United States Patent 10,717,768 (PROTEINS FROM ANAEROBIC FUNGI AND USES THEREOF) - sequence listing, part 2

SEQ ID NO: 13954 - DNA, 948 bp, Piromyces finnis
  6hp_glycosidase
tccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttacgc

SEQ ID NO: 13955 - DNA, 48 bp, Piromyces finnis
  6hp_glycosidase
ggaactttctcaagcctacggtaactgggatatctacatcatgcactg

SEQ ID NO: 13956 - DNA, 270 bp, Piromyces finnis; identical to SEQ ID NO: 13952
  6hp_glycosidase

SEQ ID NO: 13957 - DNA, 48 bp, Piromyces finnis; identical to SEQ ID NO: 13955
  6hp_glycosidase

SEQ ID NO: 13958 - DNA, 948 bp, Piromyces finnis; identical to SEQ ID NO: 13954
  6hp_glycosidase

SEQ ID NO: 13959 - DNA, 60 bp, Piromyces finnis
  6hp_glycosidase
ctaccacagattctgggctcaaactgaaattgctgttgctaacggtcttatttccattta

SEQ ID NO: 13960 - DNA, 345 bp, Piromyces finnis; identical to SEQ ID NO: 13950
  6hp_glycosidase

SEQ ID NO: 13961 - DNA, 60 bp, Piromyces finnis; identical to SEQ ID NO: 13959
  6hp_glycosidase

SEQ ID NO: 13962 - DNA, 1119 bp, Piromyces finnis
  6hp_glycosidase
tgcttactacactggtgattacaccagtccattcaaaacttacttaggtaagactgatgaagaaattcaaaagaagcttgatgaactttggaatcactatttcaagggtgataacaacagtaaggtattttatgaccaaggtaacgaaggttacattttagatgtaaacaataatgatgttcgttctgaaggtatgtcttacggtatgatgatcgctgttcaaactgatcaccaaaaagaattcgacaaactttggaactgggctaagaaccatatgtggcacaagagtggtagttgggatggttatttcgcctggaagcgtggatcaaacggttctggtggtgatgataactgtgctccagatggtgaaatgtacttcatgatgtcattactttttgccgctaaccgttggaatgacaagaaatacatggacgatgcccaatacattcttaagagaatgtgggataacagtcaacacagtctcttcaacccagcttacaatgttattactttccaaccacaaggtaatgaaaacaatttctctgatccatcctacgatttaccagctttcgtagatctcttctctcgttggtctactactaaccaaaataaatggaaggctgctgcttctgccactcgtgatcacttatacaaatcttccaacccacaatctggtttattctctgactacaataactttgatggtactccacactctgttagttacaacagtaacgctcaaaagtacatgtacgatgctatgcgttgtgctatgaactttggtatggattactatttattcggtactgatgctaagcgtcaaactgaaatggccaaacgtatcatcaaccactttgaaaaggatggttaccaacacgctcgtttcaactgggatggtactggtggatctgaacaatacactttaggtgaaactggtgctaacgctgttgccacttatgctttaatgggaattgctggttacgaagacattattaagaagaacttaaagatggcttgggatggtaaaccaatgactggtcaataccgttactacgatggtttagttcactacttatctatgcttcatcttcttggtagtttcaagatctggaagccagc

SEQ ID NO: 13963 - DNA, 345 bp, Piromyces finnis; identical to SEQ ID NO: 13950
  6hp_glycosidase

SEQ ID NO: 13964 - DNA, 60 bp, Piromyces finnis
  6hp_glycosidase
ttaccacagattctggggtcaaaccgaaattatggttgccaatggtcttatctctattta

SEQ ID NO: 13965 - DNA, 270 bp, Piromyces finnis; identical to SEQ ID NO: 13952
  6hp_glycosidase

SEQ ID NO: 13966 - DNA, 60 bp, Piromyces finnis; identical to SEQ ID NO: 13964
  6hp_glycosidase

SEQ ID NO: 13967 - DNA, 48 bp, Piromyces finnis; identical to SEQ ID NO: 13955
  6hp_glycosidase

SEQ ID NO: 13968 - DNA, 948 bp, Piromyces finnis; identical to SEQ ID NO: 13954
  6hp_glycosidase

SEQ ID NO: 13969 - DNA, 345 bp, Piromyces finnis
  6hp_glycosidase
catgtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttactc

SEQ ID NO: 13970 - DNA, 60 bp, Piromyces finnis; identical to SEQ ID NO: 13959
  6hp_glycosidase

SEQ ID NO: 13971 - DNA, 60 bp, Piromyces finnis; identical to SEQ ID NO: 13959
  6hp_glycosidase

SEQ ID NO: 13972 - DNA, 48 bp, Piromyces finnis; identical to SEQ ID NO: 13955
  6hp_glycosidase

SEQ ID NO: 13973 - DNA, 270 bp, Piromyces finnis; identical to SEQ ID NO: 13952
  6hp_glycosidase

SEQ ID NO: 13974 - DNA, 948 bp, Piromyces finnis
  6hp_glycosidase
tccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactc

SEQ ID NO: 13975 - DNA, 1119 bp, Piromyces finnis; identical to SEQ ID NO: 13962
  6hp_glycosidase

SEQ ID NO: 13976 - DNA, 849 bp, Piromyces finnis
  6hp_glycosidase
ccatatgtggcacaagagtggtagttgggatggttatttcgcctggaagcgtggatcaaacggttctggtggtgatgataactgtgctccagatggtgaaatgtacttcatgatgtcattactttttgccgctaaccgttggaatgacaagaaatacatggacgatgcccaatacattcttaagagaatgtgggataacagtcaacacagtctcttcaacccagcttacaatgttattactttccaaccacaaggtaatgaaaacaatttctctgatccatcctacgatttaccagctttcgtagatctcttctctcgttggtctactactaaccaaaataaatggaaggctgctgcttctgccactcgtgatcacttatacaaatcttccaacccacaatctggtttattctctgactacaataactttgatggtactccacactctgttagttacaacagtaacgctcaaaagtacatgtacgatgctatgcgttgtgctatgaactttggtatggattactatttattcggtactgatgctaagcgtcaaactgaaatggccaaacgtatcatcaaccactttgaaaaggatggttaccaacacgctcgtttcaactgggatggtactggtggatctgaacaatacactttaggtgaaactggtgctaacgctgttgccacttatgctttaatgggaattgctggttacgaagacattattaagaagaacttaaagatggcttgggatggtaaaccaatgactggtcaataccgttactacgatggtttagttcactacttatctatgcttcatcttcttggtagtttcaagatctggaagccagc

SEQ ID NO: 13977 - DNA, 48 bp, Piromyces finnis; identical to SEQ ID NO: 13955
  6hp_glycosidase

SEQ ID NO: 13978 - DNA, 63 bp, Piromyces finnis
  6hp_glycosidase
taccggtgattactctggtgttgaaactgcctggagctacattgaaaagcacatgattccaga

SEQ ID NO: 13979 - DNA, 948 bp, Piromyces finnis
  6hp_glycosidase
tccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttctcttgaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactc

SEQ ID NO: 13980 - DNA, 60 bp, Piromyces finnis; identical to SEQ ID NO: 13959
  6hp_glycosidase

SEQ ID NO: 13981 - DNA, 270 bp, Piromyces finnis; identical to SEQ ID NO: 13952
  6hp_glycosidase

SEQ ID NO: 13982 - DNA, 60 bp, Piromyces finnis; identical to SEQ ID NO: 13959
  6hp_glycosidase

SEQ ID NO: 13983 - DNA, 48 bp, Piromyces finnis; identical to SEQ ID NO: 13955
  6hp_glycosidase

SEQ ID NO: 13984 - DNA, 948 bp, Piromyces finnis; identical to SEQ ID NO: 13979
  6hp_glycosidase

SEQ ID NO: 13985 - DNA, 822 bp, Neocallimastix californiae
  9-O-ACETYL-N-ACETYLNEURAMINIC ACID DEACETYLASE-RELATED
cgctattgcagcttttgttgccactactttatcggctatttctcaaacttttgccgctccagatccaaacttccatatttatttagcctttggtcaatctaatatggaaggtcaaggtccaattggaagtcaagatagaactgttgataagcgtttccaaatgatttcaactgttagtggatgtaatggtcgtcaaatgggtaattggtatgatgctatcccaccacttgctaattgtgatggtaagttaggtccagtcgattactttggacgtactttagttaagaatttaccacaagaaattaaggttggtgttgctgttgttgctgttgctggttgtgatattcaacttttcgaaaagaataactacagaaactacagattagaaagttacatgcaaggtagagttaatgcctatggtggtaacccatatggtcgtttaattgaagttgctaagaaagctcaacaagttggtgtcatcaagggaattcttcttcaccaaggtgaaactaacactggtcaacaaaactggccaaaccgtgttaaggctatctatgaagatatgcttaaggacttaggtttaaatgctaaggatgttccacttcttgctggtgaagttgttcaaagtaaccaaggtggtcaatgtggtagtatgaattctattattcaaagacttccatctgttattccaaccgctcatgttatttcttctcaaggtttaggtcaacaaggtgatggtcttcacttctcttctcaagcttaccgtactttcggtgaacgttatgctaatgaaatgttaaagattcttggtgatgttaagcc

SEQ ID NO: 13986 - DNA, 774 bp, Neocallimastix californiae
  9-O-ACETYL-N-ACETYLNEURAMINIC ACID DEACETYLASE-RELATED
tgtagctgctcctgatccaaattttcatatatatttggcttttggtcaatctaacatggaaggacaaggtcctattgagcctcaagatagaataccagaaaaacgttatcaagtactttcaacttttggtaattgtgacggtcgtgaagtcggtaaatggtatgatgcagttcctcctcttgctagatgttttgctagagttggaccaatggattattttggtcgtacattagctaaaaaattaccagaagaaattaaaattggtgcagtcattgttgctgttggtggatgtagtattcaactttttgaaaaagataactatatgaattataaattagaaaattatatggttgatgtagttaaaaactatggtggtaatccttataagcgtttaattgatgtagctaaattagctcaaaaagatggtgtcattaaaggaattcttcttcatcaaggtgaatctaacaatggtcaaactaactggccctatcgagttaaagcagtctatgaaaatattcttaatgatttaggattgaaagcagaagaagttccgcttcttgctggtgaagtcgttcaaacaagtgaaggtggtcaatgtggtggtatgaataaaattattaatactcttcccaatgttattccaacagctcatgtcgtttcatcagtaggtttaaaacaacaaggagatggttatcatttttcaacggaggcttaccgtgaatttggtgaacgttatgctgaagaaatgttaaaaattcttggtgatgttaaagt

SEQ ID NO: 13987 - DNA, 834 bp, Neocallimastix californiae
  9-O-ACETYL-N-ACETYLNEURAMINIC ACID DEACETYLASE-RELATED
gagaggaaatatagctattactacaattttggcaactgcttttactttagtttcaaagacatgggccgcccctgatccaaatttccatatttatttggcatttggtcaatctaatatgcaaggggatggtaaaattgaaaaccaagatagagttgttgataaacgtttcaaaatgttagctactgcaggaggatgtaataatagaagagttggtgaatggtatgatgctattcctccacttgctaattgtgctggtggtttaggtccagttgattattttggacgtacattacttaaaaaattaccagaacaaattaaggtaggtgttgctgttgttgccgttgctggttgtgatattcaactttttgaaaaagataactacagaagttataatatgccagattggatggttggtattgttaatggttacaatggtaatccatatggacgtttaattgaaatgggtaagaaggccaaggaagctggtgtcattaaaggtattcttcttcatcaaggtgaaactaacactggtcaacaagactggccagatcgtgttaagaaaatttatcaaaatattattaatgatttaagtttaaatgctgatgaagttccacttcttgttggtgaagtagttaatgctgattctggaggtgcctgtgcttatcataacgaagttattaaaagagttccacaacttattaaaaattcatacgtcatatcttctaaaggtttaccacaaaagggtgatggacttcactttacttcagccggttatcgtacatttggtgaacgttttgctgatactatgttaaaaattcttggtaacgttagtgt

SEQ ID NO: 13988 - DNA, 834 bp, Neocallimastix californiae
  9-O-ACETYL-N-ACETYLNEURAMINIC ACID DEACETYLASE-RELATED
gagagtaactctttctatttcaacattattaatttcagcaatttctttaattaccaagacatgtgctgctccagatccaaacttccatatttatttggcctttggtcaatctaatatgcaaggagcaggtcaaattgcaaatcaagataaaactgtagataaacgttttcaaatgttagccacagctggaggttgtaataatcgtcaagttggtaattggtatgatgctattcctccacttgctcattgtggtggaggtttaggtccagttgattactttggtcgtaatttaattaaaaacttaccttctcaaattaaagttggtgttgttgttgtcgctgtagctggatgtgatattcaactttttgaaaaggataattacagaagttataatatggctgactggatgaaaagtattgttaactcctatggaggtaatccatatggaagattagttgaaatgggtaaaaaggctcaacaagctggtgttattaaaggtattctcttccatcaaggtgaaactaacagtggtcaacaaaattggccaaatcgtgttaaaggtatctatgataatcttatcaaggatttaggcttaaaggcttcagaggttcctcttcttgctggtgaacttgtttctagtgctaaagggggtgtttgtggaggtcataatagtattattcaacgtcttccacaagttattccaaatgctcatgttatttcttctagtggattagatcaacaaggtgatggtctccacttcacatcagctgcttatcgtacttttggtcaacgtttcgctgagactatgttaaaacttcttggtgatgttaaaac

SEQ ID NO: 13989 - DNA, 834 bp, Neocallimastix californiae
  9-O-ACETYL-N-ACETYLNEURAMINIC ACID DEACETYLASE-RELATED
gagagcaaatatagctattactgcaattttaacaactgcattatcttttgtttcaaaaacatgggctgcaccagatccaaatttccatatttatttagcttttggtcaatctaatatgcaaggtgcaggtcaaattgaaaatcaagataaaaccgttgataaacgttttcaaatgattgctacagctgctggatgtaataatcgtagagttggtgaatggtatgatgctattccaccacttgctcattgtggtggtggtttaggtccagttgattattttggtcgtactttagttaaaaaattaccagaacaaattaaagttggtgtagctgttgtagctgttgctggttgtgatattcaactttttgaaaagaataattatagaagttataatatggcagattggatgaaaggtattgttgattcttatggtggtaatccatatggtcgtttaattgatatgggtaaaaaagctcaacaagttggtgttattaaaggtatacttcttcatcaaggtgaaactaataatggacaaagtgattggccaaatcgtgttaaagctatttatgaagatattcttaaagatttaagtttaaaagctgaagaagtcccacttcttgttggtgaaacagttgattctgattctggtggtgtttgtggttatcataatagtgttattgctagaattccacaagttattaagaatggtcatgttatttcttctaaaggtttaggacaacaaggagatggtcttcactttacctctgctgcttatcgtacttttggtgaacgttatgctgatactatgttaaaacttcttggtaatgttcaacc

SEQ ID NO: 13990 - DNA, 834 bp, Neocallimastix californiae
  9-O-ACETYL-N-ACETYLNEURAMINIC ACID DEACETYLASE-RELATED
gagagctaatattgctattgctactttcttagctacttccttatcatttgtatctaaggcttttgctgcaccagatccaaatttccatatttatttagcttttggtcaatcaaatatggaaggtaatggtccaattgaaagtcaagatagaactgttgacaagcgttttaagatgcttgctactgtaagtggatgtaacaatcgtcaagctggtaattggtatgatgctactccaccacttgccaactgtaatggtaaattaggtccagtcgattactttggtcgtactttagttaagaaattaccacaagaaattagaattggtgccgttgttgttgctgttgccggttgtgatattcaacttttcgaaaaggataagtaccgtagctaccaacaaccagattggatgcgtggtattgttcaacaatacggtggtaatccatatggtcgtttaattgaaatggctaagaaggcccaacaagaaggtatcatcaagggtattcttcttcaccaaggtgaaactaacactggtcaacaagactggccaaaccgtgttaaaggtatttacgaaaatattcttaatgatttaggtttaaaagctgaagatgttccacttttagctggtgaagttgtttctagtgctgttggtggtcaatgtggttctcataatgctgtcattcaaagacttccaagtgttatcaagactgctcatgttatttcttctcaaggtttacaacatcaaggtgatggtcttcactttacttcagctgcttaccgtactttcggtgaacgttatgctgaagaaatgttaaagattcttggtgatgttcaagt

SEQ ID NO: 13991 - DNA, 834 bp, Anaeromyces robustus; identical to SEQ ID NO: 13989
  9-O-ACETYL-N-ACETYLNEURAMINIC ACID DEACETYLASE-RELATED

SEQ ID NO: 13992 - DNA, 834 bp, Anaeromyces robustus; identical to SEQ ID NO: 13990
  9-O-ACETYL-N-ACETYLNEURAMINIC ACID DEACETYLASE-RELATED

SEQ ID NO: 13993 - DNA, 780 bp, Anaeromyces robustus
  9-O-ACETYL-N-ACETYLNEURAMINIC ACID DEACETYLASE-RELATED
caaaacttttgctgcaccagatccaaatttccatatttatttagcatttggacaatctaatatgtatggaagtggtgatattgaagaacaagataagactgttgacagtcgtttccaaatggtttccactgtaaatgattgtggatctcgtaaattaggtacttggtatgatgccattccaccacttgctacttgtgatgctggtttaggtccagctgattactttggtcgtactttagttgaaactttaccaaaggaaattaaagttggtattgctgttgttgcagttccaggttgtgatattcaacttttcgaaaaagataattaccaaaattatttcccagatgattggatgtatccatttattgatgaatatggaggtaatccatatggtcgtttagttgaaatgggtaagcaagctaaagaattaggtgttattaagggtattcttcttcaccaaggtgaaactaacaatgaacaaactgactggccattacgtgttaaggctatttatgaaaatcttcttacagatttagaattaaaggctgaagaagttccaattcttattggtgaacttgttcaattaagtgaaaacggtacttgtggtgctatgaatgctattattcaaactgttccaagtgtcattccaactgctcatgttatttcttctgaaggtttaaaacaacgtggtgatggtttccactttacttctccatcctatcgtgtctttggtcaacgttatgctgaagttatgttagaccttcttaaggacactactcc

SEQ ID NO: 13994 - DNA, 819 bp, Anaeromyces robustus
  9-O-ACETYL-N-ACETYLNEURAMINIC ACID DEACETYLASE-RELATED
tattgctattgctgccttcgtagcctccactttatcggctatttcttttgctgctccagatccaaacttccatatttacttagccttcggtcaatctaatatggaaggtcaaggtccaattggacaacaagatagatccgttgataaacgtttccaaatgatttcaactgtcaatggttgtaatggtcgtagacttggtgaatggtatgatgctgttccaccactttcaagttgtagtggtaaattaggtccagtcgattatttcggtcgtactttagtaaagaaattaccacaagaaattaaagtaggtgttgctgttgttgctattgctggttgtgatattcaacttttcgaaaagaataattacagaaattatcaattacaatcttacatggttaacactgttaatgcttatggtggtaatccatatggacgtttaattgaaatgggtaagaaggctcaacaagttggtgttattaagggtattcttcttcaccaaggtgaaaccaacactggtcaacaaaactggccaaaccgtgttaaggctatttatgaagatattcttaaagatttaggattaaatgctaaggatgttccacttcttgctggtgaagttgtttcaagtcaacaaggtggtcaatgtggtagtatgaattctattattcaaagtcttccaagaactattccaactgctcacgttatttcatctcaaggtttaggtcaacaaggtgatggtcttcacttctcatctgatgcttaccgtacttttggtcaacgttacgctgaagaaatgttaaagattcttggtgatgttcaagc

SEQ ID NO: 13995 - DNA, 786 bp, Anaeromyces robustus
  9-O-ACETYL-N-ACETYLNEURAMINIC ACID DEACETYLASE-RELATED
tagtcaagtttttactgcaccagatccaaattttcacatttatttagcatttggtcaatctaatatggaaggtcgtggtaaaatttatcaagaagataaaactgttgatagtcgtttccaaatgattgctactgtcgatggttgtaaaggtcgtaaatttggtgaatggaatgatgctattccaccactttcaaattgtaatatgggtcaattaggaccggctgattatttcggtcgtaccttagttaaaaaattaccacatgaaattaaaattggtattgctgttgttgctattggtgattgtgatattcaactttttgaaaaaacaaaaaatagaaattatcgaatcccaaatgagataaaaaatacttatgaagcctatggtcgtaattcatatagtcgtttaattgaaatgggtaaaaaagctcaagaagttggtgttattagaggtatacttcttcaccatggtgaaaataatataggtcaaactgactggccaaatcgtgttaaagctatttatgataacatacttaatgatttagatttaaattctgatgatgttccacttcttgctggtgaagttgtttcatctgaaaaaggtggaaaatatggtgaaatgaacccaatcattcataatcttgctaaaatttgttcaacttgtcacattatttcttctcaaaatttagattcagaagatgatggtttccatttcactacaaatgcttatcgtaccttaggtgaacgttatgctgaagaaatgttaaagatacataattataatcagtc

SEQ ID NO: 13996 - DNA, 3534 bp, Neocallimastix californiae
  AAC-RICH MRNA CLONE AAC4 PROTEIN-RELATED
tattaattctaatactaataatataatggataattctggaaattgttgggcaacttatcttgataaaaattatacttgttgttcaaatgataatattgaaattaaatccattaatatggatggagaatggggtcttgagaataataattggtgtggtttaagaaatagtaaagttcattggaatgatcgtgaaagtattgatgaaactagacaacagtggaatatatttaaaaataaatgggataatgagtataaaacaaattttgaacgactttcagtttttgtcggggaagatgaatctaaacttaattttggttggtattcaacccatcaagaaactccagttattcgttttggttctaagcaagatatgtcagatgctaaagaatttatgggtaatagtgaatttcatagagaattaaaaggtattagatatttttcaaataaagtgaccgttgatggtataaaacgtaaatctacctattattatcaaagaaagttaaatagtcaatgggaagaaaccattcaatttgatactcatgatccagaaaattttaattttatttttttaggggatcctcaaattggtggttctaacagtcgtcattccgccttggatcctactcgaccacttacagtggaggaaggtactagaaatgatgcttttaattggaacagaacaattacaaattcattccaatttactcgtgaacccagtgttattatgacagcaggtgatcaagcagattcaatgtgtattgattctaaccttgatgaaatttataatcaagaaactcaatactctgctttccttcttccagaattaatgcaaaagattccaaccgcaaccactgttggtaatcatgactccttcacaacaaattatagaaatcattttaatccaccaaacacttacactaccccggaatatgttatggctaatggattttcaggagtaataccaggatatagttatttctttaaatataataatgtccttgtggtcgtgctagaaaccaattataataattgtaatgattttgaaaacgttattaataaggccattgagaaatatccatataccgattggcgtattgccatgtttcatcatgatatatatggtgatggttatattcattcgacggaggattatattactaaatatttacgtccatgtttaactggtattttcaccgataaaaaatttgatcttgttattaatggtcatgatcatgtctatacggcttcacatttcatttcgtatactggtgcttataataatggtggttatagtttcagtcatatagaaaagaataaagtttatcgagatccaaagggaaccctctatattacagctaattgttcttctggtagtaaactgtatacatttgttgatgataatctggaaccggattatgttaatttttctaatcaaactttcaccgctacctttggtgtattagattttaaaaaggaaaatggtatttctagattaagcgttgcgtcttatgaagtagaaacgtttaatcttacagatggtccttacattttcgaaaaaaatagtgtagtagaaggaagtgacaaagttagtgatggtggtggtaataaagttcttaaatgggttattattattgttgtcgcagatattatcattttattatttttatatttcttttttgctcgtggttatttcaaagaaaaaagggaaaatcacggaaaaagaatttcttcctcttctacttctttttattctcacggttatcccacccatttaaataataataataatgataataataataacaataataataataatactaatcattttaattataataatcattctaatgtctcttcctacataaataataccaataatcctatgatgatgaatgatttaactacactacctcattctttacctactccatctcttggtaattctttatatcctcttaatcaaagtcgaaatcaaaatcaaagtcaaaatcaaagtcaaagtcaaagtcaaaatcaaaatcaaaatcaaagtcaaagtcaaattcaaaatcaaagtgaaattcaaattccaatttccgatgattttcctaatgttagtgtaagaactaattctcttcaagaaataagttcagctaatgctactcataacaatagtatttccatatcttcaataaaagataatagaaattcctttaaacaacaaaagaatttctttgatgccggtggtaatgccgaattaaatcaagatttatatcttcttacattaaataaattaagaaataataaatttgtaggatatgttaatccattagatcgtcaacaacaacaacaacagcaaaagcaaaagcaacagcaacaacaacagcaatcactacaaaatagatcaccttctttaccacaatctaaatctaattctattgaatctacaccattaaaatcaaaatcatatgatatgtatccttcttctatgattagatcaaccattgctcatccatccagatcatttgatcttccaccaactaaatcatatattgctcgtccatttagatcatttgatcttcaaccttcggaaactatcgcttctcctattgtaaaatcatcctctttcaatcaaaccaattttagtaaaagttttgaatctgatgaacccttaaatgttagtagcttaggtgagaatgaacaagataatcatttaattttagatcctaatatgccatctggggtagttcttacaaaggatgatgatgatgatgatttaagtaaaaaaatgggtatttcctctcattctaaaataatagaagaacctgatattagtttaggtatagtggatgaaactgatctttccataaatcatggaaaacaaaatataagtaatattgatggttttcaagccatgaaagacattgatattagtttaagtagtgttggtagaggagatgaagaagaagaagaagaagaagtttctttagaggtcggtcatatcatagaacctagtttcaattttgaggttaaaaatcaacaacaacctatcagtcaatctagtagtggattaattagtagtccaactttaacagatcaagttgtcaattcctcaaaatatttattaaataataataataataataataataataataataataataataataataatagtaataataacaataacaataacaacaacaataatactaataataatagtattcctccctcaaggacatcttttggtttaaaacgtgctaatcctctctatctcaatattccctctaataaattaaattccggaaatataccaatggcatcatcatcaacaaccaaaaattatttaaatttaaaacataatcaaattacggatcaaacccaagcacatatgaatgttacctctccaagaaaaacatcatttaataccgaaagtgaagaggctaataaaaacaatagtaatacaaaaaaaataaatttaaattattttaatgaaaaagatataaataaagttaaaattactaaagataatgtagataatatttt

SEQ ID NO: 13997 - DNA, 897 bp, Neocallimastix californiae
  AB_hydrolase
atttgaaaagatcatgttcggtgaaaagccacgtaatccagataaggttgaaggaagaaaatctggtaacaagtataccgtcactgttaccaacaagggcaatactgcctcatttgatgttactatcagtaacgctggtacagctgctaaaccaaagccagctattattggtttagaccaaggttttggtatgggtggtagtttaggcgcttcaaccaatggtcttgatgttgcctcaattacctttaacaccaataatcttgctccagaaaacaatccaagaagtggtgccttctttaaggctaacccaagtagtaatgccggtaccattatggcttgggcctggggtgttagtcgtttaattgatgcccttgagaaggattcaagtgttggtattgatgttaaacaccttgctgttactggttgttcacgtttaggtaaggctgctcttgccattggtgcttttgatgaacgtattgctctaactattccacaagaatccggttctggtggtgcttctctttggcgtgttggtgcccaagtcaacagacaaaagggtaaacaattcgttcaaggtttaggtagtgctgctactgaaggtaactggatgattagttctttcagaaattatgatggtagagaaaccactcttccattcgatcaacacatgcttactggtatggtagctcctcgtgcccttttaattattgataatgccggtcaagaatggcttggtgaagttccatctaactactgtggtcaagctactaaggaaatatttgatgctcttggtgctactgataaatacacttacactcaagaaggtggtcacatgcactgttcattaccaaacggacaattcgatgaagtcaaggactttgtaaataagttcctttt

SEQ ID NO: 13998 - DNA, 582 bp, Neocallimastix californiae
  AB_hydrolase
attcgaaaagatcatgttcggtgaaaagccacgtaatccagataaggttgaaggaagaaaatctggtaacaagtatactgtcactgtaaccaataagggcagtactgcctcatttgatgttactatcagtaacgctggtacagctgctaaaccaaaaccagctattattggtttagaccaaggttttggtatgggtggtagtttaggtgcttcaaccaatggtcttgatgttgcctcaattacctttaacaccaataatcttgctccagaaaacaatccaagaagtggtgccttctttaaggctaatccaagtagtaatgctggtaccattatggcttgggcctggggtgttagtcgtttaattgatgcccttgagaaggattcaagtgctggtattgatgttaaacaccttgccgttactggttgttcacgtttaggtaaggctgcacttgccattggtgcttttgatgaacgtattgctcttactattccacaagaatccggttctggtggtgcttctctttggcgtgttggtgcccaagtcaacagacaaaaaggtaagcaattcgttcaaggtttagg

SEQ ID NO: 13999 - DNA, 627 bp, Neocallimastix californiae
  AB_hydrolase
tactcaaaaacaaccacaaacaactcaaaaggttcaaccaactcaagctcaagttgttgactgctctggaaagactctcaagagtaacactaacctctctattggtggtcgtaaggttattgttaaattccctaacggttacagaggtgataagccaactcctcttcttattaactaccatccaattatgggtagtgcctctcaatgggaaggtggttctcaaaccgctaaggccgctcttaatgatggtgccattgtagccttcatggatggtgctcaaggtccaatgggtcaagcttggaatgttggtccttgctgtactgatgctgatgatgtcaaattcactcgtgacttcattaaggaaattaccaataaggcttgtgttgatccaaaacgtatttacgctgctggtttctccatgggtggtggtatgtctaactacgctggttgttacctttctgatgttattgctgctgctgctccatctgctttcgatcttgctaaggaaattgttgatgctggtaagtgtaagccatctcgtccattcccaattcttaacttccgtggtacctctgaccaaattgttatgtataatggtggtctctctcaagttgtcccaggtaaacc

SEQ ID NO: 14000 - DNA, 48 bp, Neocallimastix californiae
  AB_hydrolase
tgttaaggttggtctctgtaccattaatggtggtggtcacaatgaagg

SEQ ID NO: 14001 - DNA, 48 bp, Neocallimastix californiae
  AB_hydrolase
tttcccagttcgttggtgtactcaatctggtggtcaccaatgggatca

SEQ ID NO: 14002 - DNA, 510 bp, Neocallimastix californiae
  AB_hydrolase
atggtctggtggtagacgtaaggttattattgatcttccagataattatgataaaaataagccttaccgtttaattttcggtatgcaatgtatgggtggttcatctgataatgttcgtagtgaaggttactatggtttaaagccattagatactggaaaaacttctattttcgttgctccagaaggtaatggtcaacaattaccatggggtgaagccgattacagattatttgatgaacttcttgataagttaaaggaagatctttgtattgatgaatctcgtgtcttctctactggtttcagttatggatctatgtattctaatggtctttcctggaatcatcaaaaggtacttcgtggtgttgctgtttatgaaacagctgaacgtaacatctggttaccaaagcacactggtgaaccaattgcatggatgggtgttcttggttttgatgatggtctctgtactccagaaatgggtcgtcatgctcgtgatattattcttgaacacaa

SEQ ID NO: 14003 - DNA, 399 bp, Neocallimastix californiae
  AB_hydrolase
ttcatttgaattcagttggtctggtggtagacgtactgtacgtattgatattccaaacaactacaacaaccaaaatccataccgtttagtcttcggtatgcactgtatgggtggttgggccggaggtgtccaacaagaaggttactatggtttaaagccattagatactggtaagactactattttcgttgctccagaaggtaatggtaacgttgctccatggggacaaggtgattacaaattatttgatgaacttcttgaaaaaatgaagaatgatctttgtattgatgaatctcgtgtcttctctaccggtttcagttacggttctatgttctcaaatggtctttcctgggatcaccaaaaggttcttcgtggtgttgctgtttatgaaactgctga

SEQ ID NO: 14004 - DNA, 814 bp, Neocallimastix californiae
  AB_hydrolase
tgatgatggtttaaccgaagaacagagaggttctgttgaacatgttgaatatgaatcccacgattacgttactggtgatgaaactgaagtttacaacaaacctgcttgggtttacttaccagctggatatgatgccaatgataaggatactaaatacccattagttattttaatgcacggttatggtatgactgaagatagttggggtcttaccgataagagttctggtggtagaattaagagtatgatggatagaggtatggctaagtctaaggatgaagaagattacgttgaaaagtttattcttgttgttccaactggtttagctagtaaggattacagaaacaacaatgattacaattacactgatccatggtacgccttcggtggtgaacttagaaatgatcttattccatttatgagaagtaaatacaacattaaggatggtcgtgaaaatgttgctatggctggtctttctatgggtgctgaagaaaccttaaaccttggtattggtgaatgtcttgatttaattagttactttggtgccttctctttcccattcggtgaaactatgattgaaaaggctgaaaaggctttcccagataagagtttaacgattaagactctttacactatttgtggtgataatgattccattgcctatgataaatacggagatgctgttgaaaagatgagtaagtgggacagagttgaagatggtaaattcaaatctgaaatttacgttggtggtactcatgacttcccagtctggttcagaggttttgaacactttattccattattattcaaaaat

SEQ ID NO: 14005 - DNA, 543 bp, Neocallimastix californiae
  AB_hydrolase
caacaccaacctcactattaacggtcgtaaggttattgtaaaattcccaagtggtttctcaggtgataaggctgctccacttcttattaactatcacccaattatgggtagtgcttctcaatgggaaggtggttctcaaactgcaaaggctgcccttagtgatggtgcaattgttgcctttatggatggtgcacaaggtccaatgggtcaagcttggaacgttggtccatgttgtactgatgctgatgatgttcaatttactcgtgatttcattaaggaaatcactagtaaggcttgtgtagatccaaagcgtatttacgctgctggtttctctatgggtggtggtatgtctaactacgctggttgtttcctttctgatgttattgctgctgctgctccatctgcctttgatcttgctaaggaaattgttgatgctggtaagtgtaagccaactcgtgctttcccaatacttaacttccgtggtactcaagataacattgttatgtacaatggtggtctttcacaagttgtccaaggtaagcc

SEQ ID NO: 14006 - DNA, 48 bp, Neocallimastix californiae
  AB_hydrolase
tgctaaggttggtctttgcactattaacggtggtggtcactctgaagg

SEQ ID NO: 14007 - DNA, 48 bp, Neocallimastix californiae
  AB_hydrolase
tgctaaggtgggtctctgtaccatcaacggtggtagtcactcagaagg

SEQ ID NO: 14008 - DNA, 549 bp, Neocallimastix californiae
  AB_hydrolase
taagagtaacaccaacctcacaatcaatggtcgtaaagtcattgtaaaattcccaagtggttacaccggaaatgaagctactccacttctcattaactatcatccaattggtggtagtgcctctcaatgggaaggtggttctcaaactgctaaggctgcccttagtgatggtgccattgttgccttcatggatggtgctcaaggtccaatgggtcaagcttggaatgttggtccctgctgtactgacgctgatgatgttcaattcactcgtaactttattaaggaaattacgagtaaggcttgtgttgatccaaaacgtatttacgctgcaggtttctctatgggtggtggtatgtctaactatgctggttgttaccttgctgatgtcattgctgctgctgctccatcggcctttgatcttgctaaggaagttgtcgatgctggaaaatgtaagccagctcgtccattcccaattcttaatttccgtggtactcaagatccaattgttatgtacaatggtggtctctctcaagtcgttcaaggtaagcc

SEQ ID NO: 14009 - DNA, 612 bp, Neocallimastix californiae
  AB_hydrolase
tagtcttactcttacttctaagattaccgttccaagtggtaatggtccattcccagttattattggtatgaacagtgctactggttctcttggtagtaatttattcagtggtttcattcaagttccattcatgcatgatcaatgtgctacatactctatgaatggtcaaaagaacactaacgctccattctacaaaatgtatccaaatcttaaacaagctggtgattacatcgcctggtcttggggtgtttctcgtcttattgatggacttgaacaagttaaaagtcaaattcatgccgatatggctcacatcggtgttactggttgttcttacgctggtaagatggctctctttgctggtgctttcgatgaacgtattgctttaactatcccacaagaatctggtggtggtggtattaacgcctggagagtttctgataccatcggtaatgttgaaaagattgataatactaattactcttggttcatgcaagccttaaagaataactttggtagcaacaaagctggtaaattaccatatgatcaccatgaagctattgctatgattgctccacgtgctgtcttcgctatgggtaacccagattacgaatg

SEQ ID NO: 14010 - DNA, 522 bp, Neocallimastix californiae
  AB_hydrolase
agatgttgccttttatgaacaagaaggtatttcttatggtactctccaaagaattacttattattctgaaaatactaaatccaatcgtccaatgaatattcttcttccaccaaactataatccggaaaagaaatacccaattttatatcttttacatggtattttatctgaccagaattcattaattaaatcaaaatatggtacaccaaacatagctggttatttaatgaataaaggtatggctaaagaaatgattattgcttatccatatacttatgctccaaaagacggtattgaagttgaaccaggatttactaaggaacatgccgccggttatgataattttattaatgaattactctttaatattatgccatatatggaaaagaattatccaattcttactggcagagataatacagctattgctggtttttcaatgggtggtcgtaacagtctttatattggttattctaagccagaattatttggttatattggtgccttctcaccagctccagg

SEQ ID NO: 14011 - DNA, 792 bp, Neocallimastix californiae
  AB_hydrolase
ttataaagatgcccctggaaattatcttaatccatgtcagcaagcaggtagaattgttaaggaaagttacagtggtattaatggaggtaattcattaaatgtctacttaccatatggttacgataagaataagcaatataatatcttttatcttatgcatggtggtggtgagaatgaaaacactatattcagtaatgatgtaaaacttcaaaatattattgatcatttaataatgaatggtgaacttgaaccattaattattgttactccaaccttcaataaatgtgaagctcgtactttttacaaggaattccgtgaatcagttattccattcgttgaaggtaaatattctacttatgcaaaatctgtttctccaagtgatattaaggcttcaagaatgcacagagctttcggtggtttctctatgggttctgcttctacatgggctgtcttagtcaactgtttagatattgtcgcctactatatgccacttagtggtgataactgggaagctaatggtggttacggcaaggctaaatcagttgctgatgctattaacagagcaggtctaaagagtaatgaattctttattttctgtgctactggttcagaagatattgcttatccaaatatgaatccacaaatggatgaaatgaagaagatgcaaccatttatttacacttcagatttctctaagggtaatttctactatcttgtagctccaggtaagactcactggtggggatatgtcaaacattacatttatgatgctcttccatcatttttccatga

SEQ ID NO: 14012 - DNA, 57 bp, Neocallimastix californiae
  AB_hydrolase
cttcccagttcgttggtgtactcaatctggtggtcacatttgggatcacaaagaccc

SEQ ID NO: 14013 - DNA, 528 bp, Neocallimastix californiae
  AB_hydrolase
aggttctttcgaatttaattggtctggaggtaaacgtactgtacgtattgatattccaaataattatgataacaagcatccataccgtttagtatttggtatgcactgtatgggtggttgggccggaggtgtccaacaagaaggatattatggtttaaagccattagataccggtaaaactactatttttgttgccccagaaggtaatggccaacaagctccatggggtcaagctgattaccaattatttgatcaacttcttgaaaaattaaagaatgatctttgtattgatgaatctcgtgtcttctcaactggttttagttatggttctatgttcagtaatggtttatcatggaaccatcaaaaagttcttcgtggtgttgctgtctatgaaactgctgaacgtaatatttggcttccaaaacatactggtgaaccaattgcttggatgggtgtacttggtcttgatgatggtctttgtactcctgaaatgggtcgtaaagcaagagatattattcttgaacacaa

SEQ ID NO: 14014 - DNA, 399 bp, Neocallimastix californiae
  AB_hydrolase
cgaatttaatttcaattggtctggaggtagtcgtaaggttcttattgatattccacaaaattatgatagtagtcatccataccgtttagtatttggtatgcaatgtatgggtggttccgctggaaatgttcgtaatgaaggttattatggattaaagccattggatactggaaagactactatttttgtagctcctgaaggtaacggtcaacaattaccatggggtgaagctgattacaaattatttgatgaacttcttgaaaaattaaagggtgatctttgtattgatgaatctcgtgtcttctctactggttttagttatggttctatgttctcaaatggtctttcttggaatcaccaaaaggttcttcgtggtgttgctgtttatgaaactgcaga

SEQ ID NO: 14015 - DNA, 816 bp, Neocallimastix californiae
  AB_hydrolase
tccaccagaattccttgaaagaaaagatggtgtggaatacccagctattgaaaatatctcttactattccacaactactcaaagtgaacgtccattagttgttgttcttccaccaaattacaatgaaaagaagaagtacccagtcgtttacatattacacggtattatgactgatggtagtttcatgttacaagaaggtttcggtactgttactatcccaggaaatttattccataagcacatggctaaggaatttattatggttcttcctaatcaatacgctccagctccaggaaccgaagttgaacctaatttaaatgaagaatattttgctggttacaataacttcattaatgatttagttaatgatatcatgccatacatgaaaaaacattattctattgctactggtaagaaaaacacggccatatgtggttactcgtttggtggaagaaatagtttatacattggtttaaagagaccagatttatttggttacgtcggttccttctctccagctccaggtattcttccaggggatgatgtctttactggtcatcataatggtttatttaaagaagaaaaggatgtagtttttgcaggtaaaccaccatatcttaccatgatttcttgtggtactaatgatactgtcgttggtaccttcccaaaaagttatcatgaagctttaacccataataaccaacaacatatttggtatgaaatgactggtcttgaccatgctgatgatgccgccattaattctccatattacaacttcttctcatctatctttggacaagtaaataaaaaaggcaa

SEQ ID NO: 14016 - DNA, 744 bp, Neocallimastix californiae
  AB_hydrolase
tggtacttgttctggaaagacacttaaaagtaacaccactcttaacatcggtggtcgtaaggttatcgtaaagttcccaagtggttattctggtgataagaatgttccacttcttattaattatcacccaattggtggtagtgctactcaatgggaaggcggttctcaaactgctaaggcagctcttaatgatggtgctattgttgctttcatggatggtgctcaaggaccaatgggacaagcttggaatgttggtccatgttgtactgatgctgatgatgttcaatttactcgtgacttcatcaaagaaatcacaagtcaagcttgtgttgatactaatcgtatttatgcagcaggtttctccatgggtggtggtatgtctaactactcaggttgtatgcttgctgatgttattgcagcagcagctccatctgcatttgatctttctaaagaaattgtcgattctggaaaatgtaaaccatctcgtccattcccaattcttaacttccgtgatactcaagataatgttgtaatgtatgaaggaggactttctcaagttgttccaggtaaggccattactttcttaggtgctaagaacaactttaaagaatgggccaaaatgaatggctgtaccggtgaacccaaaatgaacaccccaggaaacaactgtgaaatgtatgaaaattgttcaggtggagctaaagttggtctttgtactattaatggaggaggacacagtgaagg

SEQ ID NO: 14017 - DNA, 396 bp, Neocallimastix californiae
  AB_hydrolase
tttcgaatttaattggtctggtggtagacgtactgttcgtattgatattccaaacaactataataaccaaaacccataccgtttagttttcggtatgcactgtatgggttgctgggctggtggtgttcaacaagaaggttactttggtttaaaaccattagatactggtaagactactatttttgttgctccagaaggtaatggtaaccaagctccatggggacaaggtgattacaaattattcgatgaacttctctctaaattaaagaacgatctctgtattgatgaatcacgtgttttctctactggtttcagttatggagctatgttctctaatggtctttcctgggatcatcaaaaggatcttcgtgctgtcgctgtttatgaaactgctga

SEQ ID NO: 14018 - DNA, 405 bp, Neocallimastix californiae
  AB_hydrolase
tggttcattcgatttccaatggtctggaggtaaacgtactgttcgtattgatgttccagataattataataataaaaatccatatcgtttagtctttggtatgcactgtatgggtggttgggctggtggtgtccaacaggaaggttactatggcttaaaaccattagatactggtaagaccactatttttgttgctccagaaggtaatggtaaccaagctccatggggtgaaggtgattacaagttgttcgatgaacttcttgaaaaattaaaaggtgaattttgtatagatgaatctcgtgtcttttctactggtttcagttatggttctatgttctcaaatggtctttcatggaatcatcaaaaagttttacgtggtgttgccgtttatgaaactgctgaacg

SEQ ID NO: 14019 - DNA, 819 bp, Neocallimastix californiae
  AB_hydrolase
ttgtccagaggaattccttcaaaaaaaggaaggtgttgaatacccaactgttaaaaacttgacttattattcgacaactactaaaagtgaacgtccattacacgttcttcttccaccaagttatgatggaaagaaaaagttccctgttgtttacttattacacggtgttatgactaatggtgaatttatgttacaagaaggtttcggtacaattgcaattccaggaaatttgttccataaacacatggctaaggaatttattatggttcttccagatcaatatgctccagctccaggaaccgaagttgaaccaaatttaaatgaagagtactttgctggttacaataatttcattaatgatttagttaatgatatcatgccatacatgaaaaagaattatagaatatttactggtaagaaaaacactgccatctgtggttactccttcggtggaagaaacagtttatatattggtttaatgagaccagatttatttggtttcgttggcgctttctctccagctccaggtattcttccagctgaagatatgttcactcatcataatggtttattcaaggaagaaaaagatgtagtttttcaaggtaaaccaccatatcttactatgatttcctgtggtacaaatgactttgttgttggtacattcccaaaaagttatcatgaagctttagaacataaccaccaagagcatatttggtatgaaatgactggtcttgatcacggtgataatgaatctgttacttctcctctttacaacttcttttcatctatctttggacaattagatgaaaaaaagaaaaa

SEQ ID NO: 14020 - DNA, 801 bp, Neocallimastix californiae
  AB_hydrolase
tatcaccgataattgtccagatgttgctttcaatgcacaagaaaacattacttatggtactcttcaaagaataacatactattcctctaatactaaaaccgaccgtccaatgaatattcttcttccaccaaattatgatccagagaataaaaaatatccagttttatatcttttacatggtattttatctgatcaaaattctttaattaaaccaaaatatagtacaccaaatattgctggttatttaatgcatgaaggtcttgctaaggaaatgatcatcgtctttccttacacttatgctccaaaggatggtattgaagttgaaccaggatttactgaagaacactatgcaggttataataatttcattaatgaattacttgatgttattatgccatacatgaacgaaaactatccaattcttactggtagagataatactgcaattgctggtttctctatgggtggtcgtaacagtctttacattggttacactaagccagagttattcggttacattggtgctttctctccagcaccaggtgtacttccagaagaaggtaagaagggtttacttactgaagaaactttccgtattgaagataaacaatatactccatatgttacccttgtttgtactggtacagaagatgacgttgttgctgaatatccatccatttatcatggtgtcttaaccaacaatgaacaaccacatctttggtatgaagttccaactggtggacatgatggtattaccgttagtagtggtgtttacaactttatgcaaactttatttggaat

SEQ ID NO: 14021 - DNA, 51 bp, Neocallimastix californiae
  AB_hydrolase
attccctgttcgttggtgtactcagtccggtggtcacatttgggatcacaa

SEQ ID NO: 14022 - DNA, 525 bp, Neocallimastix californiae
  AB_hydrolase
ttccttcgaatttaattggtctggtggtaaacgtactgttcgtattgatattccagataactatgacaacaagaaagcctatcgtttagttttcggtatgcattgtatgggtggttgggccggaggtgtccaacaagaaggatactatggtttaaaaccattagatactggtaaaactactattttcgttgctccagaaggtaatggtcaacaagctccatggggtcaagctgattaccaattatttgatcaacttcttgaaaagttaaagaacgatttatgtattgatgaatctcgtgtcttctctactggtttcagttacggttctatgttcagtaatggtctttcctggaatcaccaaaaggttcttcgtggtgttgctgtctatgaaactgctgaacgtaatatttggcttccaaaacatactggtgaaccaattgcttggatgggtgtccttggtcttgatgataatctttgtaccccagaaatgggtcgtaaagctagagatattattcttgaacacaa

SEQ ID NO: 14023 - DNA, 808 bp, Neocallimastix californiae
  AB_hydrolase
tgatggtttaagtgacagtgacagaggtactgttcaacatattgaatatccaactcatgattatatgactaatgatgaaaatgatacttacaacaagccagcttgggtttacttaccagcaggttatgatccagaagataaggacactaaatatccattatttatcttaatgcacggttttggtcaaactgaagataattggggtcttaccgaccaaggttctggtggtaagattaagggtatgatggatagaggtatggctaaaccaaaggatgaagaaggttctgttgaaaagttcattcttgttgttccaactggtatggccactagaaattacagagaaaatggtaactatgattacactgaaccatactatagatttggtggtgaacttagaaacgatcttattccatatatgaaaaagaattataacattaaagaaggtcgtgaaaatatggccatggctggtctttccatgggtggattccaaacattatatattggtattggtgaatgtcttgatatcatgagttactttggtttcttctcctatccatttactgatgatcttaaggaaaaaattgaaaccaatttcccagagaaggatttaactattaaacgtctttacaccatttgtggagataatgatccaactccattcagtgatttctataattatgttgatgtattaagtaaatgggataaagttgaagatggtaactttagttatgaagtctacccaggaggtactcatgacttcccagtatggtatagaggttttgaacatttcattccacaattatttaaa

SEQ ID NO: 14024 - DNA, 783 bp, Neocallimastix californiae
  AB_hydrolase
tgccccaggaaattacttaaattcttgcccacaagctggtagaattgttaaggaatattacaatggtatcaatggtaataatgcattaaatgtttacttaccatacggctatgacagtaagaagcaatacaatatcttctatcttatgcatggtggtggtgaaaacgaaaacacaattttcagtaatgatgttaagcttcaacctattattgataacatgatcatgaatggtgaacttgaaccattgattattgttactccaactttcaacaaatgtgaagctcgtactttctacaaagaattacgtgaatctgttattccattcgttgaaggtaaatactctacttatgctaaatctacatctccaagtgatattagagcttctagaatgcacagagctttcggtggtttctccatgggttctgcttccacttgggctgtttttgtcaactgtttagatattgttgcttactatatgcctcttagtggtgataactgggaagctaatggtggttacggtaaggctaagaatgttgctgacgctgtcagtagattcggtataaagagcaatgaattctttatcttctgtgctactggttctgaagatattgcttatccaaatatgaatccacaaatggatgaaatgaagaagatgcaaccatttatttacacttctgacttctctaagggtaacttctattatcttgtcgccccaggtaaaactcactggtggggatatgttaagcattacatttatgatgctcttccatctttcttccacga

SEQ ID NO: 14025 - DNA, 798 bp, Neocallimastix californiae
  AB_hydrolase
catgagctatagagatgctccaggcaattatttacaaccatgtcaacaagctggtagaattgttaaagaatattataatggtattaatggttctaattcattaaatgtttacttaccatatggttacaatagtaatcaacaatacaatattttctatcttatgcatggtggtggtgaaaatgaaaacactatttttggtagtgacgtttatcttcaatacattattgatcatttaattatgaacggtgaacttgaaccattgattattgttactccaaccttcaataaatgtgaagctcaaaccttctacaaagaattccgtagttccgttattccattcgttgaaggtaaatactcaacatatgccaaatctacctctgaaagcgatattagagcctctagaatgcacagagcttatggtggtttctctatgggttctgtctctacttgggccgttctcattaattgcttagatattgttggttacttcatgccacttagtggtgactgttgggaagctaatgatgcatatggtaaggctaaggccgttgctgatgctattaatagatcaggtttaagaagtaatgaatacttcattttctgtgccactggttctgatgatattgcctatccaaatgttactccacaaattgaacaaatgaagaaaatgtctcaatttatttatacatctgacttctctaagggtaacttctattatcttgttgctccaggaaaaactcactggtggggatatgttaagcattatatttatgatgctcttccatcttttttccatga

SEQ ID NO: 14026 - DNA, 783 bp, Neocallimastix californiae
  AB_hydrolase
ttctcttactcttacttctaaactcagtgttccaagtggtagtggaccattcccagttattattggtatgaatagtggtactggttctcttggtggtaacttattcagtggctttattcaagttccattcaaccatgatcaatgtgctcaatactctatgaatggtcaaaagaatactaatgctccattctacagaatgtatccaaatctcaaacaagctggtgattacattgcctggtcttggggtgtttctcgtcttattgatggtcttgaaaaagttaaggatcaaattcatgctgatttatcacacattggtgttaccggttgttcttatgctggtaagatggctctcttcgctggtgccttcgatgaacgtattgctttaactatcccacaagaatctggtggtggtggtattaacgcctggagagtttctgatactattggtaacgttgaaaagattgataacaccaactactcttggttcatgcaagctttaaagaataactttggtagtaacagagctggtaaattaccatacgatcatcatgaagctattgctatgattgctccacgtgctttcttcactatgggtaatccagattacgaatggttaggtgataagtctggttacacttctgctatggctgcctatgaagtttggaaggctatgggtgttgaagacagattcggtttcaatattgtaggtggtcacatgcattgctctgctgctggttctcaaaacaatgatgtcagtaagttcattgacaagttccttcgtgg

SEQ ID NO: 14027 - DNA, 528 bp, Neocallimastix californiae
  AB_hydrolase
tggctctttcgatttccaatggtctggtggtaaacgtactgttcgtattgatgttccagacaactataataataacaatccataccgtttaatttttggtatgcattgtatgggtggttgggctggtggtgttcaacaagaaggttactatggtttaaaaccattagatactggaaaaacttctatttttgtagccccagaaggcaatggtaaccaagctccatggggtcaaggtgattatcaattatttgaccaacttcttgataaattaaagaatgaattctgtattgatgaatctcgtgtcttttctaccggtttcagttacggttctatgttctctaatggtctttcctggaatcatcaaaaggttcttcgtggtgttgctgtctatgaaactgctgaacgtaatatctggcttccaaaacatactggtgaacccatagcttggatgggtgttcttggtcttgatgatggtctctgtactccagaaatgggtcgtcatgctcgtgatatcattcttgaacacaa

SEQ ID NO: 14028 - DNA, 48 bp, Neocallimastix californiae
  AB_hydrolase
ttttccagtccgttggtgtactcagtctggtggtcatatttgggatca

SEQ ID NO: 14029 - DNA, 738 bp, Neocallimastix californiae
  AB_hydrolase
tcaacaagaaggtttacctgatttcactatttaccgtccagaaaatttaaaggaagctgttgatgctgagggtcgtttaccagttattttattcggtaatggtggttgtggtcgtatttccttctcctacggtaatttcttaactgaactcgcttcctatggttacgttgttgctgctgttggtccatgggttggtgaagataacactgattatctttccttatccttagatttttctgaagaaactattaatggattcaaggctgatgctaacagtttaattgatgttgctttaagttggcttgaaaaggaaaacaaggaaagaactagtattttctataagactttaaatactaataaggttagtgccatgggtcaatcctgtggtggtttacaagcattaattatcagtactaagaatgataagcgtattaagactactgttgccctaaacagtggagctaacagtccaggtgatttattagattcccttattgttaaggatgaacttcaaaaattaactcaaccaattatctatattattggtggcgaagaagatattgctcactataatgccttagatgatttcagtcttattaagaaagttccagttgctgttgcctgtaaggcagatgctggacacatgggaacctacagtgaaccaaacggtggaacttttggtaaaatgactttagcttggttagactacattttaaagaatgacaagagtcatgatgc

SEQ ID NO: 14030 - DNA, 795 bp, Neocallimastix californiae
  AB_hydrolase
aatccttaattcttgtccaatggaagctcgtactaagcaagatggtgttaaatatccaactagtgaaaaaatcacttatcactccaacactactggaacagatcgtcaaatgaatattattcttccagttgactatgatggaactaaaaaatatccagttgtatattatttacatggtatttttggtaatgaagactctatgttagatgaaactgctatcgctcttccagttaacttatataatgaaggaaaggctaaggaagcaatttttgttcttccaaatacttatgctccaccaccaggtaaggaagttgtaccagattttaatcaagattattttgatggttacgataacttcattaatgagttaattgatgatattatgccatacgttgaacaaaattattctgttcttactggtaaggaaaatactggtctttgtggtttctctatgggtggtcgtaatagtctttacattggatacaagagaccagatttattcggttatgttggagccttttcaccagctccaggtgttactccaggtgacgatttctctggtcatcatccaggtttattccaagaaagtgaattccgtactgatgttcctccatttgttactcttgtttcttgtggtacaaatgattctgttgttggtactttcccaaagagttatcatgaaattttaactaccaatggtcaagaacacatttggttcgaagttccaggtgctgaccatgatgataaggcaattgctgctggtttatacaactacctttcaactgctttcggtgt

SEQ ID NO: 14031 - DNA, 807 bp, Neocallimastix californiae
  AB_hydrolase
tgaataccttgaaatgaaggaaggtgttgaatacccaaaggttgaaaacataacttactattctactactactgagagtaaacgtccattaattgttgttcttccaccaaactattctaaatccaagaagtatccagttctttatttattacatggtattatgacagatggttccttcatgttacaagaaggtttcggtaccattactattcctggtaatttaattcatgaacacaaagctaaggaattaattatggttttaccaaaccaatatgccccagctcctggtactgaagttgaaccagccttaaatgaaaaatactttgcaggttacaataatttcataaatgatttaattaacgatattatgccatacatgaaaaaaaattactctattgctactggtaaggaaaacactgccattgctggttactccttcggtggaagaaacagtctttacattgctttacaaagaccagatttatttggttttgttggtgctttctctccagctccaggtcttcttccagctgatgatatcttctctggtcatcacattggcttatatcaagaagaaaaggaaattcattacaccggtgaagctccatatcttactatgatttcttgtggtacaaatgatactgttgtaggtacattcccagaaagttatcataatgcctttgctaagaataatgaagatcatgtttggtaccaaattactggtgctgatcacattgataatgtttctgttacttctccagtttacaacttcattaaatctatttttggtcaattaaatgaagaaaa

SEQ ID NO: 14032 - DNA, 777 bp, Neocallimastix californiae
  AB_hydrolase
cagaagagaaggtgttgcctacggtgaagctgaaaagattacctatttctctactacagctcaaatggaccgtaaaatgaatgttatcttacctgcaggttacactgaagataagaagtaccctgttttatattatttacatggtctttctggtaatgaagattcattattagcaaaagaaagagccactattgaaatttatggtaatttagttagtgaaggtaaagctaaggaaatgattattgttcttccagattgttatgtcccattagatggtgttttcgatagaccacaattttcaccagaatatttgaaggcttatgataacttcctctatgaattaattgatgatgttatgccatatattgaatctcattattctgttgctctcggaagagaaaatactgctcttgctggtttctctcaaggtggccgtaacactatctatattggttacaaacatccagaattattcggataccttggtgctttttcacctgctcaaggtattttcccatgttatgatattatggctggtcatcaacctggtttaatgaaaccagaagaattacaagctgatgctgaagttcaaccaattgtttctatgattacagttggaactaaggactttgctgttcaaaagaatccaaaactttaccatgaagctttagctacaaatggacaacctcatatttggtttacagttccaggtgctcttcatgatgaccttgcctgtactaccggttattacaacttcctttccactttatggggagt

SEQ ID NO: 14033 - DNA, 774 bp, Neocallimastix californiae
  AB_hydrolase
agctaaggcatttagaggtattatgtatgctcaacctgaaaaagttacttatttctctaacactactcacactgaacgtcaaatgaatatcattttacctccagattattctaaagaaaaaaaataccctgttttatattatttacatgatttattaagtgatgaaaatggattattagaaaaaagtattggtactcttgaaatttatagtaatttagttaatttaggtaaggctaaggatatgattattgttcttccaaattgtattgttccagcagatggtgctaaaatagaaccaggaaattcagaagaatataatgctgcatatgataactttattaatgaattgcttcaagatgtaatgccattcatagaatcaaattattctgtagattctggtagagaaaataccgcaattgctggttttggtcaaggtggtcgtagttctctttacattggttacaaacatccagaattatttggataccttggtgctttctcacctactcaaggtcttttaccatacaataaagaacaaggtttaatgaaaccagaagaattacaagttgaagatgctgaacttcaacctatcgttactatgattactgttggtgcaaaagatactgaagctcaagaatcagcaaaactttaccatgaaactctcgcctctaatgaacaacctcatatttggtttactgttcctgatgctcttcatgatagtgatgcctgctcagctagttactataacttcatttctaccttatggaagatctt

SEQ ID NO: 14034 - DNA, 549 bp, Neocallimastix californiae
  AB_hydrolase
aaagagtaacaccaatcttaatattaatggtcgtaaagttattgtaaaattcccaagtggtttctctggtaataaggctgttccacttcttattaattatcatccaattggtggtagtgcttctcaatgggaaggcggttctcaaactgctagagctgctcttagtgatggtgctattgttgctttcatggatggtgctcaaggtccaatgggccaagcttggaacgttggtccatgttgtactgatgctgatgatgttcaattcactcgtaatttcattaaggaaatcactagtaaggcctgtgttgatccaaaacgtatttacgctgctggtttctctatgggtggtggtatgtctaactatgctggttgtttcctttctgatgttattgctgcttcagctccatctgcttttgatcttgctaaggaaattgttgatgctggtaaatgtaagccatctcgtccattcccaatccttaacttccgtggtactcaagatccaattgttatgtacaatggtggtctttctcaagttgtccaaggtaagcc

SEQ ID NO: 14035 - DNA, 48 bp, Neocallimastix californiae
  AB_hydrolase
tgtaaaggttggactttgtaccatcaatggtggtggtcactctgaagg

SEQ ID NO: 14036 - DNA, 811 bp, Neocallimastix californiae
  AB_hydrolase
tgatgatggtttaactgataaagacagaggtaccgtttctcatattgaatatcctactcacgattatatgactgatgatgaaaatgataaatacaataagcccgcttgggtttacttaccagctggttatgatccagaagataagaacactaaatatccattagttattttaatgcacggtttcggtcaaaatgaagataactggggtcttaccgatcaaggtactggtggtaaaattaagggaatgatggatagaggcatggctaaagctaaggatgaagaaggttccgttgaaaagtttgtacttattgttccaactggtatggcctctaaggacttcagagataataacaactacggtaacactgaaccatggtacaagtttggaaatgaaattagaaacgatattattccatatatgagaagtcattacaatattaaggagggtcgtgaaaatgtagccatggctggtctttctatgggtggtatgcaaaccttaaaccttggtattggtgaatgtcttgatttaatcagttactttggtgccttctccttcccatttggtgctgatatatttgaaaaaactgaaaccaatttcccagacaagaatttaactattaagggactttatactatatgtggtgatgctgatgctggagctttcgctggttacggtccagctgtcgaggcctttgaaaaatgggatagaattgatgaaggtaaatttaagtctgaaatttacccaggaggtacacacgacttccctgtctggtacagaggttttgaacatctcattccattattatttaaa

SEQ ID NO: 14037 - DNA, 606 bp, Neocallimastix californiae
  AB_hydrolase
ttcccttacccttacttcaaagatttctgttccaaacggaaatggaccattcccagttattattggtatgaatagtaatactggttctttaagtaccaatcaatttagtggatttattcaggttccatttatgcacgatcaatgcgctcaatattctatgaatggacaaaaaaatacaaattctccattctataaattatatccaaatcttaagcaagctggtgactatattgcttggtcatggggtgtctctcgtctcattgatggtctcgaacaagttaaaagtcaaattcatgctgatatggaacatattggtgttactggttgttcatatgctggtaaaatggctctcttcgctggtgcatttgatgaacgtattgctttaactattccacaagaatctggtggtggtggcattaactcatggagagtttctgatactattggtaatgttgaaaaaattgcaaataccaattattcatggttcatgcaagcattaaagaataatttcaatggtaaagctagtaaattaccctatgatcatcacgaattagttgccatgattgctcctcgtgccttctttaccttaggtaatccagactatga

SEQ ID NO: 14038 - DNA, 786 bp, Neocallimastix californiae
  AB_hydrolase
agaagctcctggaaattatctacaaagatgtcaacaagctggtaagattgttaaagagaattacaatggtatcaatggaggtaacactttaaatgtttacttaccatatggttatgataagaataagcaatataatattttctatcttatgcatggtggtggtgaaaatgaaaatactatttttagtaatgatgttaatctacataatattcttgataatatgattatgaagggagagcttgaaccacttattgttgtcactccaaatttcaataaatgtgatgctcgtactttctataaggaattacgtgaaagtgttattccatttgttgaaggtaaatattctacttatgctaaatctacttccccagctgacattaaagcttctagaatgcacagagcctttggtggtttctctatgggttcagcatctacttgggctgttttaattaattgtttagatattgttgcctactacatgccacttagtggtgataactgggaagctaatggtggatacgctaaagctaaatctgttgctgacgctattgacaagtctggattacaaaagaatcaatactttatcttctgtgctactggttctgaagatattgcttacaacaacatgaacccacaaattgatgaaatgaagaagatgagtcaatttgtatacacttctgacttttccaagggtaacttctattatcttgttgctcaaggaaagactcactggtggggttatgtcagacattacatttatgatgctcttccatctttcttccatga

SEQ ID NO: 14039 - DNA, 522 bp, Neocallimastix californiae
  AB_hydrolase
atttgaatttaactggtccggtggtagacgtactgttcgtattgatattccagacaactatgataacaaaaacccatatcgtttaattttcggtatgcactgtatgggtggttgggctggtggtgtccaacaagaaggatactacggtttaaaaccattagatactggtaagactactatttttgttgctccagaaggtaacggtaaccaagctccatggggtcaaggtgattatacattatttgatgaacttcttgaaaaattaactaatgatctttgtattgatgtttctcgtgtcttctctactggtttcagttacggttctatgttcagtaatggactttcatggaatcaccaaaaggttcttcgtggtgtagccgtttatgaaactgctgaacgtaacatctggcttccaaagaatactggtgaaccaattgcctggatgggtgttcttggtttagatgatggactttgtactccagaaatgggacgtaatgcccgtgatattatcttaaagaacaa

SEQ ID NO: 14040 - DNA, 51 bp, Neocallimastix californiae
  AB_hydrolase
tttcccagttcgttggtgtactcaatctggtggtcacatttgggatcacaa

SEQ ID NO: 14041 - DNA, 48 bp, Neocallimastix californiae
  AB_hydrolase
tgctaaagttggtctttgtactattaatggaggaggtcacgctgaagg

SEQ ID NO: 14042 - DNA, 606 bp, Neocallimastix californiae
  AB_hydrolase
tactactccaaaaccacaaccaactcaagaagttgttgactgttctggtaaaactcttagaagtaacactaacctttctattggtggtcgtaaagttattgttaaattcccaagtggttacaaaggtgataaaccagttccacttcttattaattatcacccaattatgggtagtgcttctcaatgggaaaatggttctcaaaccgctaaagctgcccttagtgatggtgctattgttgcctttatggatggtgctcaaggtaacatgggtcaagcttggaatgtaggtccatgttgtactgatgctgatgatatttctttcactcgtaacttcattaaagaaattaccaataaagcttgtgttgatccaaaacgtatttacgctgctggtttctctatgggtggtggtatgtctaactacgttggttgttatcttgctgatgttattgcagccgctgctccatctgcttttgatcttgctaaagaagttgttgatggcggtaaatgtaaaccatctcgtccattcccaattcttaacttccgtggtactcaagataatattgttatgtacaatggaggactttcccaagttgttccaggtaaacc

SEQ ID NO: 14043 - DNA, 795 bp, Neocallimastix californiae
  AB_hydrolase
cagagatgctccaggaaattaccttaacagttgtccacaagctggtagaattattaaggaaagttacaatggtattaatggtggtaatagtttaaatgtttacttaccttatggttatgataagaataagcaatacaatattttctatcttatgcatggtggtggtgaaaatgaaaatactattttctcaagagatgttaaccttcaaccaattattgataatttaattatgaatggtgaacttgaaccattgattattgttactccaactttcaataaatgtgaagctcgtactttctacagagaattccgtgaatctgttattccatttgttgaaggtaaatattctacttatgctaaatctacttctgctaatgatattaaagcttctagaatgcatagagcctttggtggtttctctatgggttcagcttctacttgggctgttcttgttaattgtattgatattgttggttactttatgccacttagtggtgataattgggaagctgatggtggttatggtaaagctaaatctgtagctgatgctattaacagagctggttttaagaaggatgaattctatatctttgctgctactggttctgaagatattgcttatccaaatatgaacccacaaatggatgaaatgaagaaaatggatccatttgtttatacttctgatttctctaaaggtaacttttattatcttgttgctccaggtaaaactcactggtggggttatgttaaacattatatctatgatgctcttccatccttcttccatgaaaaaca

SEQ ID NO: 14044 - DNA, 792 bp, Neocallimastix californiae
  AB_hydrolase
ttacagagatgctccaaacaattaccttaacagatgtcaacaagctggtagaattgttaaagaaagttacaatggtgttaatggtggtaattcattaaatgtttacttaccatacggttacactgacagtaagcaatacaacattttctatcttatgcatggtggtggtgaaaatgaaaacactattttcggtagtgatgtttatcttcaatacattcttgataatttaattatgaatggtgaacttgaaccattgattgttgttactccaacattcaatagatgtgaagctggtactttctacagagaattccgtgaatctgttgtaccatttgttgaaggtaaatactctacttatgctaaatctacttctgctgctgatcttaaagcctctagaatgcacagagcttatggtggtttctctatgggttccgtttctacttgggctgttcttatcaactgtttagattatgttggttacttcatgccacttagtggtgataattgggttggtaatggtggttatggtaaggctaaatctgttgctgatgctattgataagtttggttacagaactgatgaatatttcattttctgtgccactggttccgatgatattgcctatccaaacatgaacccacaaattgatgaaatgaagaagatgaaacaattcatttacacttctgacttttctcaaggtaacttctattaccttgttgctccaggaaaaactcactggtggggatatgttaagcattatatttatgatgctcttccatacttcttccatga

SEQ ID NO: 14045 - DNA, 777 bp, Neocallimastix californiae
  AB_hydrolase
tgataaagctgaaggagttacagtagaaaaaaaatcatattattctaatataactaagggttatcgaaaattaaatgttgttcttccaccaaactattccacagaaaagaagtatccagttttatatttacttcatggcatatatggagatgaagactctatgctcaacaatggtatgggtacacttaatgttccagctaatcttgcaaaggaaaataaagcaaaagaaatgattattgtacttcctaatgaagttgccttattaccaggaaccgatccaaacattacaaaaaatttttctttggagcatcttaaagtttatgataattttattaatgaattacttaataatattatgccatttatagaatatgaatattccgttgctaccggtagagacaatactgctattgccggtttctctatgggtggtcgtactgctctttacattggatacacaagaccagatttatttggttatgtcgccggtttttcaccagcatggggtcttactccgggaggtatggatatcttaccaggagtattcccaagagatgaagattttaagattcaaaacccatccgaatatactccatatgtcacattaattagtactggtactgcagatggcgtcgtggaagactatccagcctcttatcatgaaatcttagaaaaaaatcaacaaaatcatatctggattgaaatagaaggtgctgatcatgatgagagtgccgttattgttggtttatataatttcgttgctactctttttggaat

SEQ ID NO: 14046 - DNA, 576 bp, Neocallimastix californiae
  AB_hydrolase
taagggtttcatggatagaggtatggctagtggtgatgttggtagatttattcttgtttgtgtaactggtgttgctagtagaaattggggtccaaatggtgctggtaatgatgttaatggtttcaatgcttttaaaggtgaacttagagatgatattattccatatatgagatctaaattcaatattaagagtggtcgtgataatgttgctcttgctggtctttctatgggtggtggtcaaactttcaatattggtattgctgaatgtcttgatcttattagtaactttgctggtttctctggtgctatgttctctggtgctgatgaattcaagagaaatgttgataataagagagaattcaatggtcttaagattcacaatctttacatgacttgtggggataaagatgatttagtttattcttccttcccaggatacgttagatcaatgaaaagttggagtagagttgaaaactttaaagattatacttatccaggtggtactcacgatttcccagtttggtacaaaggtttcaatgatttcattcatatgattttcccagaaatgagagaaaa

SEQ ID NO: 14047 - DNA, 822 bp, Neocallimastix californiae
  AB_hydrolase
ttctggtaatactttaactgttaccgttaatgataatggaggttcacttactcttacttcaaaaatttctgttccaagtggtaatggaccattcccaattattattggtatgaacagtaatactggttctctttctgctggtcaattcaatggttttattcaagttccattcaatcatgaccaatgtgctaagtattctatggatggtcgtaaggatactaatgctccattctacagaatgtatccaaatcttagacaagctggtgattatattgcttggtcttggggtgtttctcgtcttattgatggtcttgaacaagttaaaaatcaaattcatgctgatttagaacatattggtgttactggttgttcttacgctggtaaaatggcactctttgctggtgcttttgatgaacgtattgctttaactattccacaagaatctggtggtggtggtattaactcttggagagtttccgatactattggtaatgttgaaaagattgataacactaactactcttggttcatgcaagctttaaagaataactttggtaatggtaaagctactagattaccatatgatcatcatgaagctattgctatgattgctccacgtgctttcttcactatgggtaatccagattatgaatggttaggtgataaatctggttacacttcagctatggctgcatatgaagtttggaaagcaatgggtgttgaagatagatttggttttaactttattggtaatcatatgcattgttctgctgctagttctcaaactaatgatgttaacaaattcattgatagattccttcg

SEQ ID NO: 14048 - DNA, 130 bp, Neocallimastix californiae
  AB_hydrolase
agaagctaagattcaaaagagtggagttacttacagtaaggctgaaaagattacttaccattcatattcaacaaatgttgatagaaaaatgaatattattttaccagcaaattacactactgaaaagaaa

SEQ ID NO: 14049 - DNA, 51 bp, Anaeromyces robustus; identical to SEQ ID NO: 14040
  AB_hydrolase

SEQ ID NO: 14050 - DNA, 522 bp, Anaeromyces robustus; identical to SEQ ID NO: 14039
  AB_hydrolase

SEQ ID NO: 14051 - DNA, 48 bp, Anaeromyces robustus; identical to SEQ ID NO: 14041
  AB_hydrolase

SEQ ID NO: 14052 - DNA, 606 bp, Anaeromyces robustus; identical to SEQ ID NO: 14042
  AB_hydrolase

SEQ ID NO: 14053 - DNA, 795 bp, Anaeromyces robustus; identical to SEQ ID NO: 14043
  AB_hydrolase

SEQ ID NO: 14054 - DNA, 792 bp, Anaeromyces robustus; identical to SEQ ID NO: 14044
  AB_hydrolase

SEQ ID NO: 14055 - DNA, 546 bp, Anaeromyces robustus
  AB_hydrolase
tccaggtatcaaaactggttccttccaattccaatggggtggtagaaagaaccgtcttgttcacattgatcttccaaacaattatgataacaatcatccataccgtttagttttcggtatgcaatgtatgggaggttctggtgctaatgtcagaaatgaacaatactatggtttaaagccattagatactggtaaaactactattttcgttgctccagaaggtaacggtcaacaacttccatggggtcaagaagattatcaattattcgatgaacttcttgaaaaattaaagactgatctttgtattgatgaatctcgtgtcttctctactggtttcagttatggttctatgttctctaatggtctcgcttgggatcaccaaaaagtacttcgtggtgttgctgtttacgaaactgctgctgttaacatctggcttccaaagaatactggtttaccaattgcttggatgggtgttcttggtttcgatgatggtctttgtactccacaaatgggtcgtcaagctcgtgatgttatcttaaagaacaa

SEQ ID NO: 14056 - DNA, 54 bp, Anaeromyces robustus
  AB_hydrolase
tttcccagtcaaatggtgtactcaatctggtggtcaccaatgggaacacaagga

SEQ ID NO: 14057 - DNA, 96 bp, Anaeromyces robustus
  AB_hydrolase
ccaaggtgtttatattaagcacttaaagcttgttggtcgtggtcacagtccatctaaagctgatatcggtgatatctggaactttgttaaggaata

SEQ ID NO: 14058 - DNA, 519 bp, Anaeromyces robustus
  AB_hydrolase
aaaatctatcaacgattataagagagttcaagtttcaggcagagacattcacgtctatgccccatctaatctcgcagcaaagagtccattacttctttctttacacggtatggaccaagatccaaattaccaacaatccaatacccactgggaaactttagctgatactgaaggttttgttgttgtatatccaagaggaggaactggtatgagtacttgggatatccaaggtgataaggataccaaatgggtattacaaattattgatcaaatggctaaggattatgacattgaccgtaatcgtgtttacctttctggattctctatgggtggtatgttcacttaccatgctatgagtaagattggtgacaagattgctgcttttgctccatgttctggtccaaatgtatttggtgcctcaaaggctatgcgtccagttccaattttccatgttcacggtactaacgatgatgtattaaattacaaccaagttgaaggtttccttaagaattaccgtga

SEQ ID NO: 14059 - DNA, 831 bp, Anaeromyces robustus
  AB_hydrolase
tgaagacaagccatttgatgatggtttaaccgattctcaacgtggtactgttgttgaaattaattatccaactagagattataccgttgatcaaagtcgtgctcaaaaatacaataaacacggatgggtttatcttccagctggttatgatgctgatgacaagaatactcaatatccattatttgttttacttcacggttttggacaaaatgaaaacacttggggtctttctaacaaaggacgtggtggtaaaattaagggtttcatggatagaggtatggctagtggtgatgttggtagatttattcttgtttgtgtaactggtgttgctagtagaaattggggtccaaatggtgctggtaatgatgttaatggtttcaatgcttttaaaggtgaacttagagatgatattattccatatatgagatctaaattcaatattaagagtggtcgtgataatgttgctcttgctggtctttctatgggtggtggtcaaactttcaatattggtattgctgaatgtcttgatcttattagtaactttgctggtttctctggtgctatgttctctggtgctgatgaattcaagagaaatgttgataataagagagaattcaatggtcttaagattcacaatctttacatgacttgtggggataaagatgatttagtttattcttccttcccaggatacgttagatcaatgaaaagttggagtagagttgaaaactttaaagattatacttatccaggtggtactcacgatttcccagtttggtacaaaggtttcaatgatttcattcatatgattttcccagaaatgagagaaaa

SEQ ID NO: 14060 - DNA, 48 bp, Anaeromyces robustus
  AB_hydrolase
tgctaaagttggtctttgtactattaatggaggaggtcactctgaagg

SEQ ID NO: 14061 - DNA, 627 bp, Anaeromyces robustus
  AB_hydrolase
agctccaagaactactaccactactactccaaaaccacaaccaactcaagaagttgttgactgttctggtaaaactcttagaagtaacactaacctttctattggtggtcgtaaagttattgttaaattccctaatggttacaagggtgataaaccagttccacttcttattaattatcacccaattatgggtagtgcttctcaatgggaaagtggttctcaaactgctaaagctgcccttaatgatggtgctattgttgcctttatggatggtgcacaaggtaacatgggtcaagcttggaatgtaggtccatgttgtactgatgctgatgatgtttctttcactcgtaacttcattaaagaaattaccaataaagcttgtgttgatccaaaacgtatttacgctgctggtttctctatgggtggtggtatgtctaattatgctggttgttatcttgctgatgttattgcagctgctgctccatctgcttttgatcttgctaaagaagttgttgatggcggtaaatgtaaaccatctcgtccattcccaattcttaacttccgtggtacagctgataatgttgtctcttataatggaggactttcccaagttgttccaggtaaacc

SEQ ID NO: 14062 - DNA, 819 bp, Anaeromyces robustus
  AB_hydrolase
tggtaatactttaactgttaccgttaatgataatggaggttcacttactcttacttcaaaaatttctgttccaagtggtaatggaccattcccaattattattggtatgaacagtaatactggttctctttctgctggtcaattcaatggttttattcaagttccattcaatcatgaccaatgtgctaagtattctatggatggtcgtaaggatactaatgctccattctacagaatgtatccaaatcttagacaagctggtgattatattgcttggtcttggggtgtttctcgtcttattgatggtcttgaacaagttaaaaatcaaattcatgctgatttagaacatattggtgttactggttgttcttacgctggtaaaatggcactctttgctggtgcttttgatgaacgtattgctttaactattccacaagaatctggtggtggtggtattaactcttggagagtttccgatactattggtaatgttgaaaagattgataacactaactactcttggttcatgcaagctttaaagaataactttggtaatggtaaagctactagattaccatatgatcatcatgaagctattgctatgattgctccacgtgctttcttcactatgggtaatccagattatgaatggttaggtgataaatctggttacacttcagctatggctgcatatgaagtttggaaagcaatgggtgttgaagatagatttggttttaactttattggtaatcatatgcattgttctgctgctagttctcaaactaatgatgttaacaaattcattgatagattccttcg

SEQ ID NO: 14063 - DNA, 819 bp, Anaeromyces robustus; identical to SEQ ID NO: 14062
  AB_hydrolase

SEQ ID NO: 14064 - DNA, 48 bp, Anaeromyces robustus
  AB_hydrolase
tgttaaagttggtctttgtactattaatggaggaggtcactctgaagg

SEQ ID NO: 14065 - DNA, 534 bp, Anaeromyces robustus
  AB_hydrolase
tctttccattggtggacgtaaagttattgttaaattccctaacggattcagtggtgataaaccagctccacttcttattaattatcacccaattatgggtagtgcttcacaatgggaaagtggttcacaaactgctaaagctgctcttaatgatggtgccatcgttgcctttatggatggtgctcaaggtccaatgggtcaagcatggaatgtaggtccatgttgtactgatgctgatgatgttagttttactcgtaactttattaaagaaattactagtaaagcttgtgttgatccaaaacgtatttatgctgctggtttctctatgggtggtggtatgtctaattatgctggttgtttccttgctgatgttattgctgctgctgctccatctgctttcgatcttgctaaagaaattgttgatggtggtaaatgtaaaccagctcgtgccttcccaattcttaacttccgtggtactcaagataatgttgttgcctataatggaggtctttcacaagttgtacaaggaaaacc

SEQ ID NO: 14066 - DNA, 807 bp, Anaeromyces robustus
  AB_hydrolase
tccagctattcaatttaaagaagctccaggaaattatttacaaagatgtcaacaagctggtaaaattgtaaaagaaagttacaatggtattaatggtagaaactcacttaatgtttatttaccatatggatatgatgaaaaaaagcaatacaatattttctatcttatgcatggtggtagtgaaaatgaaaatactattttcaataatgaagttcaacttaacaatattcttgataatatgattatgaaaggtgaacttgaaccacttattgttgttactccaacctttaatagatgtgaatgtcgtacgttctacaaagaattccgtgagagtgttataccatttgttgaaggtaaatattctacttatgctaaatcaacttcagctgcagatattaaagcttcaagaatgcatagaggtttcggtggattctctatgggttctgcttctacttgggctgtatttattaattgtttagatatttgtgcttattacatgccacttagtggtgaaaattgggaagctgatggtgcctatatgaaagctaaaactgttgctgatgccgttgataaattaggtttaaagaagaatcaatacttcattttctgtgctacaggttcagaagatattgcatatccaaatatgaacccaatgatgaatgaaatgaagaagatgagtcaatttgtatatacttctgatttctctaaaggtaatttctattatcttgttgctaatggtaagacccactggtggggttatgttagacattatatttatgatgctcttccatctttcttccatgaagt

SEQ ID NO: 14067 - DNA, 51 bp, Anaeromyces robustus
  AB_hydrolase
attcccagttcgttggtgtactcaatctggaggtcaccaatgggaacacaa

SEQ ID NO: 14068 - DNA, 546 bp, Anaeromyces robustus
  AB_hydrolase
cccaggtcttaagactggttccttccaattaaaatggggaggtaataagaaccgtcttgttcacattgatattccagacaattataataatagtaaaccataccgtttagtattcggtatgcaatgtatgggtggttctggtgctaatgttagaaatgaacaatactatggattaaaaccattagatactggaaaaactaccattttcgttgctccagaaggtaatggtcaacaacttccatggggacaagaagattatcaattattcgatgatttacttgaaaaattaaagaatgatctttgtattgatgaatctcgtgtattctcaactggtttcagttatggttctatgttttctaatggtctttcatggaatcaccaaaaagttcttcgtggtgttgctgtatatgaaactgctgaacgtaacatttggcttccacaaaataccggtttaggtattggttggatgggtgttcttggtttcgatgataacctttgtactccagaaatgggtcgtaaagctcgtgatattatcttaaagaacaa

SEQ ID NO: 14069 - DNA, 798 bp, Anaeromyces robustus
  AB_hydrolase
tatgcaatatagagatgctccaggagactatttaagagattgcccacaacctggtaaaattattaaagaatattataatggtattaatggtgctaattcattaaatgtttacttaccttacggttatgataagaataaacaatataatattttctatcttatgcatggtggtggtgaaaatgaaaatacaattttcagtgttgatgttcatcttcaaccaattattgatcatttaattatgaatggtgaacttgaacctttaattatagttactccaactttcaataaatgtgaagcacgtactttctataaagaattccgtgaatctgttataccatttgttgaaggtaaatattctacttatgctaaatctacttcaccagctgatattagagcttctagaatgcatagagcttatggtggtttctctatgggatcagcttcaacttgggctgttcttattaattgtttagatattgttggttatttcatgccacttagtggggataattgggaagctaatggtggatatggtaaagctaaatctgttgctgatgctattaatagagcaggtttaaagaaaaatgaatttttcattttctgtgctaccggatccgatgatattgcttatccaaacatgaacccacaaatggatgaaatgaaaaagatggaaccatttgtttatacttctgatttctctaaaggtaatttctattaccttgttgctccaggaaaaactcactggtggggatttgttaaacattacatctatgatgcacttccatctttcttccacga

SEQ ID NO: 14070 - DNA, 48 bp, Anaeromyces robustus
  AB_hydrolase
ttctaaagttggtctttgtactattaatggtggtggtcactctgaagg

SEQ ID NO: 14071 - DNA, 594 bp, Anaeromyces robustus
  AB_hydrolase
tcaaactaattcaccatctgtagttgattgttcaggtaaaactcttaagagtaacactaacctttctattggtggtcgtaaagttattgttaaattccctaacggttttaaaggtgataaaccagttccacttcttattaattatcacccaattatgggtagtgcttctcaatgggaaaatggttctcaaactgccagagctgcccttaatgatggtgctattgttgcctttatggatggtgctcaaggtccaatgggtcaagcttggaatgtaggtccatgttgtactgatgctgatgatgtttcttatactcgtaatttcattaaagaaattacaagtaaagcttgtgttgatccaaaacgtatttatgctgctggtttctctatgggtggtggtatgtctaattatgctggatgttaccttgctgatgttattgcagctgctgctccatctgcttttgatcttgctaaagaaattgttgatgctggtaaatgtaaaccagctcgtccattcccaattcttaatttccgtggtactcaagataatattgtaatgtataatggaggactttcccaagttgtacaaggaaaacc

SEQ ID NO: 14072 - DNA, 753 bp, Anaeromyces robustus
  AB_hydrolase
tagttccaaacaacaaggagttaattatccaagtgctaaaaaggttacttatcattcaaaaactactaataatgatcgtaaaatgaatgttattctaccaattggatatactgaaagtaagaaatatccagttttatatttattacatggtattatgggtaatgaagattctatgttaagtacaaatatgggtagtattactattccaaccaatttattaagagaaggtaaagctaaagaaatgattattgttcttccaaatgaatatgctccagaaggtggtaaggaagttcctgctggtattaatcaagcttactttgaaggttatgataatttcattaatgatttaattggtagtattatgccatatatggaaaaaaattattctgttgctactggtagagaaaatactgctattgctggtttttctatgggaggtcgtaatagtctttatattggttataaaagatctgatttatttggttatattggagctttttcaccagctccaggtgttgttccaggtcttttcagaaatgaaaatcaattccgtactgatcaaccaccaattgttagtcttatttcttgtggtactgatgattctgtagttggtactaatcctaaaaattatcacaatgttttaactaaaaataatcaagatcatatttggtttgaagtaccaggtgctgatcatgatgctaaagctgtcactgctggttattataatttcattcaaacttgttttggtgcctt

SEQ ID NO: 14073 - DNA, 615 bp, Anaeromyces robustus
  AB_hydrolase
atcagctacacttacctctaaacttaatgttccaagtggtaatggtccatttccaattattattggtatgaatagtggtactggttctcttagtgctagtcaatttagtggttttattcaagtaccatttaatcatgatcaatgtgctaaatattcaatgaatggtcaaaaagatacaaatgcacaattttataaaatgtacccaaatttaaaacaagctggtgattatattgcttggtcatggggtgtttctcgtcttattgatggtcttgaacaagtaaaggatcaaattcacgctgatatatcacacattggtgttactggttgttcttatgccggtaaaatggctctctttgctggtgctttagatgaacgtgttgcattaaccattgctcaagaatccggaggtggtggtattaattcatggagagtttcagatactattggtaatgttgaaaaaattgacaatactaactattcatggttcatgcaagctttaaagaataattttggtaatggaaaagctacaaaattaccatatgatcatcacgaattagtagctatgatcgccccacgtgcattctttactttaggtaacccagattatgaatggtt

SEQ ID NO: 14074 - DNA, 51 bp, Anaeromyces robustus
  AB_hydrolase
tgctaaagttggtctttgtactattaatggtggtggtcacgatgaaggaag

SEQ ID NO: 14075 - DNA, 528 bp, Anaeromyces robustus
  AB_hydrolase
tattaatggtcgtaaagttcttgtaagattccctaatggttacaagggtgacaaaccagttccacttcttattaattatcacccaatttcaggtagtgctgctgcttgggaatatggttctcaaactgccagagctgcccttaatgatggtgctgttgttgcttatatggatggtgctgttggcccaggtggtcaagcttggaatgttggtccatgttgtactgatgctgatgatgtacaatacactcgtgatttcattaaagaaattacaagtaaagcttgtgttgatccaaaacgtatttatgctgctggtttctctatgggtggtggtatgtctaactatgctggttgtaaacttgctgatgttattgctgctgctgctccatccgcttttgatctttctaaagaagttgttcaaagtggtcaatgtactccagctcgtccattcccaattcttaacttccgtggtacaagtgatttcgtagttccatacagtggtggttattctaatgctgttgcaggtaaacc

SEQ ID NO: 14076 - DNA, 408 bp, Anaeromyces robustus
  AB_hydrolase
tgaatacagaaaaaagcaagaaggaattgaatacccaactcctcaaaaaattacttactattcaaaagttactgaatctgaacgtaaaatgaatgttattcttccagttggatatgatgaaaataaaaaatacccagtagtatacttcttacatggtcttatgtcagatgaagatggtatgcttggtgatgaatctactattgctattccaactaatttaattaaagaaggtaaagctaaagaaatgattatggttcttccagatatttatgctccagtaccaggtacagctgttgaaccaaattatgatccagaatattataaaggttatgataatttcattaatgaattaactgaagttattatgccatacatggaagaacattatccaattcttactggtagaga

SEQ ID NO: 14077 - DNA, 798 bp, Anaeromyces robustus
  AB_hydrolase
ttgtccagatgaatatagaaaaaagcaagaaggaattgaatacccaactcctcaaaaaattacttactattcaaaagttactgaatctgaacgtaaaatgaatgttattcttccagttggatatgatgaaaataaaaaatacccagtagtatacttcttacatggtcttatgtcagatgaagatggtatgcttggcgatgaatctactattgctattccaactaatttaattaaagaaggtaaagctaaagaaatgattatggttcttccagatatttatgctccagtaccaggtacagctgttgagccaaattatgatccagaatattataaaggttatgataatttcattaatgaattaactgaagttattatgccatacatggaagaacattatccaattcttactggtagagaaaatacagctatttgtggtttctctatgggagctcgtactagtctttacattggatacatgaaatcagatttgattggttacactggtgcatttgcaccagctccaggtattactccaggagaagattcattctctggtaaacatccaggattaatcactgaagatgaattccgtgcagaaattccaccaattgtttcacttattgattgtggtactaatgatagtgttgttggacaattcccaaaaagttatcatgaaattttaaccagaaatggtcaagaacatatttggttcgaagttccatatgctgatcatgactggaatgctatttctgctggtttatataatttccttcaaactacttttgatgctttaaatga

SEQ ID NO: 14078 - DNA, 789 bp, Anaeromyces robustus
  AB_hydrolase
tccagatgtcgcttttaatcaacaagaaaatattacttatggtgaacttcaaagaattacttattattctgaaaatactaaaagtgatagaccaatgaatattcttcttccaccaaattatgacccagacaataaaaaatatccagttttatatcttttacatggtattctctcagatcaaaattctttaattaaaccaaaatatagtacaccaaatattgctggttatttaatgaatgaaggtttagctaaagaaatgattattgtatatccatatacttatgctccaaaagatggtattgaagttgaaccaggattttctgaagaacatgctgctggttataataatttcattaatgaattactttacaatattatgccatatatggaaaaaaattatccaattcttactggtagagataatactgctattgctggtttttcaatgggtggtcgtaatagtttttatattggtttaaataaaccagaattatttggttatattggtgctttctctcctgctccaggtgttcttccagaagaaggtaaaactagtttattcccttctgaagatgatttcttagttaaagataaacaattaacaccatatgttactcttgtttgtactggtactgatgatgatgttgttgctgaatacccaattcattatcataatgttttcactaaaaataaccatccacatctctggtatgaagttccaactggtggtcatgatggtattactgttagtagtggtgtttacaactttttacaaactttatttggtat

SEQ ID NO: 14079 - DNA, 399 bp, Anaeromyces robustus
  AB_hydrolase
atttgaatttaattggtcaggaggtaaacgtaccgttcgtatagatttaccagataattatgataataaaaaaccttatcgtttagtttttggtatgcaatgtgctggaggttgggccggtggtgttcaacaagaaggatattatggtttaaaacctttagatactggtaaaactacgatttttattgctccagaaggtaatggtcaacaattaccatggggtgaagccgattataaattatttgatgaacttttagataaattaaccaatgatctttgtattgatatttctcgtgtcttttcaactggttttagttatggtgcaatgtttagtaatggtctttcatggaatcatcaaaaagtacttcgaggtgttgccgtttatgaaactgctgaacg

SEQ ID NO: 14080 - DNA, 772 bp, Anaeromyces robustus
  AB_hydrolase
agctaatttcagatacaaacaaaataatatccaatatccatcacctcaaaaaattacttacttctcttcaaatactaatagtgaacgtaaaatgaatattattcttccagttggttatgatgaatctaagaaatacccaattgtttatttcttacacggtatttttggtgatgaagattctatgctcgatgaaagtactattgctattccaactaatttacttaaagaaggtaaagctaaagaatttattatggttcttccaagtgaatatgctccaactccaggtaatgaagttgaaccaggtttctctcaaaaatactttgatggttatgataacttcattaatgaattagttgatgttattatgccatatatggaacaaaattatccaattcttactggtaaggataacactgctctttgtggtttctctatgggtggtcgtaacagtctttacattgcttacaagagatcagatttattcggttatgttggtgctttctctccagctccaggtgttactccaggtgatgatttctctggtcatcatccaggtttattcactgaagaacaattccgttctgatgatccaccatatgttacccttatttcttgtggtactaatgattccgttgtacatgaattcccaaaaagttaccatgaaattttaactagaaacaaccaaaaacacatatggtttgaagttccaggtgctgatcacaatgaagatgctatttctgctggtttatacaactttgtacaaactattttc

SEQ ID NO: 14081 - DNA, 552 bp, Anaeromyces robustus
  AB_hydrolase
ttgcccagctgaatttgttgaaagaaaagaaggtgttgaatacccaagtattaatcaattaacttattattctactactactgaatctgaacgtccattaatcgttcttcttccaccaaattatactgaaactaagaaatatccagttctttatttattacatggtattatgggtactggtatgtttatgttacaagaaggttttggtactgttgctattccaggtaatttatatgctaaaaatatggctaaagaaatgattattgttcttccagatcaatatgctccagctccaggtactgaagttgaaccagatttaaatgaagaatattttgctggttataataattttattaatgatttaattaatgatattatgccattcttagaaaagaattattctattgctactggtagagaaaatactgctctttgtggttattcctttggtggtcgtaatagtctttacattggtttaaaaagaccagatttattcggttatattggtgctttctctccagctccaggtcttgttccaggtgatgatatctt

SEQ ID NO: 14082 - DNA, 807 bp, Piromyces finnis
  AB_hydrolase
tgttgctaacatgcaattcaaggaagccccatacaactaccaacaaccatgccaacaagccggtagaattattaaggaaagttacaatggtgtcaacggtggtaacactttaaatgtttacttaccatacggatatgacaagaacaaacaatacaacatcttctatcttatgcatggtggtggtgaaaatgaaaacaccattttcagtgatgatgttaaacttcaaaacattcttgaccatcaaattatgaatggtgaacttgaaccattgattgttgttaccccaactttcaacaagtgtgaagctcgtactttctacaaggaattccgtgaatctgtcatcccattcgttgaaggaaaatactctacttacgctaaatctacttctgctagtgatatcaaggcttctagaatgcacagagcttacggtggtttctctatgggttctgcttctacttgggctgttcttgttaactgcttagatatttgtgcttactacatgccacttagtggtgataactgggaagctaacggtggatatggtaaggccaagtctattgccgatgctgttaacagattcggtttaaagaagaatgaattctttatcttctgtgctactggttctgaagatatcgcttatccaaacatgaatccacaaatggatgaaatgaagaagatggatccatttgtttacacttctgacttctctaagggtaacttctattacttagttgctccaggtaagactcactggtggggatacgttaagcactacatctacgatgctcttccatccttcttccacga

SEQ ID NO: 14083 - DNA, 789 bp, Piromyces finnis
  AB_hydrolase
ctgtccaaaagacgctatatctgaaagaccaggtgttcaatacccaactgccaaaaagatttactacttttcaaaaattacacaatcctatcgtccattaaatgttattcttccagtaggatatactgaaagtaaacaatatccagttttatacttattacacggtattatgtgtaatgaagattctatgttagaagctgaaatgggtagtcttactattccaacaaacttattcaatgatggtagagctaaagaaatgattattgttcttccatatgaatatgctccagaagctggtaaggaagttgaagccgcttttaatcaagcctactttgatggttatgataactttatcaatgaattaactgatgtcattatgccatacgtaaaggctaattactctattaaaactggtagagaaaatactgctatttgtggtttctctatgggtggtcgtaacagtctttacattggttttaagagatctgacttatttggttatgttggtgctttctctccagctccaggtgttaccccaggtactgactcttctggttatcacaaaggtttatttactgaagacagtttccgtgctgaaatttcaccaatcgttgctcttataaactgtggtactagtgattcagttgttggacaattcccaaagagttaccatgaaattttaactagaaacaaccaagaacacatttggtttgaagttcaaggtgctgatcacaatggtgtagccgtttcagctggattctacaacttcatcttagctgcttttggtgc

SEQ ID NO: 14084 - DNA, 399 bp, Piromyces finnis
  AB_hydrolase
ctttgaattcaaatggggtaacaacaagcgtactgtccgtattgatatcccagataactatgataagagcaagccataccgtttagtcttcggtatgcactgtatgggcggttgggccggaggtgtccaacaagaaggttactatggtttaaagccattagatactggtaagactaccattttcgttgctccagaaggtaacggtcaacaactcccatggggtgaagctgattactacatgttcgatgaacttcttgccaagttaaagggtgatctctgtattgatgaatcccgtgtcttctctactggtttcagttacggttctatgttctctaacggtctttcctggaaccaccaaaaggttctccgtggtgttgccgtttacgaaactgctgaacg

SEQ ID NO: 14085 - DNA, 432 bp, Piromyces finnis
  AB_hydrolase
atctaagggttgtggtaagtcattaagtcttccaaaaactggatcatttgaattcagttggtctggtggtagacgtactgttcgtattgatattccagataactataataacaacaacccataccgtttaatattcggtatgcactgtatgggtggatgggccggaggtgtccaacaagaaggttactatggtttaaagccattagatactggtaagactaccattttcgttgctccagaaggtaacggtcaacaactcccatggggtgaagctgattactacatgttcgatgaacttcttgccaagttaaagggtgatctctgtattgatgaatcccgtgtcttctctactggtttcagttacggttctatgttctctaacggtctttcctggaaccaccaaaaggttctccgtggtgttgccgtttacga

SEQ ID NO: 14086 - DNA, 471 bp, Piromyces finnis
  AB_hydrolase
ctttgaattcaaatggggtaacaacaagcgtactgtccgtattgatatcccagataactatgataagagcaagccataccgtttagtcttcggtatgcactgtatgggcggttgggccggaggtgtccaacaagaaggttactatggtttaaagccattagatactggtaagactaccattttcgttgctccagaaggtaacggtcaacaactcccatggggtgaagctgattactacatgttcgatgaacttcttgccaagttaaagggtgatctctgtattgatgaatcccgtgtcttctctactggtttcagttacggttctatgttctctaacggtctttcctggaaccaccaaaaggttctccgtggtgttgccgtttacgaaactgctgaacgtaacatctggcttccaaagcacactggtgaaccaattggttggatgggtgttcttggtttcgatgatggtct

SEQ ID NO: 14087 - DNA, 187 bp, Piromyces finnis
  AB_hydrolase
cccagctcttcaatttaaagaagctccatatgattatcaaaatccatgtcaacaagctggtaaaattgttaaggaatcctacaatggtattaatggtggtaatactttaaatgtttacttaccatatggttatgataaaaacaagcaatacaacattttctaccttatgcatggtggtggtgaaaat

SEQ ID NO: 14088 - DNA, 603 bp, Piromyces finnis
  AB_hydrolase
cactcaaaaaccacaacaaactcaaaatgttgttgattgctcaggtaagacccttaagagcaacactaaccttactattaacggtcgtaaggttattgttaaattcccaaacggctacaagggtgataaggccgtcccacttcttatcaattaccacccaattatgggtagtgcctcccaatgggaaggtggttctcaaactgccaaggctgcccttaacgatggtgccattgttgctttcatggatggtgctcaaggtccaatgggtcaagcttggaacgtcggtccatgttgtactgatgctgatgatgttacctacactcgtaacttcattaaggaaattacccaaaaggcttgtgttgatccaaagcgtatctacgctgctggtttctccatgggtggtggtatgtctaactatgctggttgttacctctctgatgttattgctgctgctgctccatctgctttcgatcttgccaaggaaattgttgactctggtaagtgtaagccatctcgtccattcccaatccttaacttccgtggtacttctgataacgttgttatgtacaatggtggtctttctcaagttgttccaggtaagcc

SEQ ID NO: 14089 - DNA, 48 bp, Piromyces finnis
  AB_hydrolase
tgttaaggtcggtctttgcaccattaacggtggtggtcacagtgaagg

SEQ ID NO: 14090 - DNA, 603 bp, Piromyces finnis; identical to SEQ ID NO: 14088
  AB_hydrolase

SEQ ID NO: 14091 - DNA, 48 bp, Piromyces finnis
  AB_hydrolase
tgttaaggttggtctctgtactattaatggtggtggtcacaatgaagg

SEQ ID NO: 14092 - DNA, 600 bp, Piromyces finnis
  AB_hydrolase
tcaaaaaccacaacaaactcaaaatgttgttgattgctcaggtaagacccttaagagcaacactaaccttactattaacggtcgtaaggttattgttaaattcccaaacggctacaagggtgataaggccgtcccacttcttatcaattaccacccaattatgggtagtgcctcccaatgggaaggtggttctcaaactgccaaggctgcccttaacgatggtgccattgttgctttcatggatggtgctcaaggtccaatgggtcaagcttggaacgtcggtccatgttgtactgatgctgatgatgttacctacactcgtaacttcattaaggaaattacccaaaaggcttgtgttgatccaaagcgtatctacgctgctggtttctccatgggtggtggtatgtctaactatgctggttgttacctctctgatgttattgctgctgctgctccatctgctttcgatcttgccaaggaaattgttgactctggtaagtgtaagccatctcgtccattcccaatccttaacttccgtggtacttctgataacgttgttatgtacaatggtggtctttctcaagttgttccaggtaagcc

SEQ ID NO: 14093 - DNA, 51 bp, Piromyces finnis
  AB_hydrolase
tgttaaggtcggtctttgcaccattaacggtggtggtcacagtgaaggtga

SEQ ID NO: 14094 - DNA, 51 bp, Piromyces finnis; identical to SEQ ID NO: 14093
  AB_hydrolase

SEQ ID NO: 14095 - DNA, 603 bp, Piromyces finnis; identical to SEQ ID NO: 14088
  AB_hydrolase

SEQ ID NO: 14096 - DNA, 651 bp, Piromyces finnis
  AB_hydrolase
tgaatgggaatgtagacgtaatgaaattaaagctgaaattgaaaattacgaacttggtaagaaaccagctccaccaaccaatattaaggcttcttactctggtggtaccttaactgttactgttaatgacaatggtggttctcttactcttacctctaaaatttctgttccaagtggtaatggacctttcccaattatcattggtatgaacagtaacactggttctcttagtgctagtcaatttaatggttttattcaagttccatttaaccatgatcaatgtgctcaatactctatgagtggtcaaaagaatactaactctccattctacaaattatatccaaaccttaaacaagctggtgattacattgcttggtcttggggtatttctcgtcttatcgatggtcttgaacaagttaaaaatcaaattcatgctgatatggaacatattggtgtcactggttgttcttacgccggtaaaatggctctctttggtggtgctttcgatgaacgtattgctttaactattccacaagaatctggtggtggtggtattaactcctggagagtttctgataccattggtaatgttgaaaagattgataatactaattactcttggtttatgcaagctttaaagaacaactttgg

SEQ ID NO: 14097 - DNA, 774 bp, Piromyces finnis
  AB_hydrolase
aggtgttaccaaagaaaaggtttactactactcttccttctctcaatcccaacgcccattaaatgttattttaccaccaaattattcaaccgataaaaaatatccagtactttacttacttcatggtgtagctgctaatgaagatatcatggtagaagaatataatggtgctttaaatattccacctaaccttgctaaacaaggtaaggctaaggaaatgattattgtttctccacgtgttaatatttatccaccaggtgttgatgaagttgaattcgctttttccacagaatatctttctggttttgataattttattaatgatttaatagatagtattatgccattcattgaaactcattattcagttcttacaggtagaaacaatacagctattgctggcttttctatgggtggtcgtacagcactttatattggttatagtaaacctgaattatttggttatgtttgtggtctttcacccgcttttggattaactcctattgaaggatctagtgtatatcatagtcttttcccatccgaagaagatgtcaaaattagaaatgttaataaaacaccttatgtcactttaattagttggggaaatattgatactgttgttaatccctacccatttatttatcataaagttcttacgaataataatcaacctcatctttatatggaagttattggtgctaatcatgatgaaatagctatcactcatggtttatataattttgttatgacgcttttcggtcaattagatgaaaa

SEQ ID NO: 14098 - DNA, 783 bp, Piromyces finnis
  AB_hydrolase
taaaaaaggtgtcaactatccaacagttgatagtttaacttattattccactacaaccgaaactaaccgtactttaactgttcttgttccaccaaattattctccaaagaaaaagtacccagttctctatttgttacatggtattatgactgatggagcttggatgattcaagatggatttggtactattgccattccaggaaatttagctcatcaaaaaaaagctaaagaaatgttcattgttcttccagatcaatatgctccatcaccaggtaccgaagttgaaccagccttaaatcaagaattctttaatggttatgataactttattaatgatttagtcaatgatattatgccatttatgaaaaaacaatattctattaaaactgatagaaaaaatactgctatttctggttattcctttggtggacgtaacagtctttacattggtatcactagatctgatttatttggttatgttggttctttttcaccagctccaggtctcgttccaggggatgatattttcactggacatttcgatggtttataccaagaaaaggaattaaaatttaagcatcaaccttacctcaccatgctttcttgcggtacaaatgatactgttgttttcgatttcccaaaacaatatcatgaaattcttaaaactaataaacaagaacatatctggtatgaaattactggtcatgatcatatggataatgaatctttttcttctccataccataatttccttacttccatttttgatcaagttaatgaaaa

SEQ ID NO: 14099 - DNA, 240 bp, Piromyces finnis
  AB_hydrolase
aggtgttaccaaagaaaaggtttactactactcttccttctctcaatcccaacgcccattaaatgttattttaccaccaaattattcaaccgataaaaaatatccagtactttacttacttcatggtgtagctgctaatgaagatatcatggtagaagaatataatggtgctttaaatattccacctaaccttgctaaacaaggtaaggctaaggaaatgattattgtttctccacgtgt

SEQ ID NO: 14100 - DNA, 201 bp, Neocallimastix californiae
  AB_hydrolase
caatgaaagtaatataaagattcgttccaagttattaatgttctccggtaaacaagataaaattattgatgaaaataatgccgcattatggaagaaggaagtcagtgatgaatacagtgaatttactcaacatatcagaatgagaggtaatcattggttcatgatgaagaatactgctaaatatttaaagaatattatgga

SEQ ID NO: 14101 - DNA, 348 bp, Neocallimastix californiae
  AB_hydrolase
catcttcttcccatccgctgatgaaggtgaaatagattatgagagctacgttgaaaatatggaagaatctcttctcttcaccttaaaccttccaggttatggcgtaagaaaggatgaacctcttattactgattgggatttattagtgaagaatgtgacgaaggcaattattcaaaccgctgcctcggataagtttaaacaatgtaataccattcactttgttggtaatggttttggtgccatattagcttggaagacacttcttcaaattcaagcctatgaagatgaaaataaggaagtcccaccaatttctactttaattatttctagagccatggctccttccgt

SEQ ID NO: 14102 - DNA, 399 bp, Neocallimastix californiae
  AB_hydrolase
tgattggattgttcgtttagatactaataaggatactactaattctttcttccttatcccagctgctggtagttccattaatatgtataatagttggagtaagtatatgaataagtctgctttattcgctattagttatccaggtcacttggcccgtatagatgaaactccaattgatgactttaaagtattggttaagtctattggtgaagaaattttaaataatattaagaatggtaaaatttcaaaggataaaccaatttacttctttggtcattccttaggtgccttagtttcctatgaaacagttttatatcttcaaaatgaaagaaagaagggtaatccaaatgctccagttgttactgctttagttgtcagtgcttctccatctccagtttt

SEQ ID NO: 14103 - DNA, 171 bp, Neocallimastix californiae
  AB_hydrolase
ttatgatattggtggtattagtgatccaattatttctgttgcatcaagatctcgttgggatcttgaaaatgctgaaggttatccaatagttcgtattgaatttgaaggtgaccactggttcattcaagaaaatgtagaagttgttcttgaacgtttaaagaaggaatttaa

SEQ ID NO: 14104 - DNA, 639 bp, Neocallimastix californiae
  AB_hydrolase
tctcttcaccatcaaccttccaggttatggtgaaagaaagggggaagctgtcattaccgactgggatttattagttaagaatgtcactaaggttatccttcaaaccgccgctgattctgaaaaattcaaacaatgtaatacaattcactttgttggtaacggttttggtgcactattagcttggaagactcttcttcaaattcaaatctatgaagatgaagataaggatgttccaattatttctactttaattatttctcgagtcgtggctccaactgctgaacgtccaattcaattagcaggtgaggttatttctaaacttccaccagagggtattcgtctcttccttgaaatgattggaagtaaggtcgatttcgaaggtgaaaaggcttacctcttaccaattattcataatgaatatgctatgatggattctgtcactaatgaaaatgatatgaagattcgttccaaattattagtattatctggtaaacaagataagattattaatgaaaataacacttccttatggaagaaggaagttagtgatgaatttagtgaatttactcaacatatcaagatgagaggtgatcattggttcatgatgaaagataccactaaatatttaaagaatattat

SEQ ID NO: 14105 - DNA, 399 bp, Anaeromyces robustus
  AB_hydrolase
tgattggcttattcgtttagatatgaataaatctactaataatacctttatacttttcccagctgctggtagttctattaatatgtatagtaattggaataaatatttaactaattctactttacttgctgtaagtttaccaggtcatttaattcgtttagaagaaaaaccaattgataatatggaagatttagtggataatatttataaggaaattataaagaatgttaaaaatggtaatattccaaaggatcaaccattatatttatttggtcattctttaggtgctttagttggttatgaagtagctatgactcttcaaaatgaaagaaagaaaggtaatccagatattccaaatattactgctttaatttctagtggttctccagctccaatttt

SEQ ID NO: 14106 - DNA, 204 bp, Anaeromyces robustus
  AB_hydrolase
tgaaaaagatcatcaattagaagttccaatttatgatattggtgctaattctgattatgttgctccaaaggatagtagaactaattgggatattgaaattgctaatggatacccattgaaacgtatgaatttcgaaggtggtcattggttcattcaagataatcttgaagttgttatggattatttaaagaaagaacttaatct

SEQ ID NO: 14107 - DNA, 351 bp, Anaeromyces robustus
  AB_hydrolase
atttatattcttcccatctgctgatgaaggtgaaattgattacagtgaatatgtagaaaaaatggaagattctttacttttcactgttaaccttccaggttatggtgttagaaaggatgaaccatttattaatgattgggatcttttaattaaaaatattactaaagcaattattcaaacagatatttcaggtaaatttaaagaatgtaaaactattcactttgttggtaatagttttggtggtattgttgcatggaagactcttcttcaaatacaagcttatgaagatgaagataaagaagtaccaattatttctactttaattatttcaagagctattgctccaacagc

SEQ ID NO: 14108 - DNA, 201 bp, Anaeromyces robustus
  AB_hydrolase
taatgaaagtaatatgaaaatacgttcaaaattattaatgttctctggtaaacaagataaaattattgatgataataatacatcattatggaaaaaggaagttagtgatgaatttagtgaatttacacaacatattaaaatgagaggtaatcattggttcgtaatgaaggatacctctaaatatttaaagaatattatgga

SEQ ID NO: 14109 - DNA, 345 bp, Piromyces finnis
  AB_hydrolase
tattttcttcccatctgctgatgaaggtgaaattgactatgctgaatatgttgaagatatggaagattccttactcttcactgttaatcttccaggttacggtgttagaaaggatgagccacttgttactgattgggatttattagttaagaatgttactaaagctattattaaatctgatgaatctgaaaaattcaaggattgcaatgccattcactttattggtaatggatttggtgccttattagcttggaagacacttcttcaaattcaaatctatgaagatgaagataaggatgttccaattatttccaccttgattatttccagagccttagctccatc

SEQ ID NO: 14110 - DNA, 183 bp, Piromyces finnis
  AB_hydrolase
gattcgttccaaattattaatgttctctggtaaacaagacaagattattgatgataataatacttccttatggaaaaaggaagttagtgatgaattcagtgaatttacccaacatattaagatgagaggtaatcactggtttatgattaaggattcttccaaatatttgaagaatattatgga

SEQ ID NO: 14111 - DNA, 204 bp, Piromyces finnis
  AB_hydrolase
tgataaggatcatcaattagaatgtccattatatgatattggtggtgtttctgatccaatggttaacccagattctagaaagaattgggaacttgaagtaactgaagaaactccattagttcgtattacttttgaaggtggtcattggtttattcaagaaaatatggaatctgttcttgaacgtttaaagaaggaacttaaact

SEQ ID NO: 14112 - DNA, 396 bp, Piromyces finnis
  AB_hydrolase
atggcttattcgtttagatactaataataatattactaactcattcttccttttcccagctgctggtagttctatcagtatgtatggtaattggaacagttacatgaaaaactcagccttatttggtgttagttatccaggtcatttagtacgtttagatgaaactccaattgatgacttaaagactttagttagtgctattgctaaagaaattatggaaaatattaagaatggtaatattccaaaggatcaaccactttactgttttggtcactccttaggtgctcttgtttcatatgaagttgtaatgcttcttcaaaatgaaagaaagaatggtaatccaaatgccccagtctttgctggtcttattgtaagtgcatctccagctccaattta

SEQ ID NO: 14113 - DNA, 615 bp, Neocallimastix californiae
  Abhydrolase_5
tccaattatgggtagtgcctctcaatgggaaggtggttctcaaaccgctaaggccgctcttaatgatggtgccattgtagccttcatggatggtgctcaaggtccaatgggtcaagcttggaatgttggtccttgctgtactgatgctgatgatgtcaaattcactcgtgacttcattaaggaaattaccaataaggcttgtgttgatccaaaacgtatttacgctgctggtttctccatgggtggtggtatgtctaactacgctggttgttacctttctgatgttattgctgctgctgctccatctgctttcgatcttgctaaggaaattgttgatgctggtaagtgtaagccatctcgtccattcccaattcttaacttccgtggtacctctgaccaaattgttatgtataatggtggtctctctcaagttgtcccaggtaaaccaattaccttcatgggtgctaagaacaacttaaaggaatgggctaagatgaacggttgttccggttctccaaagcaaaacactccaggaaacaactgtgaaatgtatgaaaactgtaatggtggtgttaaggttggtctctgtaccattaatggtggtggtcacaatga

SEQ ID NO: 14114 - DNA, 618 bp, Neocallimastix californiae
  Abhydrolase_5
tcacccaattatgggtagtgcttctcaatgggaaggtggttctcaaactgcaaaggctgcccttagtgatggtgcaattgttgcctttatggatggtgcacaaggtccaatgggtcaagcttggaacgttggtccatgttgtactgatgctgatgatgttcaatttactcgtgatttcattaaggaaatcactagtaaggcttgtgtagatccaaagcgtatttacgctgctggtttctctatgggtggtggtatgtctaactacgctggttgtttcctttctgatgttattgctgctgctgctccatctgcctttgatcttgctaaggaaattgttgatgctggtaagtgtaagccaactcgtgctttcccaatacttaacttccgtggtactcaagataacattgttatgtacaatggtggtctttcacaagttgtccaaggtaagccaattaccttcatgggtgctaagaacaactttaaggaatgggctaagatgaacggttgtaccggtgaaccaaaacaaaataacccaggaaacaactgtgaaatgtacgaaaactgtaaggatggtgctaaggttggtctttgcactattaacggtggtggtcactctga

SEQ ID NO: 14115 - DNA, 624 bp, Neocallimastix californiae
  Abhydrolase_5
taactatcatccaattggtggtagtgcctctcaatgggaaggtggttctcaaactgctaaggctgcccttagtgatggtgccattgttgccttcatggatggtgctcaaggtccaatgggtcaagcttggaatgttggtccctgctgtactgacgctgatgatgttcaattcactcgtaactttattaaggaaattacgagtaaggcttgtgttgatccaaaacgtatttacgctgcaggtttctctatgggtggtggtatgtctaactatgctggttgttaccttgctgatgtcattgctgctgctgctccatcggcctttgatcttgctaaggaagttgtcgatgctggaaaatgtaagccagctcgtccattcccaattcttaatttccgtggtactcaagatccaattgttatgtacaatggtggtctctctcaagtcgttcaaggtaagccaattactttcatgggtgccaaaaacaacttaaaggaatgggctaagatgaatggctgtaccggttcaccagttcaaaacaatccaggaaataactgtgaaatgtatgaaaactgtaatggtggtgctaaggtgggtctctgtaccatcaacggtggtagtcactcaga

SEQ ID NO: 14116 - DNA, 501 bp, Neocallimastix californiae
  Abhydrolase_5
tttattcggtaatggtggttgtggtcgtatttccttctcctacggtaatttcttaactgaactcgcttcctatggttacgttgttgctgctgttggtccatgggttggtgaagataacactgattatctttccttatccttagatttttctgaagaaactattaatggattcaaggctgatgctaacagtttaattgatgttgctttaagttggcttgaaaaggaaaacaaggaaagaactagtattttctataagactttaaatactaataaggttagtgccatgggtcaatcctgtggtggtttacaagcattaattatcagtactaagaatgataagcgtattaagactactgttgccctaaacagtggagctaacagtccaggtgatttattagattcccttattgttaaggatgaacttcaaaaattaactcaaccaattatctatattattggtggcgaagaagatattgctcactataatgccttagatgattt

SEQ ID NO: 14117 - DNA, 615 bp, Neocallimastix californiae
  Abhydrolase_5
tcacccaattatgggtagtgcttctcaatgggaaaatggttctcaaaccgctaaagctgcccttagtgatggtgctattgttgcctttatggatggtgctcaaggtaacatgggtcaagcttggaatgtaggtccatgttgtactgatgctgatgatatttctttcactcgtaacttcattaaagaaattaccaataaagcttgtgttgatccaaaacgtatttacgctgctggtttctctatgggtggtggtatgtctaactacgttggttgttatcttgctgatgttattgcagccgctgctccatctgcttttgatcttgctaaagaagttgttgatggcggtaaatgtaaaccatctcgtccattcccaattcttaacttccgtggtactcaagataatattgttatgtacaatggaggactttcccaagttgttccaggtaaaccaattaccttcatgggagctaagaataacttcaaagaatgggctaaaatgaatggatgtactggatcaccaaaaaccaatacaccaggtaacaattgtgaaatgtatgaaaattgtaatggtggtgctaaagttggtctttgtactattaatggaggaggtcacgc

SEQ ID NO: 14118 - DNA, 615 bp, Anaeromyces robustus; identical to SEQ ID NO: 14117
  Abhydrolase_5

SEQ ID NO: 14119 - DNA, 429 bp, Anaeromyces robustus
  Abhydrolase_5
tctttctttacacggtatggaccaagatccaaattaccaacaatccaatacccactgggaaactttagctgatactgaaggttttgttgttgtatatccaagaggaggaactggtatgagtacttgggatatccaaggtgataaggataccaaatgggtattacaaattattgatcaaatggctaaggattatgacattgaccgtaatcgtgtttacctttctggattctctatgggtggtatgttcacttaccatgctatgagtaagattggtgacaagattgctgcttttgctccatgttctggtccaaatgtatttggtgcctcaaaggctatgcgtccagttccaattttccatgttcacggtactaacgatgatgtattaaattacaaccaagttgaaggtttccttaagaattaccgtgatca

SEQ ID NO: 14120 - DNA, 615 bp, Anaeromyces robustus
  Abhydrolase_5
cccaattatgggtagtgcttctcaatgggaaagtggttctcaaactgctaaagctgcccttaatgatggtgctattgttgcctttatggatggtgcacaaggtaacatgggtcaagcttggaatgtaggtccatgttgtactgatgctgatgatgtttctttcactcgtaacttcattaaagaaattaccaataaagcttgtgttgatccaaaacgtatttacgctgctggtttctctatgggtggtggtatgtctaattatgctggttgttatcttgctgatgttattgcagctgctgctccatctgcttttgatcttgctaaagaagttgttgatggcggtaaatgtaaaccatctcgtccattcccaattcttaacttccgtggtacagctgataatgttgtctcttataatggaggactttcccaagttgttccaggtaaaccaattaccttcatgggagctaagaataatttcaaagaatgggctaaaatgaatggatgtactggatcaccaaaaaccaatacaccaggtaacaattgtgaaatgtatgaaaattgtaatggtggtgctaaagttggtctttgtactattaatggaggaggtcactctga

SEQ ID NO: 14121 - DNA, 618 bp, Anaeromyces robustus
  Abhydrolase_5
tcacccaattatgggtagtgcttctcaatgggaaaatggttctcaaactgccagagctgcccttaatgatggtgctattgttgcctttatggatggtgctcaaggtccaatgggtcaagcttggaatgtaggtccatgttgtactgatgctgatgatgtttcttatactcgtaatttcattaaagaaattacaagtaaagcttgtgttgatccaaaacgtatttatgctgctggtttctctatgggtggtggtatgtctaattatgctggatgttaccttgctgatgttattgcagctgctgctccatctgcttttgatcttgctaaagaaattgttgatgctggtaaatgtaaaccagctcgtccattcccaattcttaatttccgtggtactcaagataatattgtaatgtataatggaggactttcccaagttgtacaaggaaaaccaattaccttcatgggagctaagaataatatgaaagaatgggctaaaatgaatggatgtactggatcaccaaaaactaacaccccaggtaataattgtgaaatgtatgaaaactgtgaaggtggttctaaagttggtctttgtactattaatggtggtggtcactctga

SEQ ID NO: 14122 - DNA, 615 bp, Anaeromyces robustus
  Abhydrolase_5
tcacccaatttcaggtagtgctgctgcttgggaatatggttctcaaactgccagagctgcccttaatgatggtgctgttgttgcttatatggatggtgctgttggcccaggtggtcaagcttggaatgttggtccatgttgtactgatgctgatgatgtacaatacactcgtgatttcattaaagaaattacaagtaaagcttgtgttgatccaaaacgtatttatgctgctggtttctctatgggtggtggtatgtctaactatgctggttgtaaacttgctgatgttattgctgctgctgctccatccgcttttgatctttctaaagaagttgttcaaagtggtcaatgtactccagctcgtccattcccaattcttaacttccgtggtacaagtgatttcgtagttccatacagtggtggttattctaatgctgttgcaggtaaaccacttactttcttaggtgctcaaaataatttcaaagaatgggctaaaatgaatggttgttcaggatcaccaaagagtaatactccaagtaacaattgtgaaatgtatgaaaattgtaacggtggtgctaaagttggtctttgtactattaatggtggtggtcacga

SEQ ID NO: 14123 - DNA, 615 bp, Piromyces finnis
  Abhydrolase_5
cccaattatgggtagtgcctcccaatgggaaggtggttctcaaactgccaaggctgcccttaacgatggtgccattgttgctttcatggatggtgctcaaggtccaatgggtcaagcttggaacgtcggtccatgttgtactgatgctgatgatgttacctacactcgtaacttcattaaggaaattacccaaaaggcttgtgttgatccaaagcgtatctacgctgctggtttctccatgggtggtggtatgtctaactatgctggttgttacctctctgatgttattgctgctgctgctccatctgctttcgatcttgccaaggaaattgttgactctggtaagtgtaagccatctcgtccattcccaatccttaacttccgtggtacttctgataacgttgttatgtacaatggtggtctttctcaagttgttccaggtaagccaattactttcatgggtgctaagaacaaccttaaggaatgggctaaaatgaacggttgtaccggttctccaaagagcaatactccaggaaacaactgtgaaatgtacgaaaactgtaacggtggtgttaaggtcggtctttgcaccattaacggtggtggtcacagtga

SEQ ID NO: 14124 - DNA, 615 bp, Piromyces finnis
  Abhydrolase_5
cccaattatgggtagtgcctcccaatgggaaggtggttctcaaactgccaaggctgcccttaacgatggtgccattgttgctttcatggatggtgctcaaggtccaatgggtcaagcttggaacgtcggtccatgttgtactgatgctgatgatgttacctacactcgtaacttcattaaggaaattacccaaaaggcttgtgttgatccaaagcgtatctacgctgctggtttctccatgggtggtggtatgtctaactatgctggttgttacctctctgatgttattgctgctgctgctccatctgctttcgatcttgccaaggaaattgttgactctggtaagtgtaagccatctcgtccattcccaatccttaacttccgtggtacttctgataacgttgttatgtacaatggtggtctttctcaagttgttccaggtaagccaattactttcatgggtgctaagaacaaccttaaggaatgggctaaaatgaacggttgtaccggttctccaaagagcaatactccaggaaacaactgtgaaatgtacgaaaactgtagcggtggtgttaaggttggtctctgtactattaatggtggtggtcacaatga

SEQ ID NO: 14125 - DNA, 615 bp, Piromyces finnis; identical to SEQ ID NO: 14123
  Abhydrolase_5

SEQ ID NO: 14126 - DNA, 615 bp, Piromyces finnis; identical to SEQ ID NO: 14123
  Abhydrolase_5

SEQ ID NO: 14127 - DNA, 324 bp, Neocallimastix californiae
  Ac_transferase_dom
cgatgccttccattctccattaatggacccagccattgaagaattaaatggttggattgaagaaaagaatgatgcccagttcagacaaactttaaaggtaaagttcatttccaacgttgatagtaccattaagcctgtcggtgatcgtcttgaaaaggattactggggtaagcatgctagaaatgccgttcgtttcgttgacggtgtaaagtctatgattgaatccgaaaagaagttattggctgtcattgaagttggtccagccgccacgttgaccaacatgagttctcgtttcgttcgtgaaacagaatctcttcgtggtaa

SEQ ID NO: 14128 - DNA, 378 bp, Neocallimastix californiae
  Ac_transferase_dom
gcatgaagtaggtatgtccttcacaggtcaaggcagtattaagccaggagttggtaaggaattatttagaacccaacccgtcttccgtgccgctatggaaaagtgtgatgctgtggttaagaagtctaccggaatttctattcttgatgccctctatgatcaaaatcaaggtcatcacttaaagaaggctcaaattgctcaacctgctttattcgcttatgaatatgctatgtacatgctttggaaatcttggggtattaagccagtcattgttaatggtcacagtttaggtgaaattgttgccgctgccgccaccggcgctatagatattgatttagccattgatttcattattgaaagagccagatgcatgggtga

SEQ ID NO: 14129 - DNA, 402 bp, Neocallimastix californiae
  Ac_transferase_dom
aaaatcaactgcttttgcttttactggtcaaggtgttgctaaggttggtatgggtaagcacttctaccaaactcaaccagttttccgtgaagctatggacagatgtgatgctgttactcgtcgtcttcttggcgtttccattgttgaggttttatataatgtttcaaacattccaaatggtactgaagaaggtgaaaaggctctcaagaagtcctctgttgcccaaccagctttattcgcttatgaatatgctatgagtcaattatggattagttggggaattaaaccatctatggttcttggtcattcacttggtgaaattgttgccactaccattgctggtggtattgactttgaattagctatggaattcattgttgaaagagcttcatgtatggaaaa

SEQ ID NO: 14130 - DNA, 318 bp, Neocallimastix californiae
  Ac_transferase_dom
tgaagctttccactctgctttaatggatccagctattgaaaagttatacgaatggattgatagtaagccagatgaaaaattccgtcaaccattaaaatatggtcttatttctaatgttactggtaagcttattccagctggtgaacgtcttccaaagaactactggggtgagcatgctagaaatgctgttcaatttgttaaggctgttgaaaccttattagccaatagtgaaactttattaaatgttattgaagttggtccagcttccgttttaactaacatgagttctcgtattttacgtgaaaagaaggttgataa

SEQ ID NO: 14131 - DNA, 357 bp, Neocallimastix californiae
  Ac_transferase_dom
taaggctttccataccccattcattctttcagctaaggagaaattccttaaaggtattgaaggtattcatttaagagttcagccaccaaagattccattcatctcttctactcatggtaatgaatatcaaggtccatttgatgccaactattggtggtccaatattattaatccagtgaactttagtcaagcagtaaaaattgctcataccaaggttgataaggtcttagaaattagtagtacgccagttttaggtatctatataagtagtgtcttccaacccgatagtatcttctataccctctcacgaaagctaaaggatcataatagtttatgtagaaatattgcaaatatgta

SEQ ID NO: 14132 - DNA, 405 bp, Neocallimastix californiae
  Ac_transferase_dom
aatttccgctaaaccaaagttagccttcactttttcaggacagggtactcaatatcctgatatgggtcgacaactgtatcattctaacccttattttgctaatattattgactattgtaacgaaatcgttctttccatctccaaaaaagatttattaaaggaaaccggtttattcggtgatttgccagtaaatgaagaaaacttaatggatcctcaatattccttcttagcgatcggtattattcaattggctcttgtagaattttggaaggcctatggtgtagaaccttcattggtctttggtcatagtatgggtgaagtagctgctgcatatgctgcgggtattttaactttagaagatgccattctcctactgtatcattatggtcttatcagtcaaaattt

SEQ ID NO: 14133 - DNA, 309 bp, Neocallimastix californiae
  Ac_transferase_dom
ctctgatttatatcatcgtcttccaagcttccgacaagccataaaagaatgtgataaagaaattaagaaattaacccaatataaatattctcttattaaggatttggctagtttaggtgaagaaagcaagaagagtaatttgagctatcttggtaacgttcttgttcttgcccttcattatgccttctataaggtcatcagaagtattcatcctgtcgaaggaactttacttgtcggttatggctatggtgaacttgccgctattcttaatgccggtggtatttccttcggaaaagcggcccaattcct

SEQ ID NO: 14134 - DNA, 414 bp, Neocallimastix californiae
  Ac_transferase_dom
gattaatgaaaagccaggcattaactttgctttttctggtcaaggttctcaatttataaatatgggtagacgtatgtatcaagtaaatggtcttttcaagagaattgtagactattgtgctgccgttcttgttacctacaatggtggtgaagatatttttgaaaagtaccatattttcaagggtgatgtttctcaaattagtgaagctgatctttctcttccacaatactctattcttgctattggtgttgctcaaattgctcttactgaaatttggaaggctatgggtgttactccagaagctgtttttggtcacagcatgggtgaagttgctgctgcctatgctgctggtattcttacacttgaagatgctatcttattattatacatgcgtggacatattcttgctcaatt

SEQ ID NO: 14135 - DNA, 357 bp, Neocallimastix californiae
  Ac_transferase_dom
gcaagctttccattctccatatgttgaaggtgctgaacaagcctttaaggaaagcattagaggtattagtgaacgtacttccgctccaaagtgtaaatttatttctgcatgctttggtcaagaatatgaaggtccatttgatgaaaactactggtgggctaacattcgaaatccagtaagtttctatgctgctgctagtattggtactcaattctctaaacgtgtattggaaattggtgctcacccagttcttagtgtgtatcttaaagaaatttatggtaaagaatatgtttatcaatcattatccagaaagatggatgatgttgatagcatgtgtcgtacaactgctgccttatt

SEQ ID NO: 14136 - DNA, 327 bp, Neocallimastix californiae
  Ac_transferase_dom
tactattccagctcacaatgaaatcttaaaggaagctgctgaattagttgttgaagatgctgccaagttaaacattacattcccaactaagaacttagctattccagtctaccgtactgataatggtgttgatatgaaggaagaatctgatattactgatgttgttgaacctgttgtcaaccaaatttgtatcttaccagtcgattgggttaaggccactaatgttccaggattaactcacgttttagatttcggacctggtggtgcctctggtattggttctcttatccaaaagaacaaggaaggtactggtgttcaagttattct

SEQ ID NO: 14137 - DNA, 207 bp, Neocallimastix californiae
  Ac_transferase_dom
aaatgctactcaattcactcaaccagcaattacccttactgaaaaggctgcctttgaagatatgtatgaaaagggttacatttgtgatgatgcagtttacgccggtcactctcttggtgaatacgctgctctttcctgtgttgctaacaccttaagtattgaaagtatggctgaaattgtcttctaccgtggtcttgtcatgcaatc

SEQ ID NO: 14138 - DNA, 168 bp, Neocallimastix californiae
  Ac_transferase_dom
attattatcttatcaattagcttctgctgttcaatggattaagactcaagaattcttattcagttctcaaaagaagggtggtgctgatattgaacgtcttattgaatttggtccaactccaactttagttggtatggctaaacgtactcttggtatgaaatatgttaa

SEQ ID NO: 14139 - DNA, 174 bp, Neocallimastix californiae
  Ac_transferase_dom
gccaactgcctacgttttcactggtcaaggtgctcaagaagttggtatgggtcaagatctctacaacaaatctgctgttgccaaggctgtttgggatagagctgatgcctacttaatgaagaagtacggttactctatcttggaaattgttcgtactaatccaaagtcccttac

SEQ ID NO: 14140 - DNA, 165 bp, Neocallimastix californiae
  Ac_transferase_dom
tgatgttccattccactccagttacttactttggggtgttccaaccttccgtgaattacttcaccaacgtgtccgtcgtgaagatgttgatgttaaatgtcttgttggtcgttacattccaaacttgatgggtgaaccattctctgttgaaaaggattatgctat

SEQ ID NO: 14141 - DNA, 453 bp, Neocallimastix californiae
  Ac_transferase_dom
tgttttcggtggtcaaggttacccaggttttaatgaaattcttcaagcttatactatgtatggtgccatcgttcgtgactacattgctgaactttccaccattttaaaggaattagcttctaagccagagttccaacgtacctacaaacaaggtcttgatattttaaaatggttacgtaacccagaatctcttccagaagatgcttacttagattctgctccagtttccttcccattaattggtattgttcaattagttcaatacttaattcttttccgtaccttccgtaaaactccagattgggctcgtcatttattcgctggtactactggtcactcccaaggtttagttacctctgttgttattgcttcatctggtaccgaagaagaatacttggaaaactctaagaaggctgtttccttattattcttgattggtgctcgttcccaaca

SEQ ID NO: 14142 - DNA, 297 bp, Neocallimastix californiae
  Ac_transferase_dom
aggtttatatgatgtttatccatgctttagaaaagccatcaaggaatgtgataaagaaataaaaaaattaactaataaacaatattctcttattaaagatattaccaatttgggtaaagaagataaaaaaggtatggactatcttggaaatgtcattgttctagctttgaattatgcttttaataaaatgattaatgatattcatgtttctaaaaatccccttcttattggttacggttatggtgaactttcagcaatacttaatgctggtggtgttacttttggtgcggctgctca

SEQ ID NO: 14143 - DNA, 399 bp, Neocallimastix californiae
  Ac_transferase_dom
acaaggtataacttttgtatttagaggaatgagccaattaaattcaaatattggctatagtttataccaatataaccaaaaatttgccgaaattgttgattactgtgataaggtacttgaaaaggtaagtggtggcgtttgctcacttaagagagaatttggtttattccaatcagaaaatttgaatttcctttctcttcaaaatccaaagatgtcaattattggtaatggcatgatacaattggctttgggtcatctattaaagagctatggtattaaaccatcttctgttgttggttacaattctggtgaaatcgctgctgcttatacagcaggtattattagtttagaggatgctatcttagttttatatcaatacagtactattttagaaaaagt

SEQ ID NO: 14144 - DNA, 297 bp, Neocallimastix californiae
  Ac_transferase_dom
ttgtggtatttgtacaccatatctaaatgattttaaggatgaattctttgcttcattaaagggtattggtaataattgcaagaccccagttattaaatttatttctacgactttgggacaaccatttaatggaccattaaatgaatattattggtgggcaaatttatcaagtactgtaaactttagtcatgctctttctcttgcaatgaatgaacaacaaaagggtagtgggtacattttagatgttggtagtggttacgctaatgctgctctctttaccaattactttggtgcttt

SEQ ID NO: 14145 - DNA, 171 bp, Neocallimastix californiae
  Ac_transferase_dom
tactgcttatgtcttcactggtcaaggtgctcaagaagtaggtatgggtatggacttgtatgaaaagtcaccagtagctagagaaatttgggatcgtgctgatgctcacttgatggaaaattatggtttctctattattgatattgttaagaataatccaactgaaattac

SEQ ID NO: 14146 - DNA, 141 bp, Neocallimastix californiae
  Ac_transferase_dom
attattagcttaccaatttgctagtgctgtcagatggattgaaactcaagatagattattcgttgatattggtgttgaacgtttaattgaaattggtccaggtccaacactttctggtatggctcaaaagaccttaaagtt

SEQ ID NO: 14147 - DNA, 207 bp, Neocallimastix californiae
  Ac_transferase_dom
atcggctactcaattcacacaaccatcccttgttttaatggaaaaggctgcttttgaagaaatgagatctcgtggtttcattcaacaaaacagtgcttttgctggtcatagtttaggtgaatatgctgccttaactgctattggtgatgtcttaagtattgaaacgttggttgatgtcgttttctatcgtggtatgactatgcaaag

SEQ ID NO: 14148 - DNA, 168 bp, Neocallimastix californiae
  Ac_transferase_dom
tgatgttccattccactctagtttcttattaagaggtgttgctccattccgtcaatacttgatgagtaagtttgatccaaacttgattgacgttaaccgtttaatcggtaattatattccaaacttaactgctgaaccattctctcttaagaaggaattcattgaaaa

SEQ ID NO: 14149 - DNA, 141 bp, Neocallimastix californiae; identical to SEQ ID NO: 14146
  Ac_transferase_dom

SEQ ID NO: 14150 - DNA, 339 bp, Neocallimastix californiae
  Ac_transferase_dom
ttctgttccattccattgtgattacttaaaggatgttaatgatattattatgaaggatgttgaacgtgatcatttaattcttggtaagggtgaattagttattccaattttatctactgagactggtgaagatttaagaggtcatccacaatttacttatgaattaattaaacaaatttgtactttacctgttcattgggaaaaggctacctctgttactaatgctactcatgtattagaatttggtccttctggtgctggtgttggtttattaacccacagaaataagattggtaccggtattcaaattattcttgctaacagtttagaatctactga

SEQ ID NO: 14151 - DNA, 483 bp, Neocallimastix californiae
  Ac_transferase_dom
tgctaaacataaggcatctatctttgccgtttttggtggtcaaggtagtgaagattactttaatgaaattaaggaaatttacagtacctatgaagttatcattaaatcttatttagaaagaatgtcttgcatgttagaagaattagcttcaaagccagaacttttacaattctttccaaagggtttacatgttttaaaatggttagaagaaccagaaactttaccagatactaaatatttagttaatgctccaatttctttaccattagttggtctttgtcaacttttacattactctgttttatataaaattttaggaaaaactccagatgaaatgagaagatgttttgttggtaccactggtcactcccaaggtattatttcatctgttgttgtttcatcctctggaactgaagaagaatttattgaaaattctcaaaaggctttatctttattattctggattggtgttagatctcaaat

SEQ ID NO: 14152 - DNA, 207 bp, Neocallimastix californiae; identical to SEQ ID NO: 14147
  Ac_transferase_dom

SEQ ID NO: 14153 - DNA, 171 bp, Neocallimastix californiae; identical to SEQ ID NO: 14145
  Ac_transferase_dom

SEQ ID NO: 14154 - DNA, 168 bp, Neocallimastix californiae; identical to SEQ ID NO: 14148
  Ac_transferase_dom

SEQ ID NO: 14155 - DNA, 309 bp, Neocallimastix californiae
  Ac_transferase_dom
taaggagctcttatctactgaaaatagtttcaagaagacattcgaattctgtgactctgaaattcaaaagattgctgaaggcatttccttaaaacaaatgatagaagaagaaaagaatggaaaggaaagcgaactcaataattcattctttatcctttctttctattacagtttacatcaacttgtcgaatccataatgataaagaataacagtagtaagaagatttatggaggatttggatttggagaaataataagtttagttcttagtggaggattatctttcagttcagccatttccttaattca

SEQ ID NO: 14156 - DNA, 267 bp, Neocallimastix californiae
  Ac_transferase_dom
tttcgccatccacaccaaaaagatttctgaagcaatgaaggaagaactggtaaagcgtttaacgaacattaaatccaagccttcctccattgccatgttctcgaccaccaaattcagtaaagaaggaaagccatataccgacgcattagatggtcagtactggtggatgaatatgagaaatccagtgctctatgctcattccctctcccaaacggccaacttccttccaaccgatggtaaaaatattttagagattggtcttcactt

SEQ ID NO: 14157 - DNA, 381 bp, Neocallimastix californiae
  Ac_transferase_dom
ctgtagagatttctattgtaataatagctactttgctgactgcattgattattgtgatcaggtattaaagatgataagtggacgttctcttcttgaagattatggtcttttccaatccgtaaaggaagaagaaaaggaaaaggaaaaggaaaagaaaaacaaattaagagaagatcttctcaaggatcctactactactcttttaattaatggtataattcaattaggattagtggcactctaccgttattatggcatttctccaaatgcagttattggttatggtgctggtgaaattgctgctgcctatgctgcagaaaagatagatttaaaatcggctgttcaaattctttatcattatggaagggtattatcgatggt

SEQ ID NO: 14158 - DNA, 348 bp, Neocallimastix californiae
  Ac_transferase_dom
tgcttgctacctctaccgtacttatcctgtctatgctaaagccttagaggaatgtgatcgtatcatctctgaattaagtaactttaaggtcttattagttaatttgatcatttgtatgggtgaattagttcaaccagatcttttaaaggaatacaagaaacaagtcgatgaagatccatgtatggctcaattcattattctttcgatgaactatgcactcaccgcgctcttacgtcatttgaatatttctatcaatttagtcatgggagatggtttcggtgaagtcagtgccgctttagcttgccaaaaaattaccttaagaaacgcttttattctcattcaatatct

SEQ ID NO: 14159 - DNA, 315 bp, Neocallimastix californiae
  Ac_transferase_dom
attagagttattcctttctcgtccagaattcagaaaggctcttttagattgtgacagcattatttctgaagttagtaacaagacctattccttagttgatgatattgttaatggaggaaagaacaataaggaagctgctgatgccttccaagctattaatgtcctttccttctattatgccttacacaagactttagataaagaattagatattagcaaatctatctactgtggttatggacttggagaactcattactattcttgttaatggtggtatttctcttaagaaggccatccaattccttaaattagt

SEQ ID NO: 14160 - DNA, 288 bp, Neocallimastix californiae
  Ac_transferase_dom
tgttccattccattgtgattacttaaaggatgttaatgatattgttatgaaggatgttgaacgtgataacttaacccttggtaagggtgaattagctatcccaattttatctactgaaactggtgaagatttaagaggtcatccacagtttacttatgaattaattaagcaaatttgtactttaccagtttactgggaaaaggctacttctattactaatgctactcatatcttagaatttggtccatctggtgctggtgtcggtttattaactcacagaaacaaggt

SEQ ID NO: 14161 - DNA, 489 bp, Neocallimastix californiae
  Ac_transferase_dom
tgttactaagcataaggcttctatctttgccgtttttggtggtcaaggtagtgaagattattttaatgaaattaaagaaatttacagtacctatgaagttatcattaagtcatatttagaaagaatgtcttgtatgttagaagaattagcttctaaaccagaacttttacaattcttcccaaaaggtttacatgttttaaaatggttagaagaaccagaaactttacctgatactaaatatttaattaatgctccaatttctttaccattagttggtctttgtcaacttttacattactctgttttatataaatctttaggcaaaactccagatgaaatgagaagatgttttgttggtactactggtcactcacaaggtattatttcatctgttgttgtttcatcttctgggactgaagaagaatttattgataattctgaaaaggctttatctttattattctggattggtgttagatctcaaatggc

SEQ ID NO: 14162 - DNA, 141 bp, Neocallimastix californiae
  Ac_transferase_dom
attattagcttaccaatttgctagtgctgttcgttggattgaaactcaagatagattattcgttgatattggtgttgaacgtttaattgaaattggtccaggtccaacgctttctggtatggctcaaaagacattaaagtt

SEQ ID NO: 14163 - DNA, 168 bp, Neocallimastix californiae
  Ac_transferase_dom
tgatgttccattccactctagcttcttattaagaggtgttgctccattccgtcaatacttaatgagtaaatttgatccaaacttgattgatgttaatcgtttaatcggtaattatattccaaacttaactgctgaacccttctctcttaagaaggaatttattgaaaa

SEQ ID NO: 14164 - DNA, 171 bp, Neocallimastix californiae
  Ac_transferase_dom
tactgcctatgttttcactggtcaaggtgctcaagaagttggtatgggtatggatttgtatgaaaagtctccagttgcaagagaaatttgggatcgtgcggatgctcacttaatggaaagctatggtttctccatcattgatattgtcaagaataacccaaccgagattac

SEQ ID NO: 14165 - DNA, 207 bp, Neocallimastix californiae
  Ac_transferase_dom
atcggcaactcaattcactcaaccatcgcttgttttgatggaaaaggcagctttcgaagaaatgagaactcgtggtttcatccaacaaaatagtgctttcgctggtcacagtttaggtgaatatgccgccttaactgctattggtgatgtcttaagtattgaaaccttagtggatgtcgtcttctatcgtggtatgaccatgcagag

SEQ ID NO: 14166 - DNA, 327 bp, Neocallimastix californiae
  Ac_transferase_dom
tactattccagctcacaatgaaatcttaaaggatgctgccgaattagttgttgatgatgctgccaagttaaacattactttcccaactaagaacttagctattccagtttaccgtaccgataatggtgttgacatgaaggaagaagctgaagttaccgatgttgtcgagtctgttgtcaaccaaatttgtattttaccagttgattgggttaaggctactaatgttccaggtttaactcatgttttagatttcggacctggtggtgcctctggtatcggttctcttattcaaaagaacaaggaaggtactggtgttcaagttatcct

SEQ ID NO: 14167 - DNA, 207 bp, Neocallimastix californiae
  Ac_transferase_dom
aaatgctactcaattcactcaaccagctattactcttactgaaaaggctgcctttgaagatatgctcgaaaatggttacatctgtgatgatgctgtctatgctggtcactctcttggtgaatatgccgctctttcttgtgtcgctaacaccttgagtattgaaagtatggctgaaattgtcttctaccgtggtcttgttatgcaatc

SEQ ID NO: 14168 - DNA, 453 bp, Neocallimastix californiae
  Ac_transferase_dom
tgttttcggtggtcaaggttacccaggtttcaatgaaatacttcaagcctacactatctatggtgctattgttcgtgattacattgctgaactttccactgttttaaaggaattagctgctaagccagaattcgaacgtacctacaagcaaggtcttgatatcttaaagtggttacgtaatccagaatctcttccagaagatgcttaccttgattctgctccagtttctttcccattaattggtattgttcaattagttcaatacttaattcttttccgttccttccgtaaaactccagattgggctcgtcgtttattcgctggtaccactggtcactctcaaggtttagttacttctgttgttattgcctcctccggtactgaagaagaatacttagaaaactctaagaaggctgtttccttattattcttaatcggtgctcgttcccaaca

SEQ ID NO: 14169 - DNA, 174 bp, Neocallimastix californiae
  Ac_transferase_dom
gccaactgcctacgttttcactggtcaaggtgctcaagaagttggtatgggtcaagaactctacaacaaatctgctgttgccaaggctgtttgggatagagctgatgcctacttaatgaagaagtatggttactctatcttagaaattgttcgtactaatccaaagtctcttac

SEQ ID NO: 14170 - DNA, 156 bp, Neocallimastix californiae
  Ac_transferase_dom
attattagcttatcaattagcttctgctgttcaatggattaagactcaagaattcttattcagttctaagaataagggtggtgctgatgttgaacgtcttattgaattcggtccaactccaactttagttggtatggctaaacgtactcttggtat

SEQ ID NO: 14171 - DNA, 165 bp, Neocallimastix californiae
  Ac_transferase_dom
tgatgttccattccactccagttacttactttggggtgttccaaccttccgtgaattacttcatcaacgtgtccgtcgcgaagatgttgatgttaaatgtcttgttggtcgttacattccaaacttaatgggtgaaccattctctgttgaaaaggattacgctat

SEQ ID NO: 14172 - DNA, 210 bp, Neocallimastix californiae
  Ac_transferase_dom
cgatgctttccattctccattaatggacccagctatcgaagaattaaataactggattgaagaaaaggatgatgctaagttcagacagtccttaaaggttaagttcatctctaatcttgatggtaccattaagccagttggtgatcgtcttgaagaagattactgggctaaacacgctagaaatgctgttcgtttcgttgatggtgttaa

SEQ ID NO: 14173 - DNA, 369 bp, Neocallimastix californiae
  Ac_transferase_dom
aggtatgtccttcactggtcaaggtagtatcaagccaggcgttggtcaagaattattcagaagtcaaccagttttccatgcagctatggaaaagtgcgatgctgttgttaagaaggttaccggtgtttctatcattgatgccctctatgatcaaagtcaagcccatcacttaaagaaggctcaaattgctcaacctgccttattcgcttatgaatatgccatgtgtatgctttggaagtcttggggtgttgaacccgtcatcgtcaatggtcacagcttaggtgaaattgtggctgctgctgttactggtgctatcgatattgatttagccatcgatttcattattgagagagccagatgtatgggtga

SEQ ID NO: 14174 - DNA, 591 bp, Neocallimastix californiae
  Ac_transferase_dom
aaaagacgtttatcaaaattatgactactataaggaatgctttatctactgtgaacaaaagatacaaaaacttggaggagataaaaaatatccaatgtttgatgttgtttttgaacatgacaaaataaatattgataccctagatcctattgtgaagcgtttaattatattttcacatttctattctcttcataaacttttccttaattttaatattagtattaatgctattagtggaaaaggaattggagaatattttactttagccatttcctatgcactctctttagaagattcattgagactcctaattaactattataataatactacagtggacagtgataaaattgagaaagaagttaaattaataatgtccattcagaagccacttcgttgttatttctattctaatgctacgaaaagactcttaaagactaatgagtatctagatgagacttactggaaaactcttttatccaatgtagttttccaagaagaaaataaagaaaatgaaattgataacttatttataaagcaaatcattacaattagcccacaaaccattacagtaaagccagcatctacatt

SEQ ID NO: 14175 - DNA, 591 bp, Neocallimastix californiae; identical to SEQ ID NO: 14174
  Ac_transferase_dom

SEQ ID NO: 14176 - DNA, 468 bp, Neocallimastix californiae
  Ac_transferase_dom
taaagagatctatcaatattatgattattacaaagaatgttttatctattgtgaacaaaagattcaaagtcttggaggaaataaaaaacatccaatgtttgatgttgtttttgatagtaattactctgatattaaaaatttagatcctatagttaaacgtttaattatattttcacatttctattcacttcataaacttttccttaattttaatgtcagtattaattctattggtggagaaggcattggtgaatattttgctctggccatttcaggtgtcctctcattagaagaatcattaaaactattaataaattatcataatattattgtggataaaaacaaaattgaaaaagaagttaaatcattactttctattcaaaagccacttcgatgtcatttttactctagtgctacaaaaaggttaatgaaaactagccaatatctagatgattcctattggaaaat

SEQ ID NO: 14177 - DNA, 261 bp, Neocallimastix californiae
  Ac_transferase_dom
ctttggtatacattctaagataattacagaagctatgaaggatgaattaacaaagcgtcttgaaaacatttcatctcattcttcttctattgcgatgttttcaactgcaaaattcaatgagaagagcgaaccgtacactggtgctttagatggttcatactggtggatgaatatgagaaatccagtactttatgcccatactctttctcaaacagttaactaccttccttctgatggtaagaatattttagaaattggtct

SEQ ID NO: 14178 - DNA, 222 bp, Neocallimastix californiae
  Ac_transferase_dom
caagttaaaggaagatcttcttaaggatccttcaaccgctcttttaattagtggtattgttcaatttagcttggtatctctctataaatactatggtattacgcctagtgttgttattggctatggtgcaggtgaaattactgcggcgtatgcagctgaaaaaatagatttgaaggatgccgttcagattctttaccactacggtcaagtcctatccatggc

SEQ ID NO: 14179 - DNA, 159 bp, Anaeromyces robustus
  Ac_transferase_dom
attattagcttatcaattagcttctgctgttcaatggattaaaactcaagaattcctctttagtagtgaaaagaagggtggcgttgatattgaacgtcttattgaatttggtccaactccaactttagtgggtatggctaaacgtactcttgctaagaa

SEQ ID NO: 14180 - DNA, 453 bp, Anaeromyces robustus
  Ac_transferase_dom
cgttttcggtggtcaaggttatccaggttttaatgaaattcttcaagcttacactatttacggtgctattgttcgtgattacattgatgaactttccaccgttttaaaggatttagcttctaaaccagaatttgaacgtacctataaacaaggtcttgatatcttaaaatggttacgtcatccagattcccttccagaagatgcctaccttgattctgctccagtttccttcccattaattggtattgttcaacttgttcaatacttgattcttttccgtaccttccgtaaaactccagattgggctcgtcatttattcgctggtaccactggtcactctcaaggtttagttacctctgttgttattgcctcttctggtactgaagaagaatatttagaaaattctaagaaggctgtttcccttcttttcttaattggtgctcgttctcaaca

SEQ ID NO: 14181 - DNA, 207 bp, Anaeromyces robustus
  Ac_transferase_dom
aaatgctactcaatttactcaacctgctattacccttactgaaaaggctgcctttgaagatatgcttgaaaatggttacatttgtgatgatgccgtttatgctggtcactctcttggtgaatatgctgctcttagttgtgttgctaatactttaagtattgaaagtatggctgaaattgtattctaccgtggtcttgttatgcaatc

SEQ ID NO: 14182 - DNA, 174 bp, Anaeromyces robustus
  Ac_transferase_dom
gccaactgcttatgtctttactggtcaaggtgctcaagaagttggtatgggacaagaattatataataaatcggctgtcgctaaatccgtttgggatagagctgatgcctatttaatgaaaaagtatggttattccattttagaaattgttcgtactaatccaaaatctttaac

SEQ ID NO: 14183 - DNA, 165 bp, Anaeromyces robustus
  Ac_transferase_dom
tgatgttccattccattctagttatttattatggggagtcccaaccttccgtgaattacttcatcaaagagttcgtcgtgaagatgttgatgttaaatgtcttgtaggacgttatattccaaacttgatgggtgaacctttctctgttgaaaaggattatgctat

SEQ ID NO: 14184 - DNA, 327 bp, Anaeromyces robustus
  Ac_transferase_dom
ttctattccagctcacaatgaaattttaaaggaagctgctgatttaattattgaagatgccgctaaattaaatattactttcccaactcaagatttagctattccagtttaccgtaccgataatggtgttgatatgaaggaagaagttgatgttccagatgttgttgaatctgttgtcaaacaaatttgtattcttccagtggattgggttaaggctactaatgttccaggtttaactcatgttttagatttcggtccaggtggtgcctctggtattggttctttaattcaaaagaataaggaaggtactggtgttcaagttattct

SEQ ID NO: 14185 - DNA, 405 bp, Anaeromyces robustus
  Ac_transferase_dom
aatatccgcaaaaccaaagttagcctttactttttcaggtcaggccactcaatacccagatatgggtcgtcaactttatcattctaatccttattttgctagtattattaattattgtaatgaaattattattcgtttgtcacaaaaagatcttattaaagatactggattgtttagtgatacaccagtagatgaagaaaaattaattgatccacaatattctttccttgctataggtattattcaattagcccttgttgaattttggaaattatatggtgttgaaccagctcttgtttttggtcatagtatgggtgaagttgctgctgcttatgctgctggaattttaaccatagaagatgctatcttattactttataattatggtcttattagtcaaaatgt

SEQ ID NO: 14186 - DNA, 357 bp, Anaeromyces robustus
  Ac_transferase_dom
aaaggcattccatacaccatatattattacagcaaaacaaaaatttattcaaggcattcaaggtattggtagtagagttaattcaccaaaaattccatttatttcttcaacttatggtaaagaatatcaaggaccatttgatgaagaatattggtggactaatattattaatccagttaactttagtcaagctacaaaagtagctcgtactaaagtagaaaaagtattagaaattggttcaacaccggtattaggtatatatatgagtaaaattttcaatccagataatattttctattctttatcacgtaaattgaaagattatcatagtttaagtagaaatattgctaatatgta

SEQ ID NO: 14187 - DNA, 405 bp, Anaeromyces robustus
  Ac_transferase_dom
atcaaaatcatctgcttttgcattcactggtcaaggtgttgctaaggttggtatgggtaaacatttctaccaaacacaaccagtcttccgtaaggctatggacaaatgtgatgaagtcactcgtcgtcttcttaatgtatctattgttgaagttttatacaatatttctaatgcaccaaatggtattgaaaaaggtgaaaatgctcttaaaaaatcttctgttgctcaaccagccttatttgcttatgaatatgctatgagtcaactttggataagttggggtgttgaaccatctatggttcttggtcactctcttggtgaaattgttgctactactattgcaggtggtattgatttcgaattagctatggaattcattgttcaaagagcttcttgtatggaaaa

SEQ ID NO: 14188 - DNA, 315 bp, Anaeromyces robustus
  Ac_transferase_dom
tgaagctttccattctgctttaatgaatccagctattgaaaagttatacgaatggattgaaactaaaccagatgataaattccgtaaaccattgaagtacggtcttatttctaatgttactggtgaacttattccagctggtgaacgtcttccaaagaactattggggtgaacatgcaagaaatgctgttcaatttgttaaggctgttgaaaccttattagctaacagtgagactttattaaatgttattgaagttggtccatctaatgtcttaactaatatgagtgctcgtattttacgtgaaaagaagattga

SEQ ID NO: 14189 - DNA, 315 bp, Anaeromyces robustus
  Ac_transferase_dom
tgatgctttccactctccattaatggaaccagctattgaagaattagataaatggattgaaggaaaggatgatgaaaaattcagacaaccattaaaggttagatttatttctaatgttgatggtaagattaaggaagttggtgaacgtcttgatgaaaattattgggctgaacatgctagaagtactgttagatttgttgatggtgttaaatctatgattgaatctgaaaataataatatattagctgtgattgaagttggtccagctgctactttatctcatatgagtgcacgttatgttcgtgaaaatgaagc

SEQ ID NO: 14190 - DNA, 384 bp, Anaeromyces robustus
  Ac_transferase_dom
tgataaaactgaagttggtatgtctttcactggtcaaggtagtattaaaccaggtgttggtcaagaattatatagaagtcaaccagttttccgtgatgctattgataaatgtgatactgttttaaagaaggtcactggtatttcacttgttgatgttctttacaatccacaacaagctcatcatttaaagaaagctcaaattgcacaaccagctttatttgcttttgaatatgctatgtgtatgctttggaaatcttggggtgttgaaccaactattgttaatggtcatagtttaggtgaaattgttgctgctgctgttactggcgcaatggatattgatttagctattgatttcattgttgaaagagctagatgtataggcga

SEQ ID NO: 14191 - DNA, 489 bp, Anaeromyces robustus
  Ac_transferase_dom
tgttgataagcataaggcttccatttttgccgtttttggtggtcaaggtagtgaagattactttgatgaaattaaagaaatttacaatacatatgaagttcttattaaatcttatttagaaagaatggcttgcgttttagaagaattagcttctaaaccagaacttttacaatttttcccaaaaggtttacatgttttaaagtggttagaagaaccagaaactttaccagatactaaatatatgattaatgctccaatttctttacctttagttggtctttgtcaacttttacattactgtgttttatataaatcattaggaaaaactccagatgaaatgagaagcagttttgttggtactactggtcattcacaaggtattatttcttctgtagttgtttcctcttctggaactgaagaagaatttattgaaaattctattaaagccttatctttattattctggattggtgttagatctcaaatggc

SEQ ID NO: 14192 - DNA, 285 bp, Anaeromyces robustus
  Ac_transferase_dom
tgttccattccattgtgattatttaaaggatgttaatgatactattatgaaggatgttgaacgtgatcatttaattcttggtaaaggtgaattggctattccaatttattctactgaaactggtgaagatttaagaggtcatccacaatttacttatgaattaattaaacaaatttgtactttaccagttcactgggaaaaagctacttctattactaatgctacccatattttagaatttggtccatctggtgctggtgttggtttattaactcacagaaataa

SEQ ID NO: 14193 - DNA, 171 bp, Anaeromyces robustus
  Ac_transferase_dom
tactgcttatgtctttactggtcaaggtgctcaagaagttggtatgggtatggacttgtatgaaaaatctgctgttgctagagaaatttgggatcgtgctgatgctcacttaatggaaacttatggtttctctattattgatattgttaaaaataatccaactgaaattac

SEQ ID NO: 14194 - DNA, 168 bp, Anaeromyces robustus
  Ac_transferase_dom
cgatgtaccattccactctagtttcttattaagaggtgttgctccattccgtcaatatttaatgagtaaatttgatccaaatcttattgatgttaatcgtttaattggtaattacattccaaacttaaccgctgaaccattctcattagaaaagaagtttattgaaaa

SEQ ID NO: 14195 - DNA, 207 bp, Anaeromyces robustus
  Ac_transferase_dom
atctgctactcaatttacacaaccttccttagtattaatggaaaaggctgcttttgaagaaatgagatctcgtggtttcattcaacaaaatagtgctttcgctggtcacagtttaggtgaatatgctgccttaactgctattggtgatgttttaagtattgaaactttagttgatgtcgttttctatcgtggtatgactatgcaaag

SEQ ID NO: 14196 - DNA, 141 bp, Anaeromyces robustus
  Ac_transferase_dom
attattagcttatcaatttgctagtgctgttcgttggattgaaactcaagatcgtttattcgttgatattggtgttgaacgtttaattgaaattggtccaggtccaacactttctggtatggctcaaaagactttaaaatt

SEQ ID NO: 14197 - DNA, 405 bp, Anaeromyces robustus
  Ac_transferase_dom
ttctcataaacaaggtattacttttgtctttagaggtattagtgaattaaattcaaactttagttatagtttatacaagtataatcaaaagtttgctaaaattgttgactattgtgataaggttcttgagaaagttagtcaaggtttatcccttaagagagattatggtcttttccagaaggaaaactttgatgaaaccactttaagagatccaaaaatttctgttattggtagtggtattattcaacttaccatggctcatctcttaaaatcctatgctattattccatcctctgttgttggttatagtattggtgaaatttccgctgcttatgccgctggtattatttccttagaggatgcggttcttattttatatcaatatagttctattttagaaaaggt

SEQ ID NO: 14198 - DNA, 261 bp, Anaeromyces robustus
  Ac_transferase_dom
aaatggaatttgtactccatatcttaatgactttaaggatgaattctatgaatctttaagagatattggtagtagatgtaaggatccagttattccatttatttcaactactttaggtcaaccatttaatggtccattaaatgaattctattggtgggctaatttaactagtactgttaactttagttctgctctttcacttgctatgaatgagcaaccaaatggtagtggttatattttggatgttggtagtggttattc

SEQ ID NO: 14199 - DNA, 288 bp, Anaeromyces robustus
  Ac_transferase_dom
attagaattaactcttgctcatccagtatttaaagaagctttagatgaatgtgatgttctcatttctgaaattttaaataataattattctttaattgatgatcttgttaataaaggtaaaaattccaataaaaattatcaaatttttggtattatttccttttattatgctttatctaaaatattagatgaagaattaaaaattaatcaatccattaactttggttatgatattggtgaattaatagctattcttcttaataatggtattagtattagaaaagtttt

SEQ ID NO: 14200 - DNA, 384 bp, Piromyces finnis
  Ac_transferase_dom
agataaaactgaagttggtatgtctttcaccggtcaaggtagtattaaatcaggtgttggtttagaattatacagaactcaaccagttttccgtgatgctcttaacaagtgtgatgttgttgttaaaaaggctaccggtatttctcttattgacgctctttacaatccaagtcaaagtcatcacttaaacaaggcacaaattgctcagccagctttatttgcttacgaatatgctatgtgtatgctttggaaatcatggggtattaacccaactattgtcaatggtcacagtttaggggaaattgttgctgctgcttctactggtgctatggatattgatttagctattgatttcattattgaaagagctagatgcatgggtga

SEQ ID NO: 14201 - DNA, 324 bp, Piromyces finnis
  Ac_transferase_dom
tgatgctttccattcaccattaatggatccagctgttagcgaattaaataaatggattgaaagaaaggatgactccaaattcagacaagacttgaaggttaaatttatttctaatgtcgatggtaacattaaaccagttggctctcgtcttgaagaagactattggggtaagcatgctagaaatgctgttcgtttcgttgatggtgttaaatccatgattgaatccgaaaagaagttattagctgttattgaagttggtccagccgctaccttaactaacatgagctctcgtttcgttcgtgaaaccgaatcacttcgtggtac

SEQ ID NO: 14202 - DNA, 306 bp, Piromyces finnis
  Ac_transferase_dom
atcagaactctataacagtcaaccagtatttagaaaggttattaagaactgtgataaggaaatcatggaaattactcatcaacaatattcattagttaaggatattgccagtttaggaaaagaagaaaagaaagatatgccttatattaataatattattacattagctattcaccacgcctattataaattaatgaagtctgtatattctgtagataattctttattcattggttatggttatggtgaactttctgctattcttaatgcaggtggtatttcctttaaagcagcttcacagttact

SEQ ID NO: 14203 - DNA, 306 bp, Piromyces finnis
  Ac_transferase_dom
tgaattatacatatctcgtcctgaatttaaacaagctattgaagaatgtgacgctatcattactactattagtaataatgtctattctttagttgatgacattacttcaaagggaatgaacattaatgaaagcaaggatgcattcaaaaacataaaaatactttcattctattatgctttatctaaagttatagataatgaattgaatgttaaacaatccatttttggtggatatggacttggtgaaatcatttctattttaatcaacaatggcatttctattgaaaaagcaattcgattcctaaa

SEQ ID NO: 14204 - DNA, 261 bp, Piromyces finnis
  Ac_transferase_dom
atgtggtatttgtactccattccttaacaatttcaagaatgaattccatgaagccttaaaggacattggtagccgctgcaaagctccagcaactccatttatctcaactactttaagtcaaccattcaatggtccattaaatgaatattattggtgggctaactttactagtactgttaactttaatgttgctctttcccttgctatgaatgaacaacaaaaaggtagtggatatattttagatgttggctgtggttattc

SEQ ID NO: 14205 - DNA, 405 bp, Piromyces finnis
  Ac_transferase_dom
ctcccataagcaaggtattacttttgtttttagaggtattagtgagttaaaaaccaatttaggttatagcttataccaaaataataaaatgtttgctgatgttgttgactattgtgacaagattcttgagaagattagccagggctactctgttaagaaaaacaccggtcttttcttaaaggaaaacttagatgctgctacccttcaaagtccaaagatttctgttgttggtagtggtatgatccaacttgctatggctcatcttttaaagacctatggtattgttccatcctctgttgttggttacaatactggtgaaatcgctgctgcttatgccactggtattatttctttagaagatgccattcttattttataccaatttagtaatatattagaaaaggt

SEQ ID NO: 14206 - DNA, 396 bp, Piromyces finnis
  Ac_transferase_dom
ttccgcctttgctttcactggtcaaggtgttgctaaggttggtatgggtaagcatttctatcaaactcaaccagttttccgtaaggctatggacaaatgcgatgaagttactcgtcgtcttctcgatgtttctattgtcgaagttctttacaatatctcaaattctccaaatggtgtcgaagaaggtgaaaaggctcttaagaaatcttcagttgctcaaccagctttatttgcttatgaatatgctatgagtcaactttggattagttggggtgttgaaccatcaatggttcttggtcattcacttggtgaaatcgttgctacaactattgcaggtggtattgactttgaattagctatggaatttattgttcaaagagcttcttgcatggaaaa

SEQ ID NO: 14207 - DNA, 318 bp, Piromyces finnis
  Ac_transferase_dom
tgaagccttccattctgctcttatggatccagctattgaaaaattatatgaatggattaatactaaaccagatgaaaagttccgtcaaccattaaagtatggtcttatttctaatgttactggtgaacttattgaggctggtgaacgtcttccaaagaattattggggagaacatgctagaaatgctgttcaatttgttaaggctgttgaaaccctattagctaatagtgaaactttattaaatgttattgaagttggtccagctaatgttttaactaatatgagttctcgtattttacgtgaaaagagaattgacaa

SEQ ID NO: 14208 - DNA, 318 bp, Piromyces finnis; identical to SEQ ID NO: 14207
  Ac_transferase_dom

SEQ ID NO: 14209 - DNA, 396 bp, Piromyces finnis; identical to SEQ ID NO: 14206
  Ac_transferase_dom

SEQ ID NO: 14210 - DNA, 264 bp, Piromyces finnis
  Ac_transferase_dom
ttatggcttacattcaatgatgattaatgataaaatgaaggaagatcttgtgaacagtcttaaggacattcctttacaaacttctgatattgctttcttcactaccactaagctcaataaggatggtaagccatacgaaggaaaactagacggtgaatactggtggatgaatatgagaaatccagttctttatgctcacgctttatctcaaacagtcgcctttttaccaatagatggtaagaatataatagaaattggttttgg

SEQ ID NO: 14211 - DNA, 381 bp, Piromyces finnis
  Ac_transferase_dom
tacatattacaattgttgtagaaatctttactgtaataataaatacttttctgattgtattgattattgtgatggtattttcaaggctttaagtcaacgttctcttcttcaagattacggcttatttactactgaaatgatggataacaataaatttaaaaaatttaattctgatcttagaaaggatccattagtcatgataatgtttggtggtatggttcaattaactttgtctgccttattaaaatattatggtctatttcctaatgcagttattggttatggtgctggtgaaattgttgctgcctatgttgctgataagatggatttaaagactacggttaaagttctttaccactatggtagagttttaagtcacgc

SEQ ID NO: 14212 - DNA, 207 bp, Piromyces finnis
  Ac_transferase_dom
atcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaag

SEQ ID NO: 14213 - DNA, 483 bp, Piromyces finnis
  Ac_transferase_dom
tgctaagcataaggcttctgtctttgctgtttttggtggtcaaggtagtgaagactattttgatgaaattaatgaaatttatagtacatatgaagccatggttaagtcttacttagaaagaatggcatgcattttagaagaattagcttctaaaccagaacttttacaattcttcccaaagggtttacatgtcttaaagtggttagaagaaccagaaacccttccagataaaaaatatttagtcaatgctccaatttctttaccattagtaggactttgccaacttttacattacactgtattatataagtctttaggaaagactccggatgaaatgagaagaagctttattggtactactggtcattctcaaggtattatttcatctgttgttgtttcttcttcaggaacagaagaagaatttattgaaaattcagaaaaggctttatctttattattctggattggtgttagatctcaaat

SEQ ID NO: 14214 - DNA, 141 bp, Piromyces finnis
  Ac_transferase_dom
attattagcttaccaatttgcaagtgctgttcgttggattgaaactcaagatagattattcgttgatattggtgttgaacgtttaattgaaattggtccaggtccaactctttctggtatggctcaaaagacattaaagtt

SEQ ID NO: 14215 - DNA, 171 bp, Piromyces finnis
  Ac_transferase_dom
tactgcttatgtcttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactgaaatcac

SEQ ID NO: 14216 - DNA, 168 bp, Piromyces finnis
  Ac_transferase_dom
tgatgtaccattccactctagtttcttattaagaggtgttgctccattccgtcaatacttaatgagtaagtttgatccaaaattaattgatgttaaccgtttaattggtaattatattccaaacttaactgctgaaccattctctcttgaaaagaagtttattgaaaa

SEQ ID NO: 14217 - DNA, 339 bp, Piromyces finnis
  Ac_transferase_dom
ttctgttccattccactgtgattacttaaaggatgttaatgatattattatgaaggatgtcgaacgtgatcatttaattcttggtaagggtgaattagccattccaatttattctactgaaaatggtgaagatttaagaggtcacccacaattcacttatgaattaattaagcaaatttgtactttaccagttcattgggaaaaagctacttctgttactaatgctacccatatcttagaatttggtcctgttggtgctggtgttggtttattaactcacagaaataagattggtactggtgttcaagtcattcttgctaatagtttagaaacttctga

SEQ ID NO: 14218 - DNA, 207 bp, Piromyces finnis; identical to SEQ ID NO: 14212
  Ac_transferase_dom

SEQ ID NO: 14219 - DNA, 483 bp, Piromyces finnis; identical to SEQ ID NO: 14213
  Ac_transferase_dom

SEQ ID NO: 14220 - DNA, 141 bp, Piromyces finnis; identical to SEQ ID NO: 14214
  Ac_transferase_dom

SEQ ID NO: 14221 - DNA, 171 bp, Piromyces finnis; identical to SEQ ID NO: 14215
  Ac_transferase_dom

SEQ ID NO: 14222 - DNA, 168 bp, Piromyces finnis; identical to SEQ ID NO: 14216
  Ac_transferase_dom

SEQ ID NO: 14223 - DNA, 339 bp, Piromyces finnis; identical to SEQ ID NO: 14217
  Ac_transferase_dom

SEQ ID NO: 14224 - DNA, 207 bp, Piromyces finnis; identical to SEQ ID NO: 14212
  Ac_transferase_dom

SEQ ID NO: 14225 - DNA, 483 bp, Piromyces finnis; identical to SEQ ID NO: 14213
  Ac_transferase_dom

SEQ ID NO: 14226 - DNA, 141 bp, Piromyces finnis; identical to SEQ ID NO: 14214
  Ac_transferase_dom

SEQ ID NO: 14227 - DNA, 171 bp, Piromyces finnis; identical to SEQ ID NO: 14215
  Ac_transferase_dom

SEQ ID NO: 14228 - DNA, 168 bp, Piromyces finnis; identical to SEQ ID NO: 14216
  Ac_transferase_dom

SEQ ID NO: 14229 - DNA, 339 bp, Piromyces finnis; identical to SEQ ID NO: 14217
  Ac_transferase_dom

SEQ ID NO: 14230 - DNA, 207 bp, Piromyces finnis; identical to SEQ ID NO: 14212
  Ac_transferase_dom

SEQ ID NO: 14231 - DNA, 483 bp, Piromyces finnis; identical to SEQ ID NO: 14213
  Ac_transferase_dom

SEQ ID NO: 14232 - DNA, 141 bp, Piromyces finnis; identical to SEQ ID NO: 14214
  Ac_transferase_dom

SEQ ID NO: 14233 - DNA, 171 bp, Piromyces finnis; identical to SEQ ID NO: 14215
  Ac_transferase_dom

SEQ ID NO: 14234 - DNA, 168 bp, Piromyces finnis; identical to SEQ ID NO: 14216
  Ac_transferase_dom

SEQ ID NO: 14235 - DNA, 339 bp, Piromyces finnis; identical to SEQ ID NO: 14217
  Ac_transferase_dom

SEQ ID NO: 14236 - DNA, 399 bp, Piromyces finnis
  Ac_transferase_dom
tgttaaaccaaaggtagccttcaccttctcaggtcaaggtactcaatatccagaaatgggtcttcaactttacaatatgaacccatatttcgcaagtattattgattactgcaattctatccatacccaaatttctaaaaaagatcttttaaaggagactggcttatttggtaagggtcctgtaaatgaagaaaaacttttagatccacagtattcattcccagctattggaataatagaattagctctagttgaactatggaaacgttatggtgttgaaccagctcttgtctttggtcatagtatgggtgaagttgctgctgcttatgctgctggtattttaactattgaggatgctattcttttactttataactatggacaaataagcgaaaatgt

SEQ ID NO: 14237 - DNA, 357 bp, Piromyces finnis
  Ac_transferase_dom
gaaggctttccatacttcctacattattacagctaaggacaaattccttcaaagtatccaaggtattggtaatagagttaaagcaccaaagattccattcatatcctctacctatggcagagaatatcaaggtccatttgatgaagaatattggtggacaaatatcattagtccagtcaactttagccaagcaaccaagattgctcgttcaaagatcgataaagttttagaaattggttccacaccagttttaggtatctatatgagtaacgatttccatcaggataatatcttctataccctttctcgtaagttaaataataataatagcttaagtagaaatatagcaaatatgta

SEQ ID NO: 14238 - DNA, 357 bp, Piromyces finnis
  Ac_transferase_dom
gcaagctttccattctccatacgttgaaggtgctgaaaaggctttcaaggaaagtattagaggcattggtgaacgtactaaagctccaaattgtaagtttgtttctgcttgttttggtcaagaatatgaaggtccattcgatgaaaattactggtgggctaatattcgtaatccagttagtttccatgctgctgcttctattgctactcaattctctaagcgtgttttagaaattggtgctcatccagttcttggtatgtatcttaaggaaatctatggtaaggataacgtctacttctccttatctcgtaagatggatgacgttgatagtatgtgccgtactactgctaacttatt

SEQ ID NO: 14239 - DNA, 414 bp, Piromyces finnis
  Ac_transferase_dom
aatcagtgaaaaaccaggaattaactttgctttctctggtcaaggttctcaatttataaatatgggtagacgtatgtatcaaaccaatgatctctttaagaaggttgtcgattattgtgctgctgttcttgttactattaatggcggtgaagatatctttgaaaagtatagcatctttaagggagatgttgctcaaattagcgaaaccgatctttctcttccacaattctctgttcttgctattggtattgctcaaattgctttaattgaagtttggaagtctatgggtgttacaccaaaggctgtctatggtcatagtatgggtgaagttgctgctgcttatgctgctggtgttcttactatcgatgatgctgtcttattattatacatgcgtggtcatattcttgctcaatt

SEQ ID NO: 14240 - DNA, 564 bp, Piromyces finnis
  Ac_transferase_dom
tctctaccgtactcaacctgtctatgctaaagccttagaagaatgtgataagattatcactgagttaagtaactttaagattttattggtcaatttggttatttgtatgggcgaattgatacaaccagaattattacaagaatacaaaaagcaagtagatgaagatccatgtatggctcaattcattgctctttccatgaactatgctttaataaaacttttagaacatttatctatttcaccaaatcttgttgtgggttataaatttggtgaaattacagctgctcttgcctgtggtaagatttctttgagaaatgctttccttattattcattacatttgtaaaataattcgtaagaatatccaactttctgatgaaactattacttcagatatcactcaattaatgattataaaggatgaatcgaaggcattttcatctgcaaagaataatgattattcctacagaatggaacatagtcaatccttttattcttccattcatcaacaggtattttcaaagggtcaaaatctcaatggagattattgggttaaatttgtcaa

SEQ ID NO: 14241 - DNA, 790 bp, Neocallimastix californiae
  ACCESSORY GLAND PROTEIN ACP76A-RELATED
aaatatgctctatagtccattttcaataaaatatgctttaaaaatgttacaagaaggagcagctaataatacttttgatgaaatcaataaattaataggaaatactcaactttctaaatacaccaacattgacgaagttttatctttagctaatggattatttataagagatactttttatgactatataaatacaaattatataaatactctaaaggaaaattatgatgcagaagttgttaaagatgaatttaaaaatgcagcaaatgctaataaatggattgaagataaaacatttaatatcattaaaaatatgctcactgatgaaatgattaaaaatccaactagcgtcatgcttatcatcaatgcccttgccatagatatggaatggaaagaaggattttcatttcagtatactgatggagattatttttatttagataatggtgaaaaaatgaaggcaacaacgatgtatagaaaagaatttggtacaattttaagttattatattgatgattccgtcactgtagtgacattagatttaaaaaaatatggtaatatacaatttgaatttatggccatcatgccaaagggaaatttaagtagttttatcgaaaatttcactgaagaacaaatggatcatatcaataaaaatcttaattttgccaataatgtagaagatggagtagtgttatacataccgaaattcaaatttaattatgacttaaaattaaaacaagatttaattaatttaggtataaaagatgcctttaattatagtaaatccgac

SEQ ID NO: 14242 - DNA, 1056 bp, Neocallimastix californiae
  ACCESSORY GLAND PROTEIN ACP76A-RELATED
aaatatgctctatagtccattatcaataaaatatgctttaaaaatgttacaagaaggagcagctaataatacctttgatgaaatcaataaattaataggaaatactcaactttctaaatacactagtattgacaaagttttatctttagctaatggattatttataagagatactttttatgactatataaatacaaattatataaatactctaaaggaaaattatgatgcagaagttgttaaagatgaatttaaaagtgcagcaaatgctaataaatggattgaagataaaacatttaatatcattaaaaatatgctcgatgatgatatagtacaaaatccatctagcgtcatgcttatcatcaatgcccttgccatagatatgggatggtataggagtttttcatttgagaatactaatggatatgatttttatttggataatggtgagaaaatgaagaccaccatgatgtctaaaacagaaaagagcacaaatttaagttattatattgatgataacgtctccgtagtaacttcagacttaaaaaaatacgatgatatacaatttgaatttatggccattatgccaaaggaaaatttaagtagttttattgaaaatttcactgaagaacaaatggatcatatcaatcaaaatcttaatttttccactactatagaagatggagtagtattccgcataccaaaattcaaatttgattatgatttagaattaaaacaagatttgatgaagttaggtataaaagatgcctttaattatagtaaatccgacttttcaaaaatggaaggttccaccgatcccgacaaaaaactctatgtttctgaggctcttcataaagctgatattgaatttactgaagagggaataaaagctgcagccgttactgtatttggtatgaaggctacatcagctcataatccaataatccctaaacctctttatatcacctttgataaaccatttatgtttattataagggataaaaagacacaggatatttggtttaccggaaccgtctatgaacccaataaatggga

SEQ ID NO: 14243 - DNA, 1077 bp, Anaeromyces robustus
  ACCESSORY GLAND PROTEIN ACP76A-RELATED
aaataaaaagaaaaatatgttgtatagtccattatctattgaatacgccttaaaaatgttacaagaaggtgccaatggtaatacttactctgaaataaataaaatcgtaggtaatgaagaacttcctaaatacataagtcttgataaaaatttatcattagctaatggattatttataagaaacacctatagtgaatatgtcaaaccatcctatgtcagtacattaagagataaattttatgctgaagtagtagaagatgaatttaatgatgcttcaaatgttaatgaatggattgaagataaaactttaggtatcattaaagatatgcttagggatgatatagttcaaaatccaagaacttcattaattttagttaatgctcttgctatggacatgaaatgggcttatcctttcagagatgaaagtacccatggaagaacattttataaggaaaatggtcaagaaatagaagcaactacattatctactacaatatccgctaatggtgtatcctattataaagatgatgacttaactgttcttaccatggatttaaaaaaatattctgaattccaatttgaatttgtggctatcatgccaaaaaatgaaaatttaagtagttttgttgaaaaggtcacaagagaacaaattgatgaaatcgatgaaaaacttatatcatcctatgacgaacgcgatggtatttatatcagaataccaaaattcaaatttcaatatgatttagaattaaaaaaagatttaataaatttaggtgtaaatgatgctttcagtcccattaaagctgatttaaaaaagatagccgatccagaagatccagataaaaaattatatgttggtgatgcccttcataaagcagatattgaattttcagaagaaggtataaaagcagctgctgtaaccgtaattattatcatggcagctggtgcagccccaggacccagaagagaaccacaacctgtcaatgtcatcattgataaaccatttatgtttatgataagagataaaaatactaaaaatatttggtttacaggaacagtttatgaaccaaatttatggga

SEQ ID NO: 14244 - DNA, 1068 bp, Anaeromyces robustus
  ACCESSORY GLAND PROTEIN ACP76A-RELATED
aaatcataaagaaaatatgttatatagtccattatccatagaatatgctttaaatatgttacaagaaggtgccgatggaaatacttatgatgaaataaataaaattataggaaatgacgaacttcctaaatacaccaatattgaaaataatttatccttagctaatggtgtatttataaaggatacattctatgaaaatgttaaaactgattatatcaatacattaaaagaaaaatttgattccgaagttatccaagatccatttgaaagtgctgaaaatgttaatcattggattgaagataaaactttaggtattattaaaaatgttgttaatgatgatgccgttagaagtccagctatggctatgcttttaattaatgctcttgctatggatatggattggaaaatcttatttgatagttatgatactaatgaagaaaacttttatatggaaaatggtcaaagaattcaagtatctatgatgaataaaaaagaaattaaaagtgatgtcgtttcctattataaaagtaataaagtcaaagctgttactatggaatttgaagaatataatggaacagaattagaatttttagcccttatgcctaatgaagatttaagtagttttgttgaaaatattacattagaacaaattcaaaaattagatcaaaaacttattccttcctctgaaacttctaatggagttaatttaaaaataccaaaattcaaatttagttatgatttagctttaaaaaagaatttaatggatttaggaatcaatgatgcttttgatgaattaaaagctaactttacaaaaatctctgatccttattcttctggaatgaatttatttgtttccgatgctcttcataaagcagatattgaatttaccgaaaagggagtaaaagcagccgcagtaactgtagctttaacttatgctacttcatttagaccaaaaaagggtgatcctattgaaatagttatagataaaccatttatgtttattataagagataaaaataccaaagatatatggtttacaggaactgtctatgaaccagaattatgggg

SEQ ID NO: 14245 - DNA, 1116 bp, Anaeromyces robustus
  ACCESSORY GLAND PROTEIN ACP76A-RELATED
agtagaatataactctgattttgatttttcatttttaaaattagaaaacaataaagaaaatatgctttatagtccattatctataaaatatgctttaaaaatgttattagaaggagcagatggtaatacttataatgaaataagtaaattagtaggaaattcagaacttactaaatgttcaaacattgataaagtattatcattagccaatggtttattcataagagatacgttttatacatgtataaacccagaatatataaaaacattagaagaaaaatataattcagaagtagtaaaagatgaatttaaaaatgctgataatgttaatgaatggattgaaaataaaactttaggtattattaaaaaaatgttagatgataaaaaggttcaagatccatcaagtgtaatgcttttaatcaatgcacttgccatagaaatggattggtattctgcatttaaaattgaaagtacttatggaaatacattttatattgatgatgataaaaaagtggaagcaactatgatgtctcaaaaagtttatagtaataatttatcatattatttaagtgatgagttaacggctgttactatggatttaaaggaatatggtggaactcaatttgaatttatggcaataatgccaaccaaagataatttaagtacttttattgaaaatgtcaccaagaaacaaattaatgaaatagatgaaaaacttatattagcctccgaagctgaatatggagttattatcaaaataccaaaattcaaatttagttatgatttaaaattaaaagatgatttaaaaagtttaggaataaaagatgcttttgatatgagtagagccaacttttcaaaaatggaaaatccatcagaattaacacaaaacctttatgtttctgatgcacttcataaagcagatattgaatttaccgaaaagggaataaaagcagctgcagttactgttatcataattacttatggaagtgcaggaccatccaaaccaacaacaccagtatatgttaccattgatagaccatttatgtttattataagagataagaataccaaagatatatggtttaccggaaccgtatataaaccaaatttatgggc

SEQ ID NO: 14246 - DNA, 1074 bp, Neocallimastix californiae
  Acetyl-CoA synthetase-like
agaattccgtaatgaaattcttgaagctaaaaataaaggtttatcctttgaacgtcaagggttagctacggatattatttatattattggtacttcctctacttcacaagccattattaaaaatggtcactgcactgaaatgaaatttgttcctataactacgacaagtggtggtgaatgttataataattatatttatcgtggaatgaaaaataagccaactttcatgattaatattcctgttagtcatttattgggtttttatggttgtgttttccatactattcaatatggtggtccagtggcttatcatactcaaaatttaagagatattggtttcattccagaaattatcttagatgatatgatagaggttaaaatggaccgtactattttatttccatttcattttaacgaatttaaaaaattatttgatgatcatcatcctcattgtgaaaaatggaagaaatttatttcttcaagaaatccatactgttttagaaatggtggagctcctctcagtaattcaatagatgattggttcaatgatacttttggtattagaacttgtcaagattatggttcctctgaaactggtgcaatcttaacttcagatttcaattctaaaccattaccaggagaagaaacctatctttctaaattcccacattgtgaactttatttaaaacctcttgatgacaatgatcctagtgttggtgagttattcgttcattctcctactcttaccactggttatatttccaaagcaaagcctggtgaattttatgaatcggatatgcctggtatgcgtacggatattgatgcagataaacttttcgtttactttgaaggtaaaaagttccttaagactaacgatattgtgattcgtagtccaaaatctggtaaatataagtatgtttctcgttcggatgatgttcttgtctttgaaaccggtcttaagatgaatcctattccgttcgaacgtacggtttcttcggaatgtgaggatatttctcgttgctgtttaatcattgatgacaccaagaccgaagtcgtttgtttcgttgaacctct

SEQ ID NO: 14247 - DNA, 288 bp, Neocallimastix californiae
  Acetyl-CoA synthetase-like
atcaccatggttaacagttacttacaatgaatttggatcacttataaaagcttgtgcctatgttttaaaaaagaaatatgatctttatccaaacagtagaattggtattattggtacttataccccaatgaatcaattattaatctatgcgttatggtatttacgttgtgctgtggttcaaattccaattaaattaggaaatgatgttaaacaattttggtgtagattattaaacttaaaaatgattttctatgatgttaattttattccttttgataataaagaaga

SEQ ID NO: 14248 - DNA, 1623 bp, Neocallimastix californiae
  Acetyl-CoA synthetase-like
tatttatgaaacaactaatatagtagatagaatgaatcttcgttttaaaagtgatgaagatgatatcgctatagtcgcaaaggagaatttattaatgaaaccatttcatggtataccaaatccatcatatccgtcaccatggttaacagtaagctatcgtgaatttggggctcttgtaaaggcttgtgcttatgttttaaagaaaaaatatgatctctatccaaatagtagagttggtattatcgcaaattttaccccacttaatcatttattagtttatgctctatggtataatcgttgcgcagtagtccaaattcccgttaaattaggaaatgatgttaaacaattttggacaagaatcttaaatttaaaaatgatattttatgatgttaattttaaacctttcgatgatgaagaaaatataaaaatgatggaagaaaatgatgaatggatttggaaatggcaacatcctttaaccgaaaatgaaatgaacttagattctggaaaagatggaattttatctgttaatctttatggagaaagtttcagaaatgaaattttaaaagcaaaaaatcaaggaaaatcatttgaacgtaaatgttatgaaactgatattatatatattattggtacctcttcttctactcaagctattattaaaaatggtcaatgctcaaaaatgaagtttgttccaatgactactatgcaatcaggtgaatgctataattattgtgttcaacaaggtttaaaatataaaccaacctttatgattaatgctccagcaagtcatgatttaggatataaaaagtgtgtccttcataatattcaaatgggtggcgctgttgtttatcatactcagcagttaagagatattggtttcattccagaaatcattttagatgatatggttgaaactaatgtagatcatactcttctatttccatttcatatagctgaaattaaaaagttatttgatagtcatcatcctcattgtgaaaaatggaaaaaatttctttgctcaagaagtaaatactttttaaatactggtggtgctcctatgagtgataaaattgataattggttctttgaaacatttggttttcgaactactcaaatatatggttcatctgaatcaggtccagttatgatctcagatttctcagttccagctcttccaggagaagaaacataccttaccaaatatcctcatattgatatttattttaaacccattgataataacgatccaaacattggtgaattgtatgttcatagtccaaccttgactactggttacattagaaaagctgaaaaggatgaattttatgaatctaatgtgcctggtatgcgcactgatatcgaagctgatgatcttttcatttatattaacggtgaaaagttttataaaacaaatgatatttggaatcgtagtccaaaatcaggaaaatataaatatatttcaagattagatgatattatcgttttctctactggtctcaaaatgaatccattaccatttgaaaatactgtttccttagaatgtaatgatattacttgttgttgcttaatgttagatgatactaaaaccgaagtggtttgctttgttgaaccccaatgggaaaa

SEQ ID NO: 14249 - DNA, 1605 bp, Neocallimastix californiae
  Acetyl-CoA synthetase-like
tatttatgaaagattagaatatcgttataatctttgtaaggatagtgatgaaccagccttggtttctaaaccaaatctttggagtttaccatttaaaccggaacctcatcctgattatccttccccatggacttgtgtttcctataaacaattttttagattagtgaaagcttgtgcttatgtccttaaaaaaagatttgatttaccacctcaatctagagtaggtgtggtcgccaatactttacccttaaatattttaattatttatgctctctggtatattcgttgtacacctgtagctgttcctcctaaactcggtaatgatgttaaacaattttgggctagaatgctcgatattagtatgtttatttatgatattaatgttaatatttttgatgaagaaaaacaaaatcaattaaatgaaagtggtgaatggatatgggaatgggaatatcctttacgtgaagacgaatataatttaagtgctggcttcaaaggaattcctatgttttgtatgaataattcagaatttcttgaagaaatttatcaatgtagtcttgaaggtaaaacgtatgcacgtcccggtttaaaagatgatgtggtcatggttattggtacttcttcttccactcaagctatcattaaaaatggacactgctccaaaatgaagtttattcctgttcgattaattcaatgtggtagtctttttcaaaacatattattgactcgaaagataagccttaaatacagtgttcttgccagcattccctcctatcatatgatgggtttcacctggattggcgttcatcatatgaatactggaggcgccttaattttccatactcaaaaattacatgatattggatttgtaccagaagtattattagatgatatagtggagactaaacctggagtcattcctctcttcccatttaattatgcagaaattaaaagactttttgatgaacatcatccaagatgtgaggtttgggagaaagccatccaggcctgtcccaagaattgttttagaacaggtggtgcccccatcggctatgatttgcttcattggtttaatcaaacatttaagattttaattaataatgaatacggttcctcggaaactggtattatgatgtataaacaatttgataaagatctcgtcccaggagaagaaggttacctcactagagtcccatggcaatatttccattttaaacttattgatgaaaataatccaaatgaaggtgagctctttatctacaatccattcgcaatcaccggttatattggaagggcaaagaaaggtgaattctatgaatcagctgtaccaggaatgcgttgtgattatgaacacgataatctttatgaaacaattgatggaattgaatactatcgaaccaatgatatttggactcgtagtaccatttctggtgattacaaatatgtttccagagtagatgatattttaacctttgcaaccggtcataaaatgaacccacttccatttgaaaataccatgtctagtgaatgtaaaaatatcaaacactgttgtctattagtggataatactcaatatgaagtggtttgcttcgttgaaccagaatg

SEQ ID NO: 14250 - DNA, 162 bp, Neocallimastix californiae
  Acetyl-CoA synthetase-like
attacaagataatgccaaaagtttaaataattggacaaaacaacttaccattcataatgtttatattattgattatggtaagcagttcccagtaacggctaaaggttcagttgctagaagagttgctaaattagaatattcagaagttttaaatcaaatgtc

SEQ ID NO: 14251 - DNA, 1473 bp, Neocallimastix californiae
  Acetyl-CoA synthetase-like
tccatggctttctgtctcattttctgaatttgaagctttagcaaaagctatggcttatgttattaataagcgttatcatttagaaccacaaagtcgtgttgctattattgctaattctcttccaaaaaaccaacttttaactattgctctttggtatttacgtgtaattactgttgaaattactccaaagattggtaatgatgttaagcaatgttggatgagaatgttagatatgtctatgggtttctatgattgtgttttcaaaccattctatcaagatcaccaggaggaagaagaatggacttggccatggatttacccaattactccagatgaaaatttagtttctggaaaggaaggtattcgcatggttaatatggacggagaagcttttatgcaagaagttttagatgctaaggagcaaggtttattctatgagcgtgttggtgataatgatgatctcattaccattggtggtacctcctcttctgctcaagctatcattaaaaatggtcaatcttcagaaatgaaatttgtcggtcttcaccatcgtaaagctggtcatacctttaatagttatttatataaaaaccttccattggaaactaacttcttattagtttctccattccatcatttattgggtatttgccaaggtttattacatcctatctataatggtggtccattagtatatcgtactcaaagtttagatgatattggtgtcattgcagaaatgcttttagatgatattatggaaaaaggtgtcaatgagacacttatcttctctttccaatatgctgagtggaagaaattaaaggaatcaggacatccaaaatggcctatttgggaaaaggcaattcgttctaaacctattggttgtttccagactggtggtgctccacctattccagaagttaccaagtggttggctcgtgagcttcaactattcccagccgaacaatacggttcttctgaatctggtgtaatgatgtattgtactggtgaaccaccacttcgtggtgaagagggctatcttaagagaattccatgggttgatgtttaccttaatcctttaagtgaagatgatccaaatgttggtgaagccttcatctattctgaacagaatttcactggttatattagaagagtagaaaagggggaaactgctaaaaactctcctgctccgggtcttcatgtagatattaaggccgatgaagtctttgtcgaaattgatggtaagaaattctataaaactaatgatattttcagacgtagtcctatcaccggtaattataaatatgtttctcgtatggatgatgtcattaccttctccactggtttaaagatgaaccctgttccattcgaaagaacgatggttcaattctgtaaaaatgttaaactctgctgtcttcttttagatactactggtactgaagccgtttgctttgtagagccagaatgggaagccat

SEQ ID NO: 14252 - DNA, 1227 bp, Neocallimastix californiae
  Acetyl-CoA synthetase-like
atttaagcctgaaattagttcacgttatccagaaaactggaaaactattccattttatcaattatttgatcttgtaaaagctacagcttacgttcttaaaaaaagatatgattttgcaccaggaacaagagttggtattattgctaatacattaccatttacacaattaatgatttatgcattatggaatttacgttgtgttgttgttacttttccaccaagacttggtaatgatgttaaacaatactgggttaagcattgtgatattaaaatgatattttatgatgtcaattttagactttatgatgattatgagaaaaatgaaaaattaaataaacaaggtcaatggatttggaaatggattcatccattaactgaagaagatgaaggtttatgtgctggtaaagaaggtgtcaaaatgtgtttcatttatagtgatgaattatgtaaagaaatttatcaagcaaaagctgaaggaaaagcatatcaaagaaagggtgaccctgatgatgttcttcttgtaatgggtacttcctcttcatcacaagctattattaagaatggtcaatgtactaaaatgaaattcgttccatggcaatttaaacaatgtgttgataaatataaacaattccttactccacaaaatagactttatactgatttattcgtaaatattccattccatcaatcctttggtgcaatttgtgcacttagttactgtgttactggagctagtggtttaatctttaaaacacaacaattaagtgatattggttttgttcctgaaatgattttagatgatatggctgaaactaaagctcaaagtgtttgtcacttcccattccaatatgctgaatataaaaagttatttgacgaaaaccatccaagaaagaagatttgggctgattattttagagaagatcatgaacataaagtttttaagactggtggtgctccattaaatccagttgttgctaaatggtataaagatacatttgatattttaattatgaatggtttaggttccactgaaggtggtcacgttttacatgatattatggagggtgaaatattaccaggtgaagaaggatattatatgagagttccatgggttgatttctactttaaaccattaaatgatgatgatccaacgattggtgaactttatacccattcttctgctaatgttacaggttactttggaagagctaagccaggagaatttta

SEQ ID NO: 14253 - DNA, 213 bp, Neocallimastix californiae
  Acetyl-CoA synthetase-like
taaaactaatgatgttcttaaacgttcaccaaaatctggttattataaatatgttactagaattgatagtattattacctttgccactggtttaaagatgaatccattaccttttgaaaacactattaactttgaatgtactaatattaagcattgttgtcttattttagattccactcaaactgaagttgtttgtttcgttgaaccaaactg

SEQ ID NO: 14254 - DNA, 1887 bp, Neocallimastix californiae
  Acetyl-CoA synthetase-like
tacagtcacatcatttttgaataaaagatgttactattatggtaatgatcctatgattgtagcaaagccaaatttattttcattaccatttaaaccaaaaccaaataaaaattttccaaaaccatatttatcggtaacttatagtgaattttctaatttagcaaaatcttatgcttacgtcttaaaacataaatataatattccttcacattcaagaattggaattattggagaagccagtccaattcatcatttattgttaacatatacagtatggtatttaagaggaactatagttgatatttcaacaggtgtaggtgaagaagtagttcaagcatggatgaccaccacagatgttatacttacactttatgattcaggtcttccaccttttccatcgatacaatctataaatataaatgaagaattggaatggacatggacatggacatccaaaattggaaatgaagatgaaattaataaaacaaagtcaatgacaatggtcaatatagaaaatgatatattaaatactgaagtattgtcagcgtataaatcaggaaatttctttgaagaagaactttctccagacgattatgtttcaattataggaacttcttcatcaacacaagctgttgttaaagatggtgtttatacaaaaatgaaatttgttgctgcaaaaagtccagtactacttaatacagaatatttcagaaaaatagctacatataaaaataaaccaacagcactattcaatttagggtacggatcggctattggacaacgtcattcctttatgtatgctatcatgtgtggaggtccaatagttttcggaacgaaaaataaagaaaatataggattaattccagaagtggttttagatgatattgatacaattaaaccagatatatgttttatttttccatacatgttttcaatttggaaaaattttgcagatgataatcatccaaactggccaagatggaaaagcgctttagaatcaaggccaaaatggtgtttctcaacaggaggggcaccagtagatccagaaattttacattggcttcgtaaagatttaaatatacaacttaataatatatatggtacttctgaagctggattagtatttactcgtaatgaatatacagtagatgttgaaggagaagaaggctatgtatccgaattaccaggagtagaatattatctcgatccaatagatggtaacgagaatgaaggtgagctgtacgttcattctccattagttttttcaggatatgttgataaggccaaagaaggtgatccaaattcatgttatggcatcgttgttaataaatggcgggaagaaaatttcagaacatttaatggaaaagaatattataaaacgaatgatatatggaggagatgtcctaaaacaggtaattattgttatgtttcaagagtggacgatactcttgtttttaaaactggaataaaaatgaatccaattccgtttgaatccacgatgacattaaaatgtaactccattaaaaattgttgtctcctacttgaaaaaaagcaccaaactgatgtattttttttcgttgagccaatatgggataaaattgatggtattgatcttacgaatgaagaaatgatgaaaacaacagcttccagtatagcaaaggatcaaatatggaatgaaattagcgctgtgttgaagaaagaaatgagtagtatggctaattgggtgaagcaaatctcaaaaaatagtctgtatattgtggagtatggtcaaaagattccaattactttgaaaggaaatgtatcaagaagaaattgtaagatagcatttaataagattctagatgaacttagctctgattccaacattgctaatgaagaaagttataa

SEQ ID NO: 14255 - DNA, 1518 bp, Neocallimastix californiae
  Acetyl-CoA synthetase-like
aaatccttatttatctgtaacctacagtgaatttgcgaatttagcaaaatcttatgcgtatgttataaaacaaaaatataatgttccttctcattcaagaattggtattattggagaagccaatcctattcatcatttattattaacatatgcggtatggtatttaagaggaactatagtagatatttcaaccggtgtcggtgaagaagtagttcaggcatggatgaccaccacagatgttacacttacattttatgattcaggtcttccttcttttccatctttacaatctataaatccaatggacaaatcagactgggtgtggtcatggtcatcaaaaatcggaaatgaaaatgataaaaacgaaataaaaacaatgacaatggttaatttagaaagtgatatattaaatgctgaagtactatcagcatataaatctgaaaacttttttgaagaagcactttcaccagatgattatgtttcaattattggaacatcatcttcaacgcaagctattgttaaagatggggtttatacaacaatgaaatttgttgctgctaaaagtcctgtaatacttaatcttgaatatttcagaaagatagctacctataaaaataaaccaagagtactatttaatttaggttttggttcagctattggacaacgtcattcctttatgtatgctatcatgtgtggtggtcctataatttttggtacaaaaaataaaaaaaatattggattaattccagaggtagttttagatgatattgatactgttaagcctgatatttgctttatttttccatatatgttttcaatatggaaatcttttaaagataataaacatcctgactggccaagatggagaaatgctttaagatcaagaccaaaatggtgcttttcaacgggtggtgcaccagtagatccagaaattttgcgatggcttcgtaaagatttatatatacaacttaataacatttatggaacttctgaagctggattagtatttactcgtaatgaatatactgtggatgttgaaggagaagaatcttatgtttcagcattaccgggagtagaatactatctcgaccctgtaaatgaaaatgaaaatgaaggagaactatatgttcattctccattagttttttcaggatatgttgataaggctaaagaaggggatccaaattcttattatggtattgttgttaataaatggcacgatgaaaatttcaaaacaattaacggtaaagaatattataaaactaacgatttatggaaaagatgccccaaaacaggtaattattgttatatttcaagagtagatgatactcttgtttttaaaacaggaattaaaatgaatccaattccttttgaatctacaatgacattaaaatgcaattcaataaaaaattgttgccttttacttgaaacaaagaatcaaacagaagtatttctttttgttgaacctgtatgggataaaattaatggtttggacctttcaaatgaagaaataatgaa

SEQ ID NO: 14256 - DNA, 870 bp, Anaeromyces robustus
  Acetyl-CoA synthetase-like
tcatcctaaagttatggttgttgccccactttatcattctttgggttcagcatggtcaattgctcaaattatgaatactggtagtcctttaattttccgtacccaaaaaaaatatgatattggatttgtagctgaaaatatattagatgatattatagaaactagacctgatgttattccacttttcccaattaattttgttgaatttaaaagactttttgatgaaaaccatccaaaatgtgaaatatgggcaaagggtattagttctttatcaagaagatgtttcctttctgctggtgctccaccaaattatgaagttatgtgttggtttgaaaataaatttaaaatacctgttaataatgtatgtggtgccactgaagctggtcttttcttgtataaagatattgataaacctcaagttccaggagaaaccaattatgttagtcgttgtccatggattcatttccatatggaacatatgtcagatgatcctaatgaaggtgaattatatatttataatcctttcggtatatacggttatgctactaaagctaaaaagggtgaattctatgaatccactttgccaaaaatacgtattgatttagaacatgatgacttatataaaacaattaatggacttgaatattacaaaactaatgatatttggagacgtagtactgtatcaggtgattatgtttatgttgctagagctgatgatgtcattaattttagtaatggattaaaaatgaatccattaccatttgaatctacagttacttatgaatgtaatgatattaaacaatgttgtttacttttagatgatactcaatgtgaagttgtatgttttgttgaaccagaatggtctaaaat

SEQ ID NO: 14257 - DNA, 1692 bp, Anaeromyces robustus
  Acetyl-CoA synthetase-like
tatgattgatagaataaatattcgtttttcatcaagaaaagataatgttgctattgtagctaaagaaaatattttacttttcccatttaaaggtgtaccaagtccagaatacccagatccttggttaactgtatctttcaaagaatttcattctcttattaaagcattagcttatgttttaaaaaaaagatatgattttagagttggtgatagagttggtattactgctaatactttacctatgactcaactttatctttatgctttattctttttacgttgtgttgttgtattaattccaccaaaacttggtaatgatgttaaacaatattgggtaagacataatgatattcgtatgatattttatgattttagtttaagaatatctgataatgatgaagaaaatcaaaagttaaatgaccaaggtgaatggacttggccatggacttatcctttaactgaagaagatgctggtttaagtgctggtgaagaaggaattccaatgtgtttcatgtataataaagatttatgtaatgaaatttatcaaactaaattagatggtaaagaatactatagaaaaggagaccgtaatgatgttttaatgattctcggtacttcttctacttctcaagctattattaaaaatggtcaatgttcaaaaatgaaatttgttacataccaagtaactcgtgttggtacaatttatcaaaaagtacttatgccaaatgtcaaacattatactaatttctatcttaattgtccattccatcatggtatgggtgctaataatgccgtaggttttagtatagttaatggtggtcctcttgtatatcatactcaaaaattatatgatgttggttttattccagaaattatgttagatgatatgactgaagtaaatgctgtaaatacacttcaattcccattccattatgaaggatataaaaagttatttgatgaaaatcatccaaaatgtccaatttgggctaaatatttaagtaaacatgataaacatagaatattcaaatttggtggagctttattaaacccagttgttaaggaatggtataaagaaaaattcggtatccacattgttaatgattttggttcttctgaaggtggtaatactcttgttgaagatattgaaaatgtattaccaggtgaagaaggttacttcaaaagaattccatgggtagatttttgtttaaaaccattaaatgaaaatgaaccaaatatcggtgaactttatactcattcaaacattatgactcttggttatgttggcagagctaaaccaggtgaattttatgattcaccaattcctggtatgacttgtgatatagatgctgatactcttttcacttatattgatggtgttaaatattataaaactaatgatgttttcatgcgttctcctgtttctggaaaatacaaatttgttacaagaatggatggtatacttgctttttcaactggtttaaaaatgaatcctattccatttgaagaaactattactgatgaatgtgatgatgttgtacgttgttgtcttcttcttaatgatacattaactgaagttatttgtttcgtagaaccaaattggaatgaaattattatagatggtaaaaagtttgatacttctattgaagcttctacacttgataaagatactattaaatccatgaaaaaacaagc

SEQ ID NO: 14258 - DNA, 213 bp, Anaeromyces robustus
  Acetyl-CoA synthetase-like
caaaacaaatgatgttgtaagacgttcaccactttctggtaaatataaatatgtttcaagaattgatagtattcttacatttgctactggtattaaaatgaatccaatgccatttgaagaaactatcatgagtgaatgtcaaaatataaaaaaatgttgtcttattttagatagtactcaaactgaagtagtttgtttcattgaaccaaattg

SEQ ID NO: 14259 - DNA, 1326 bp, Anaeromyces robustus
  Acetyl-CoA synthetase-like
aaaagaaaataatatcattgatagaataaaccgtcgttttactcttagaggtgataatattgctattgtcgctaaagataatattttaccaataccttttaaaagtgttcctcatccagattatccagaaccatgggttactgtatcatttaaagaatttcatgctcttattaaagcaatggcctacgttataaaaagaagatttgattttgctccaggtactagagttggtgttattgctaattctttaccaataactcatttattagtttatactttatggactcttcgttgtattgttgtatttataccaccaaaaattggtaatgatgttaaacaatattgggtaagacatattgatataaaaatgattttttatgatattaattttagaccatttgatgatgataatataaataaagaattaaatgaacaatgtcaatggatatggaaatggacttatcctttaactgaagaagatgaagggattagtgctggtaaagaaggaattaatatgttttacttttatgatgaagattttcgtaatgaaatatataatattaaattagaaggaaaaggttattatagaaaaggttgttcagaagatgttcttacagttgtaggtacttcatcttcttctcaagctattattaaaaatggacaatgttcaaaaatgaaatttgttccatggcaaatggttcatcttggtaatttctcacaaaaatctcttacaatacaatatgaatatttttcacctttcttccttgatattccatatcatcattctatgggtattacatgtgctctttcttataatattaattgtggtggaccaattgtttatcatactcaacaattatatgaagttggttttattccagaaatggtattgactgatattgttgaaacaaaatctaaagttattcaacttttcccattccatttcgttgcatttaaaaaattatttgatgataaacatccaaaatgtgaatattggtcaaaatatttaggtaatggggataaaagtaaattatttagaagtggaggtgctccattaaatcctatggttaaaaaatggttcaaagatacttttgatattcaaattattacaggttgtggttcatctgaaggtggttatattttacatgaaattgttgatgatgaagtattaccaggtgaagaatcttatatttggagaagagtaccatgggtcgatttcttaattcttccattaaatgaaaatgaaccaaatattggtgaactttatacacgtaatgaagctaatgttcctggttatattggtagaccaaaaccaggagaatttta

SEQ ID NO: 14260 - DNA, 1713 bp, Anaeromyces robustus
  Acetyl-CoA synthetase-like
atataataataatattcataatattgaatatattccaaaaattgaaaaagaaagaataattgaaacattcaataataatgaatacaattatgatagaaataaattctatcatgaagaatttagtaaagtagctaaagaaatacctaacaaatgtgctattgtatgtaacaataatgaaattacatttaagaaattagacgaaatgagtaattctttagcacattatttaagaaaagaaaatattggtagaggagatattgttccaatcattagtgaacgttctcattactttgtaattgctacattagctataatgaaatctggtgcagcatttttaccaatagatccagacttcccaaaagaacgtattgaatatatgattaatgaagttaacgctaaatttattctaaaatatattacaaatattgaaacagaacgtaaaattaaatttgacaatgttattgaatatgaattacaaaaacataattataaagataatgttttcgaaattactaatattaataacagtgatgatttatgttatgtattatttacttctggtactacaggtaaaccaaaaggaactatgatgacacataacaatttaattaattattctctttacagtcaaacatataatggaaaagaaatatatacaaatgattttaataatgctttatctgcagctaaatttacttttgatatgtcactttgtgaaatattatatcctttaattaaaggaaaatgtgtattcatatgtgacgataatgaatataataatcctcaattaataggagaaaaaatattaaaatataatatagattatatatttagtacaccttcaagaattgaaaactatatgaaaaataaaacatacatgaaagctttaaagaatttaaagtgcattttaattggtggagagggttgtaatattaaaacagttgaaaatataattaaaaatacaaatgcaaatatatataatctttatggtccaactgaaacaaccattatgtgtactgtatcagaactctcaaatttgtataaacaaaacaaattaaatgttattactattggtaagccattatgtaattgtaaattgtacatcttagatgaatatttaaaaccagttccgattggagttgaaggtgaaatatatattggaggatatggtgttggtaaaggatatcttaatcgtgaacaattaactagagaaaaattcgttgattgtccatttaatatcaaaaatggtttaccaaatcaaatgtatagtactggtgatttaggaaaatggacagaaaaaggtgaaataatttgttctggacgtgctgatttccaagtaaaaattcgtggtcaaagaatagaattaacagaaatagaaaatactattaaaaaaattaaaggaattaaatattcaattgtaattgataagataaaggaaaacaatgataagtatttaatgtgttattatattacagatgaaaacattaatagtggagatataagaaattatttaaaaaataaacttccaatatatatgattcctagttacttcaaaaaaattgataatataccagttacttctaatggtaaactaaatagaaaagctttacctgaaccaaatatagatgatttaataaaagaaaattacattgcaccaatatccaaagttgaaaagattatttgcaaaatttattcgaatgtatttaatattaa

SEQ ID NO: 14261 - DNA, 1209 bp, Anaeromyces robustus
  Acetyl-CoA synthetase-like
taataacagtgatgatttatgttatgtatttttcacttctggtactacaggtaagccaaaaggaactatgatgactcataataatatgacaaacttttgtttatatagtcaacattttaatggcaatgaaaatatttatgattacggatttgaaaatgctttagcattctcaaaatttacttttgatatgtcattaattgaaatttattatcctttatataaaagatgtagagtagtactttgtaatgatgaagaatttaataattcagaaatgcttagtgatttaattattaaatataatgtaaattatatttgtagcgtgcaatctcgaataaagaactatatcaaggatgaaggatttaaaaaggcattaaaaaatgttaaatggattggtttagggggagaaaaattaaattctgacattattcaagatattaagaactgtagtaaagcgacattaataaattattatggaccaactgaaactacagtatgttgtacacttaaaaagtttgagaataatgaattaaataattttgaaaataataatacttccataaccatcggtaaaccactatgtaattgtaagatatatatattagacaaatatttaaaaccagttccgattggagttgaaggtgaaattttcattggaggaaactgtgttggtaaaggttatttgaaccgtgaagatttaaccaaggaaaaatttgttaattgtccatactacaactctattaatggatcatcaaataaaatgtatcgcacaggagatttaggtaaatggacaaaagaaggtgaaattatttgtttaggaagagctgatttccaagtaaaaattaatggacaaagaattgaattaagtgaaatagaaaatacaatgaaagaaataaatggaattgattatgctatagttattgataataataaagaaaatggtaataaatacttaaccggttattatattagtaaaaataacattacaggtaaagatattagaaagagtttaaaattaaaacttccaagtttcatgattccaaattatttcattcgtatatataatttaccaattacatctagtggaaaattagataaaaaaagtttaccaattccaaatattaatgatttaattaatgaacaatatgttgctccagaaactgaaactgaaaaattaatatgtaatgtatatagtaaaacattaaatattga

SEQ ID NO: 14262 - DNA, 126 bp, Anaeromyces robustus
  Acetyl-CoA synthetase-like
tagtaaaaatgcaaaatcaaatcctgataagtgtgctattatattcgaaaatcgtgaatttacttataaggaattagatgaaatgagtaattctttagcttgttatttaagaaattatggtgtttc

SEQ ID NO: 14263 - DNA, 576 bp, Piromyces finnis
  Acetyl-CoA synthetase-like
taaaactggtggtgcaccaatgagcgatgaaattgataattggttattcgaaacttttggtattagatccttccaagattatggttcttctgaagctggttcaattatgaattcggatttctctaaaccagcccttccaggagaagaaacttatctttcgaagagaccatgggctgatatctatttaaaaccaattgatgatgatccaaatattggtgaattgcatgttcgtagtccaacaaatactactggttatattagaaaggcagaaataggtgaattttatgaatcgagtatgccaagtatgcgtactgatattggagcagaatccttatttacatatattaatggtgaaaagtttttaaaaataaatgatatatggagacgtagtccaaaatctggaaaatataagtatatttctagaattgatgacgttattgtattttctactggtcttaaaatgaatcctataccatttgaaagtactgttactaaagaatgtaataatattaaatattgttgcttaatattggatagcagtaagtctgaagttgtttgttttgttgaaccagaatg

SEQ ID NO: 14264 - DNA, 159 bp, Piromyces finnis
  Acetyl-CoA synthetase-like
ttattctgttcttatggatgactccaaaagtttaacttcatgggctaaacaattaactattaataatatatttgtaattgagtatggaaagcaattaccaagaactgaaaaaggatcaatttctagaagaattacaaaggttgaatatgaaaatgtttt

SEQ ID NO: 14265 - DNA, 1572 bp, Piromyces finnis
  Acetyl-CoA synthetase-like
aaaaatgaaccatcgttttgctgtttccaaagataagccaatgattgttgcaaaagaaaatatcttaacaccaccatttaaaggtattccaaatgaaaaatttccatctccatggcttacagtttcttttaatgaatttgaaaaattagcaaaggccatggcatatgttattaataaacgttatcatttagaacctcagagtcgtgttgctattattgccaattctttaccaaagaatcacttattatctatagcattatggtatttacgtgtagttactgttgaaattacaccaaaaatcggtaatgatgttaagcaatgttggatgagaatgttaaatatgtcaatgggtttctatgattgtgtatttaaaccattttatcaagaccataagaatgaagaagaatgggtatggccttggatatatccacctacttcaaatgaaaatttagttgctggaaatgaaggtgttttaatggttgatatggacagtgaaagtttcattcaagaagtaattgaagctagagaccaaggtttaacatttgaacgtgaaggtgattgggatgatttacttactattggtggtacttcctcttctgcacaagctattattaaaaatggccaatgttcagaaatgaagtttgttggggttcatcatagaaaagctggtagttgctatgaaaaatacctccacaaacatcttccagaagaaactaactttttattagtttctccattccatcatttacttggtatttgtcaaggtatgttacacccaatttatgatggtggaccacttatttatcgtactcaaagtgttgatgatgttggtgttatatctgaaatgcttttggatgacattgctgaaattgatgttactgaaactcttattttttcattccagtttgctgaatggaaaaagttaaaggaagctggtcatccaaaatggccaatttgggaaaaggctataagatcaagaccaattggttgtttccaaactggtggtgctccacctattccggaagttacaaaatggttagctcgtgaacttcaactctttccagcggaaagttatggttcttctgaaggtggtgttatgatgtacacagaaggtttaccaccacttcgtggagaagaaggctatcttaaaagaattccatatgttgatatttaccttaaacctttaaatgaagatgatccaaatattggtgaagcttatattcattctgcccagaatttcactggttatgttagaagaatagaaagtggtgaaacttgtgaaaattctccatgcccaggtcttcgtgtagatattaaggctgatgaatgttttgttgaaatcgatggcaaaaaattctttaagacgaatgatatctttagacgtagtccaatcactggtgattataaatttgtttcccgtgttgatgatattatcgctttctctactggtttaaagatgaaccctgttccatttgaaagaactatggttcaattttgtaagaatgttaaactttgttgccttctccttgatactactggtacagaagctgtatgttttgtcgaaccacaatg

SEQ ID NO: 14266 - DNA, 927 bp, Neocallimastix californiae
  ACID PHOSPHATASE RELATED
gtattctaaatctaaggaatatccattaatccgttttggtgtttctaaagatttaactgaagaaaatgaagtaacaggtactagttatcaatgtaaaaatattgatgatgtacaatactattgtaatcaagttactgttactggattggaaagtttatcaacttattattatcaaagaaatttaaatggaaagtgggaagatgtaattgaatttaaaactaaaaatccaaataatttcagatttgttttccttggagatccacaaatcggtgcatccaaaaataacttttcagttttaacggagcaacgtcttactgaggaagaaggtcttagaaatgatgctttcaattggaatatgactatatataattcttatgcaaaagcaaatgaagcaagtattattttatctgctggtgataatgctgattctggtcaatctccaggtgattctagcggtaaaactgaagaatatattagaaatgatcttctcagacaagaaagagaatattcaaccttattacttcctaaattaatgcaacaggttccatttgctccagctgttggtaatcatgaatcttttactccttcttttagataccattttaatactccaaatccataccttataggtaaaactgaaacaagtcctggttatagttatttctttaaacataataatgtacttgttatcgttctcgaaactaattatggtaccgaggaagaatttagagaagtagtaggaaaagctaattcaacttttccagatgttgattggagagttgctttattccatcatgatatttatagtaatggttatacacattcacaagatcctttaattaccgaatatatacgtaaagaagtaactcaattgtttgatatatatgatattgatcttgttattaatggtcatgatcatatgtatgc

SEQ ID NO: 14267 - DNA, 1092 bp, Neocallimastix californiae
  ACID PHOSPHATASE RELATED
acgtttagctgttataccaggtgaagatgaaaccaaacttaattttggttggtattcaatttcaaatgaataccctcttattcgtttcggaagtacttctgatttaactgaaaaagatgaagtaagaggtatcaattttaaatgtaaaaatattaatgatacccaatattattgtaatcatattactgttactggattaaaaagtaataccatctattattatcaaagaaatttgaatggaaattgggaagaaacaattgaatttgaaactagaagtccagataattttagatttattttccttggtgacccacaaattggtgcttctgctggtgccatctctgaacttcatcttaataaagttctttctgacgatgaaggtctcagaaatgatgccttcaattggaatatgactatttataattcctatgaaaaagcaaatggacctagtcttatcctttctgctggtgataatgccgattctggtcaatcaccaagtaatgaaaatagtaaaatcgaagatattaaaaaagatcttattagacaagaaaagcaatattctgctcttttacttccaagtttaatgcaaaaagttccatttgccactgctcttggtaatcatgaatcctattctccttccttcaaatatcactttaataatccaaacccttataaggtagaaagatcagaatttagtccaggctataactatttcttcaaatataataatgcccttgttgttatgcttgaatctaactatggtattaaagatgattattcagatgtcatttctaatgccacttctacttatccagatactgattggagaattgctgtattccatcatgatatctacagtaatggtgttatgcattccagtgaatacagagttactgaattacgtaagtggttaaccccattgtttgatgaatatgattttgatcttgttattaacggtcatgatcatatgtattctgccagtcaattcgttcatcatgataagagtagtacagataaatttaagtataaagtttctgaaattgaaagaggtaaggtttacgacaatccaaaaggaacgttatatattactgc

SEQ ID NO: 14268 - DNA, 969 bp, Neocallimastix californiae
  ACID PHOSPHATASE RELATED
taatggtgtccaatattattgtaatcaagtttcagttactggtttaaaaccaaattctatttattattacaaaagaaatttagatggaacttgggaagagacaattgaatttaaaactaaagacccagaaaatttcagatttgtttttcttggtgatccacaaattggttcatctcgtggtagttattcaattggtaatcgtaaacaatttagtgatgatgaaggtcttagaaacgatgcttttaattggaatatgactatattcaattcttattcaaaagcaaatgaagctagtcttattttatccgctggtgataatgctgattctggtgaaacgccaagtaatggtgatattttagataatattagtaatattagtaaaatgtccactgatcttctcagacaagaaaaagaatattcatctttattacttccagaattaatgcaaaaagttccatttgttcctgctgttggtaatcatgaatcttatactgctacatatagatatcattttaatactccaaattcatataaggtagagagtgaaaatcaaattccaggatataattacacaagtattacacctggttacaactattactttaaacataataatgtccttattgttgttctcgaatctaattatggaaatgaagaaatatatacaactgtaatgaatatggctaatgacgcttatcctgatgttgattggagaattgctttgtttcatcatgatatttttagtgatggttacatccattcagaagaaggtcgtgttcaagaattacgtcaatggttaactccattatttgataaatttaattttgatctagttattaatggtcatgatcatatgtattctgccagtcattttattacttatggaaataataataatatttataaatttgaaaaaattgaaaaaaataaaatttataaagatcccaatggtacaatgtttattactgc

SEQ ID NO: 14269 - DNA, 912 bp, Neocallimastix californiae
  ACID PHOSPHATASE RELATED
tgaattctatagaaaaaaagatgatgttaattattattcgaataaagttacagtttcaggtttagaacctaattctgtttactattaccaaagaaaattaaataataaatgggaagacccagtaaaatttaacacctttgaccctgataatttcaaatttattttccttggtgatccacaaattggtggttcaataggtagacatcaatatcattcgtcggattattttgattatgctgaagccattagaaatgatgctttcaattggaatataacgatttttaattccattaaatttactaaaactcctagtcttatattatctgctggagatcaagccgataccatgggtgatgatatcactcaagaacagcaatattcaggtcttcttcttccagaattgataaagactattccatttgctcctacacttggtaaccatgaagtattttctgaaagttttagacgtcattttaatgttccacatccatatatcccaaagaaatatgatgatttagattatgttcctgcatataactactactttaaatataataatgttttagttgttgttctagaaagtaatcataattcctgtcacgattgtgaaatagttatggctaaagctgttgataaatatccaaatacagattggagaatcgctttattccatcatgatatttatggtaatggtgctactcattcccaaggtgacgcaaagaaattaagaccatgtttaactggtctttttgatatttataaatttgatcttgtaattaatggtcatgaccatgtttatactacaacaaaattcattaattataataatagtaataaaaaaagttacactctttctgaaattaaagaaggagttacaaataaaaatccaaagggtaccttctttattacagc

SEQ ID NO: 14270 - DNA, 948 bp, Neocallimastix californiae
  ACID PHOSPHATASE RELATED
aaaaaatgttcagtattattgtaatcaagttactgttaccggattggaacgtaattcgatttattactaccaaagaaacttaaatggtaaatgggaagatccaattgaatttaaaactcatgatccagataatttcagatttgtttttcttggtgatccacaaatcggtgcatctcgtaatcttatttctggtaaaaagtcccttacagatgatgaaggtcttagaaatgatgcgttcaattggaacatgactatatataactcttatgaatttgctaatgaacctagtcttattttatctgctggagataatgctgattctggtcagtcaccaggtgatgataaaaaatctgaagaaaatattaaaattgatctcctaagacaggaaagagaatattccactttattacttccacagataatgcaaaaagttccatttgcttctgctattggtaatcatgaatcttttactcctacttttaggtatcattttaatactccacattcctataaagttgaaagtgataatttcatcaaaggatttcaatccagtataactcctggctataattatttctttaaatataataacgtacttatcgttgtattagaatccaattacagtacggaggaacagtatagagaagttattgaaaatgctattactacctatccagaaacagattggagaattggcttattccatcatgatatttatagtaatggttatggtcattccactgaaccacgtgtcatggatttaagaaaatggttaacaccaatgcttgataagtatgattttgatcttgttattaatggtcatgatcatgtctatgttgctacccattttgttacctcggataaaaatagtaaaaatggctatagttttaataaaattgaaagaaacaaagtttataatgatccaaagggaaccctctatcttaccgc

SEQ ID NO: 14271 - DNA, 963 bp, Neocallimastix californiae
  ACID PHOSPHATASE RELATED
taatggtacccaatattattgtaatcaagttactgttatcggtttagaaccaaattctacttattattatcaaagaaatttaaatggaaattgggaagagtcaattgaatttaaaactcatgatccctataatttcagatttattttccttggtgatccacagattggagcttctcataatgtcctttccattgataaatatattgatgatgatgaaagtcttaggaacgatgccttcaattggaatatgacgatatacaattcttattcaaaagcaaatgaagcaagtcttattttatctgcaggagataatactgactctggtcaatctccaagtgatagagatattttgagatatccagacgaattggaatatgatctcataaaacaagaaaaagagtattcatccttactgcttccagaattaatgcaaaaagttccatttgcttcagctgttggtaatcatgaatcgtttactgcttcttttagataccattttaatactccaaattcgttagaggttgaaagtaataatcaaattccaggatatgattatgctagcgttaccccaggctatagctacttctttaaatataataatgtacttattatcgttctcgaatctaattatggtactgaagaacaatatgaaacattattggaaaaggcatgctcaacctatccaggtgttgattggagaatcgcattatttcatcatgatatttatagtaatggatttaatcactcagaggaagaaagagttttattacttcgtcaatggcttacaaaattactttataaaaataaaattgatcttgttattaatggtcatgatcatatttattctgcaagtcattttatttcttatgatataaataattcaaatcaatacaagtataatattacagaaattgaaaggaacaaaatttataaagatcataaaggtacaatgtatattacagc

SEQ ID NO: 14272 - DNA, 1038 bp, Neocallimastix californiae
  ACID PHOSPHATASE RELATED
tattgctcttactcctggtgcagatgaaacacaacttaattttggttgggaatcattaactaatattgaacctgttattcgtatctcttcagataaaaatatgaaaatttataaagattttattggtaaaaatgaatattacagagaattagatggtaataaatattattctaatcaagttactactactggtttaaaaccaaattcagtttattactatcaaagaaaattagatggtaaatgggaagatgttgttgaatttaacacttatgattctaatgattttaaatttgtattcgttggagatccacaaattggtggttctaatgatcgtcttgcatataaatcaaaatccaaaatgaatgagagttccattggaaatgatgcctttaattggaatatgacggttaatagtttctatgaattaactggtaaaccaagtcttttattatctgctggtgatcaagctgattatatgggcggtgataaaactcaagaaagacaatattctgcctatcttcttccagatttaatcaagaaaattccaattgctcctgctcttggtaatcatgaagtttattctgaaagtttcagacgtcatttcaatgttccaaatcctatgtttaatgcgttacattataaaaccagttactcagcttataattattactttaaatataataatgttcttgttgttgttattgaatcaaattacaatacatgtcatcaatgtgaaaaaataatttcaaaagctgttaaggaatacccagatgctgattggagaattgctttatttcaccatgatctttatggtaatggtaatacacactctcaaggagatgcccaaagattacgtccatgtctaacaggtctttttgatattcataaatttgatcttgttattaatggtcatgatcatgtttatacctcaacccatttcgttaaattccatgattcccaaaacaagatttacgatattgctaaaattagtaaaggttctgtaaatgaaaatcctaatggtactttctatgtcactgc

SEQ ID NO: 14273 - DNA, 951 bp, Anaeromyces robustus
  ACID PHOSPHATASE RELATED
tcctggagaagatgaatctatgcttaattttgcttggtattcagttggtaaatcatatccaaaagttcgtttaagtactgataaaaaaatgtctaatccaattgaatttgaaggtgatttagtacgtaatagaagtaaatatatcagaaaacaaggttatatgattaatagagtaactgtttctggtttagaacgtaataaaacttattattatcaagtatatatggatggagaatgggaaaaacctgttgaatttaaaacttatgatcctgataatttcacagtagccttccttggtgatccacaaattggtggttctgcaggacatattccatatgaaaagaactttaaagatacattaagtatagaagaagcaacaagaaatgatgcttttaattggaatatgacaatttataaaatattcgaaaaaactgttaaaccaagtttaatattatcagctggggatcaaattgattatgatggaaatagaaaatcagaatatgatattgatattcaagaagaacaatatgctgctttctttttaccagaaaaattaaaacaagttccaattgctgaagctattggtaatcatgaatcaagattagatacctttaatttacattataatgtaccaaatccatatgatactccaattgaaccacaaattgcaccaggatatagttatttctttaaacataataatattcttgtagttgtattagaaactaatttcggtttttgtgaagattatcaagaagttatgagaagagcctataataaatatccagatacggattggcgtattgctttattccatcatgatatttatagtagtggttggtgtcattctcaagaagaatctgtcactgatttcttaagaccatgtttaactgaactttttactaaatataaatttgaccttgccattaatggacatgatcatatttattc

SEQ ID NO: 14274 - DNA, 990 bp, Anaeromyces robustus
  ACID PHOSPHATASE RELATED
gtattcaaaaactgaatcaattcctactattcgtttaagtacaaaagaagatatgagtaattataccgaatttactggtattaatgaatatcatagaatttatattgaagatccttattatacaaataaggtcactgttactggtataaatcgtcaatccacttattattatcaaagaaaattaaatgatcaatgggaagatccaattaaatttactacacatgatccagataattttaaatttatattctttggtgatccacaaattggtggttctcatagtcatgtttcacttggtcaaagaagaattcttggtgttgacgatggtattagaaatgatgcttttagttggaatagaacgatttctaaatcttttgaatttactaaagaaccaagtcttatattatctgcaggggatcaagctgatgatgatgtagatgaattatatcaagaaatagaatattctgctttatttcttccagaattattaaaaactgttccattagctactgctgttggtaatcacgattcttatactattaattataggcaacatttccatgttccaaatccatatcttacaccagaatatcaatatactattcctggatatagttatttctttaaatataataatgttcttgttgtagtacttgaaactaattatattacagaaaatgatgcctatgaaataattccaaatgccgttaaaaaatatccagatactgattggcgtattgctttattccatcaagatctttatagtaatggatatacccattctcaacaatatgatgttcttcgtttacgtccatttttaactaaattattttctgaatataattttgatcttgtcattaatggtcatgatcatatttattcagcatcccaatttgtatcctatgataatattaatgattattataaagtttcttttattcaaagaggaaaacctcaagaaaatcctgaaggtactttatatattacagc

SEQ ID NO: 14275 - DNA, 984 bp, Anaeromyces robustus
  ACID PHOSPHATASE RELATED
gtattctactacagaatcaaatccaataatacgatttagtagtaatcaagatatgtctaatgctaaaaattttattggaactattgaaaaatatatggtattaaataataaaacttattattcaaataaagttacagttactggattagaacctcattccacttattattatcaaagaaatttaaatggtaaatgggatgaacccatttcattttttaaaactcatgatccaaataattttaaatttatttttgtaggagatcctcaaattggtgcttctcatgatcgtatttcatttgctaaaaatttacaagatgttttaaccatacctgaaagtaccagaaatgatgcttttaattggaatatgacaatttataaatcttttgaattcattaaagaaccaagtttattattatctgctggtgatcaaatagatatagcatgttcacctaaaacagaagaagatctttatttacaagaaactcaatattctggttttcttcttccagatttattaaaaactattccatctgttattgctgtaggtaatcatgaagcattaactcattcttttaaacatcattttaatccaccaaatccttatacaacccctattgaaccagaattagcaccaggttatagttatttttttaaatataataatattctttttgttatattagaaacaaattatggattttgtgatgattttaaagaagttatgagaagagcttatttaaaatatccaaatacagattggcgtattgctatgtttcatcatgatatttatagtaatggtagtaatcattctcaagaagaatatattgttagattcttaagaccatgtttaacggaattattatctaaatataaatttgatcttgtaattaatggtcatgatcatgcttattcttcttcccatttaatttcttttcatcaatatttaaataataacaatgacaataataataacaatactaatga

SEQ ID NO: 14276 - DNA, 906 bp, Anaeromyces robustus
  ACID PHOSPHATASE RELATED
gtattcaaaaactaaaactgaaccagctattcgtgttagtaaatataaaaatatgaaaccctatgttgattttgttggtaaaatagaattttatagagaaataggtggacaatcctactattccaataaagtaactattagtggattagaacgttcatccacttattattatcaaagaagattaaataataaatgggaatctgccattaaatttaatacctatgatccagataattttaaatttatttttgttggtgatccacaaattggtggttctgaaggacatgtaacctatgataatccaacagaacctctttctgaagtggatggtactaaaaatgatgcctttaattggaatatgaccattcataaatccttagaattaactaaagaacctagtcttttattatctgcaggtgatcaagttaatgccttttgtatggaaggatatgataaacaatatgaacttcaagaatatgaatattctgcattacttcttcctgatcccttaaaatctcttccaatggcaaccacggttggtaatcatgaaatttatactaaagcttttaaaaatcattatcatacaccaaattcttatgaaactccacttgaaccagatcttgccccaggttataattatttctttaaatataataatgttttagttattgtattggaaaccaattatgggtattgtgatgattttaaagaagttatgagaagagctcatttaaaatatcccaataccgattggcgtattgttatgttccatcatgatatttatagtaatggtaaattccattcccaagaatcctatattacagatactttaagaccatgtttatcccaattaatgacctattataaaatagatcttgtcattaatggtcatgatcatatttattc

SEQ ID NO: 14277 - DNA, 954 bp, Anaeromyces robustus
  ACID PHOSPHATASE RELATED
aagaatttccgtatttgttggtgaagatgaatcaaaacttaattttggttggtattcaacctccaattcaaaaccaaagattcgttttggtagtaaaaaagatttgtccgatgctaaagatttcactggtacaaattcttattataagacattaaatggtaaaaaatattattcgaataaagttaccgtaaccggtttaaaacgtaaatccacttattattatagaagaaatttaaatggaaaatgggaagaaacgattagattcaatacctatgatccaaataatttccaatttatatttgttggtgatccacaaattggtggttctcatgatcgtttatctgttgctgatccttaccatgtattaacacgtgaagaaggtactagaaatgatgcttttaattggaatatgacaatttataaatcctttgaaaaaacaggaaagccaagtgtattattatctgctggggatcaagtggatacggaatgtttttctggtaccactgaagaagattatagtcaagaaattcaatattcggctttccttcttccagatttattaaaaactattccatccgctacaaccgttggtaatcatgaagctttaaataaaaattatagaaatcattataatactccaaattcacatattccattagaacctgaaattgcacctggttatagttatttctttaaatataataatgttttagtggttgttttagaaacgaattatagtttttgtgatgattttaaagccgttttcaaaaaagcttttttaaaatatccaaataccgattggcgtgtggctatgttccatcatgatatttatggtaatggtagtttccattcccaagatgaatatattattaataaattacgtccatgtttaacggaattactttcttactacaaatttgatttagttattaatggtcatgatcatattttctc

SEQ ID NO: 14278 - DNA, 1035 bp, Piromyces finnis
  ACID PHOSPHATASE RELATED
gtattcaactaccgaaaccatcccatccatttgttggggtactactaaagatacaagcgattgtgaagaattcaaaggtacagttacctattttaaggatttaagcggaacatcttattattctaatgctgttactgttaaaaatataaaacgtaatacaacatattattataaaagaaagttaaatggtcaatgggaaaaaccaattcaatttaaaacctatgatcaagataactttaaaatcctttttgttggtgacccacaaattggtggtgctcacgacagaattactgcttcaaataattactctagagttctcacaagagaagaaggtaatagaaatgatgcttttaactggaatgttactgtatataattcatttaattttgctggtcaaccaagtcttttattatctgcaggtgatcaagccgatgaagaatatgccgtaaaaggtaatgaatacgattataatgaagaatcccaatattctgcttttcttcttccaaaattaatgcaaaccattccaactgtacctacaatcggtaatcatgatagttacacagaaaactttaaatatcatttcaacacaccaaataattatgcttctaaaaattatacaaagtattataatggaaatgaaccaggatacaattatttctttaaatataataacattttatttgttgttcttaacaccaacgctccaatttgtgaagagtttaccgaaattattaataaggctatcactaaatatcccgatacagactggcgtattgccatgttccaccaagatctttatggtgatggtagtactcattctcaaaatgatggtatcacaaaagtattacgtccttgccttacaaaattaatttatgataacaaattcgatcttgttcttaacggtcatgatcacgtttataccgtaagtaaatttattacctacacaggagctgataattatggtggttatggttttaattctattgaaagaaataaggtttaccataagccagatggaacactttatattacagc

SEQ ID NO: 14279 - DNA, 918 bp, Piromyces finnis
  ACID PHOSPHATASE RELATED
ttccaataaagttagtgttactggcctagaacgtaattctgtttattactacaaaagaaaattaaatggtcaatgggaaaagccaattcaatttaaaacctacaatccagataactttaaatttatttttgttggtgatccacaaattggtggttcacatgaccgttactccatttctaatttatatgagagagtattaacggtggatgagggtacagccaatgatgcctttaattggaatagaactattacccattcctttgattttgttaaagaaccaagtcttttattatctgctggtgatcaagctgatgaagaaaacaatagtttctatagtgatcaagaacattataatgaagaaacacaatactctgcattacttctccctaaacaaattcaaaccattccaatggctgctgctatcggtaatcatgacagaaatactgaaaatttcagacatcattttaacgtacctaatccatataaaaatccatcctatcttatggatgatggatggattgaaggttacaactattactttaaatacaataatgttttaattgtagttcttaacaccaatcatgaagaatgtgttgattttgaatccgtcattaccaatgccgttgaaaaatatccagacactttatggcgtattgctttattccatcatgatatttatggtaatggtgttactcattccttagaagatggtatgaagaatgttttacgtccatgtttaaccaaattattatccaattttaaatttgatcttgccattagtggacatgatcacgtctataccgcaagtaaatttattacctacgatgctaatgctaataattctggtaaatatgtaacaagtgacattcaaaccaatgaaacctttaaggatccaaagggtaccttttttattactgc

SEQ ID NO: 14280 - DNA, 1029 bp, Piromyces finnis
  ACID PHOSPHATASE RELATED
gtattccactactaaaacactaccttccataagatatagtgtcaataaagacatgagtgatgccgtgcaatatgacggttattttgaacaacattataaattaaatggaacacaatactattctaacaaagtaaccattgaagatttaaaaccaaacaccgtttattactatcaacgattattaaatggagaatgggaaaaaccagtcattaagcttaaaacgcgtgatccttacaattttaaatttgtatttgttggtgatcctcaaattggaggttctcacgatcgtttttccatcaccaataattatgaaagggttctcacgttgaatgaaggtaatagaaatgacgcattcaattggaatagaactatttctagatcttttgaatttgcaaataaaccaagtctcctacttagtgctggggatcaagccgatgaagaatgtaaacacttggaagataatgaaaaaggacccatggaacttttgaatgaagaaatgcaatattcagcttttcttcttccagatttattaaaatctgtacctgtcgctgctgcagttggtaatcatgatgctagtaataataattttagaaaacattttaattcaccaaattcctacaccgaccccaaataccaagatttaattccgggatataattatttctttagacatcataatgttcttgtcgttgttctcgaaacgaactacgggtattgtgaagatttttccaatgtaattgaaaaggccataaaaaaatatccagacgttgattggcgtattgcaatgtttcatcatgatatctacggtaatggtgtaacccattcgaaggaaccttacattgtcaatgaattacgtccatgtttaacccaattattttatgaaaataaatttgatcttgtgattaacggacatgatcatgtctataccgcttcaaagttcatttcctatgataacaataactacagtgtaagtgatataaaaaagaataaagtttataagcaacccaaaggtactttttacattaccgc

SEQ ID NO: 14281 - DNA, 1029 bp, Piromyces finnis; identical to SEQ ID NO: 14280
  ACID PHOSPHATASE RELATED

SEQ ID NO: 14282 - DNA, 1080 bp, Piromyces finnis
  ACID PHOSPHATASE RELATED
acatctttccgttagtgttggggaagatgaatctatgcttaatttcggttggtattctaccatggatgaaattccatccattcgttatggtacggcagaagaagatgaatctcaatacaaagaatttactggtacccttcttaaacatcgtaccatcaaagataccgtctactattctaataaagttaccattactggtttacaacgcaacaccatttattactatcaaagaaaattaaatggtatttgggaacctgctgttgaatttaaaacttatccttccgatcattttaatttcattttccttggtgatcctcaaattggcggttctaagaatcgttacagtaaacttcttaaggatagaggggtcaccatcgaagaaggtattagaaatgatgcatttaactggaatagaaccctgaccgaagccgtaaactatgtcaaaactccaagtcttatcttatcagcaggggatcaagcagaatctatggcttacgattctgatgaagaacttattttacaagaaaaagaatatgctgcttttcttactccaaatttaattcaatccattcctactgccgctaccgttggtaatcatgatcaatatacggataattttattcatcattttaatccaccaaatttatacaatcaagatactgttcttcaaaccaccggtacgcgtgtccttcccggttacaactattactttaaatataataatgtacttgttgtggtacttgacaccaacaatcacaattgtaccgatttttctacggttatcgaagaagccattgaaaaacatccaaagacggattggcgaattgccatgttccatcatgatatttacggtaatggtagtactcattcttccgaagatgatattaaactttacttacgtccatgcctaactccattgattgataaggctcattttgatcttgtcattaatggtcatgatcatgtctactcctcttctaaatttatttcctacaatgatgatggaagtctctattcgttgaacgacattgaaaccaataaaatttatgaaaatcaaaatggtaccctttaccttacggc

SEQ ID NO: 14283 - DNA, 1080 bp, Piromyces finnis; identical to SEQ ID NO: 14282
  ACID PHOSPHATASE RELATED

SEQ ID NO: 14284 - DNA, 1080 bp, Piromyces finnis; identical to SEQ ID NO: 14282
  ACID PHOSPHATASE RELATED

SEQ ID NO: 14285 - DNA, 1080 bp, Piromyces finnis; identical to SEQ ID NO: 14282
  ACID PHOSPHATASE RELATED

SEQ ID NO: 14286 - DNA, 159 bp, Neocallimastix californiae
  ACP_DOMAIN
tttcgaagttatggaattagaattgaaaaaggttcttcaatacggtgaaaatgatgaaattgatccttatcaatccttatctgaattaggtattgattccattatgatgatggaattacgtaccattttaaagaatgttacaggaattaatattccttt

SEQ ID NO: 14287 - DNA, 183 bp, Neocallimastix californiae
  ACP_DOMAIN
taaagataatattccagaaattttaaaggaggaagttcgtagaatgttaatgtataatgaaaatgatgaattagatatcttccaacctctctctgaattaggtattgattctattatgatgatggaacttcgtcaaattattaaggctgtaactaatattactgttccactttctattattac

SEQ ID NO: 14288 - DNA, 216 bp, Neocallimastix californiae
  ACP_DOMAIN
aattcgtatgattcatgaatcaattaaggaaattattccttctactccagaatttaataaatttaatccagatgcgcccttcaccgtatatggtattgattccctatcggttatcaagttaaccaacgtcttgtcaagaaaattcaataaaaagtattctcctgctattctttttacctatggtacgacggcttctcttgccaaatatttaaaagg

SEQ ID NO: 14289 - DNA, 171 bp, Neocallimastix californiae
  ACP_DOMAIN
aactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattagg

SEQ ID NO: 14290 - DNA, 171 bp, Neocallimastix californiae; identical to SEQ ID NO: 14289
  ACP_DOMAIN

SEQ ID NO: 14291 - DNA, 210 bp, Neocallimastix californiae
  ACP_DOMAIN
aaagaatgaaatatgtgatagattacaaaatatgttaggtttagtagatgaaaaaattgatccagctattccacttcgtgtttatggtttagattccttaactactatggaattaaccaattggattcaaagtgaattaaaggttacattaccacaaagtcaattattaagtgatgagataactacaaatgaattagttagtataattat

SEQ ID NO: 14292 - DNA, 171 bp, Neocallimastix californiae
  ACP_DOMAIN
aactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcaatcaaagtcaattattagg

SEQ ID NO: 14293 - DNA, 210 bp, Neocallimastix californiae
  ACP_DOMAIN
gaaaaatgaagtagttgaaaaattacaagatttattaggtttagttgatgaaaatattgatactaatgtaccattgcaagtttatggtttagattctttaacttcaatggaaattgttaaatgggttgagaatgataaaaaagtagaactaccacaatcagctttattaagtagtgaaattactactgaagaacttgttaatatgattgc

SEQ ID NO: 14294 - DNA, 171 bp, Neocallimastix californiae
  ACP_DOMAIN
aaccaaggatattactgataaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattagg

SEQ ID NO: 14295 - DNA, 171 bp, Neocallimastix californiae; identical to SEQ ID NO: 14289
  ACP_DOMAIN

SEQ ID NO: 14296 - DNA, 171 bp, Neocallimastix californiae; identical to SEQ ID NO: 14289
  ACP_DOMAIN

SEQ ID NO: 14297 - DNA, 171 bp, Neocallimastix californiae
  ACP_DOMAIN
aactaaggatattacagaaaaattacaaagtatgttaggattaattgatgaagaaattgatgttactattccacttcgtgtctatggtttagattctttaacagctatggaattaaccaaatggattgaaagcgaaatgaatattgaattcagtcaaagtcaattattagg

SEQ ID NO: 14298 - DNA, 216 bp, Neocallimastix californiae
  ACP_DOMAIN
tattcgtattatatatgagtcaataaaggaaattattccttcaactccagagtttgaaaaatttgatccagaatctccatttactgtttatagtatcgattctcttgctattattaaattaaccaatattttatcaagaaagttcaatgagagatactctccagctattctttttaactatggtaccaccagtcttcttgctcaatatataacggg

SEQ ID NO: 14299 - DNA, 249 bp, Neocallimastix californiae
  ACP_DOMAIN
agaagaagaaattaatgaagaaattcaaaaagcagtaatgattgtttatgaatccattaaagaaattattccttctactccagattttgaagatttcaatattaatgcaccatttactatctacagtattgattctcttgctaccagaaaattaactagtgttttaaatcgaaagaccttaaaaccattctctgcttccaccttatttaactatggtactccatatgatcttgcgagatatattactgg

SEQ ID NO: 14300 - DNA, 228 bp, Neocallimastix californiae
  ACP_DOMAIN
tgaggaattcttaatcatgttaatctatcaatccattaaagaaattattccttccacaccagattttgaacagttcgttcctgaaaagtcctttaccatgtatggtatcgattctttaactactgtcaagctaactaaccttctctctcgcaaattaaagaaaaactactctccttccattattttcaactatgcctctccattacttttagctaaatatttagccca

SEQ ID NO: 14301 - DNA, 249 bp, Neocallimastix californiae
  ACP_DOMAIN
tagagaagaaattaatgatgaaattcaagatgctattaagcttatttatcaatcaatcaaggaaattattccatctaccccagaattcgaatctttcaacccagaaagtccattcacaatctatggtattgattctctttcaactattaaattaactaatgtattatcaagaaaattgaataagcattactcaccagctattcttttcaactatggtaatacttttgaactcgctaaattcttatctgg

SEQ ID NO: 14302 - DNA, 171 bp, Neocallimastix californiae
  ACP_DOMAIN
aaccaaagatattactgaaaaattacaaagtatgttgggtttaattgatgaagaaattgatgttaccattccacttcgtgtctatggtttagattctttaactgctatggaattaaccaaatggattgaaagtgaaatgaatattgaattcagtcaaagtcaattattagg

SEQ ID NO: 14303 - DNA, 171 bp, Neocallimastix californiae
  ACP_DOMAIN
aaccaaggatattactgaaaaattacaaagcatgttaggtttaattgatgaagaaattgatgttaccattccacttcgtgtctatggtttagattctttaactgctatggaattaaccaaatggatagaaagtgaaatgaatattgaattcagtcaaagtcaattattagg

SEQ ID NO: 14304 - DNA, 171 bp, Neocallimastix californiae; identical to SEQ ID NO: 14303
  ACP_DOMAIN

SEQ ID NO: 14305 - DNA, 171 bp, Neocallimastix californiae
  ACP_DOMAIN
taaagataatatctttgagattatggagaccgaattaaagagaattcttcaatacggtgaaaatgatgaaattgatccttaccaatccttaaccgaattaggtattgattcccttatgatgatggaattccgtactatcctaaagaatgttactaccgtcaatattccatt

SEQ ID NO: 14306 - DNA, 216 bp, Neocallimastix californiae
  ACP_DOMAIN
aataaatgtaatttattcttgcatggctgagattattccatctacggttcctttcgatgaatttaacatttatgatactttcacttcctcaggatttaactccattaattccgtaaagttaataaaattattaaatagcaaattaaagacaaactattccactgtcatgctctttaattttaattctccctatgaattagcgagagcattaattag

SEQ ID NO: 14307 - DNA, 216 bp, Neocallimastix californiae; identical to SEQ ID NO: 14306
  ACP_DOMAIN

SEQ ID NO: 14308 - DNA, 216 bp, Neocallimastix californiae
  ACP_DOMAIN
aattaatgtaatttattcttgtataactgaaattataccatctacagttcctttcgatgaatttaatattcatgacacttttacttcctcaggattcaactcaatcaattcagttaagctaataaaactattaaatagtaaattaaagacaaaatattctactgtcatgctattcaattataatacaccttatgaattagctaaagcattaataag

SEQ ID NO: 14309 - DNA, 216 bp, Anaeromyces robustus
  ACP_DOMAIN
gattaaattaatttatgaagctattaaagaaattgtaccttctacacctgaatttgaagaatttaatattaatgctccatttactatttatagtattgattctataggtacacgtaaattaacaaatattttaggtagaagaacaggaaaaccatttactacatctactttatttaattatggtactacttatgatcttgctaaatatattacagg

SEQ ID NO: 14310 - DNA, 249 bp, Anaeromyces robustus
  ACP_DOMAIN
tcaagaagaaattaatgaagaaattcaagaagctattaaattaatttatgaatctattaaagaaattgttccttctactcctgaatttgaagaatttaatattaatgctccatttactatttatagtattgattctataggtacacgtaaattaacaaatattttagctagaagaacaggaaaaccatttacttcatctactttatttaattatggtactacttatgatcttgctaaatatattacagg

SEQ ID NO: 14311 - DNA, 225 bp, Anaeromyces robustus
  ACP_DOMAIN
tgaagaaggtataaaaattatttatcaatctattaaagaaattattccatctactccttcttatgaagaatttaatccagaaagaccatttaatctttatggtattgattcacttgctactgttaaattaaccaatgttttatcaagaaaaatgggaaaacgttattcaccagctattcttttcaattatggtaattctcttgaattagcaaaattcataactaa

SEQ ID NO: 14312 - DNA, 171 bp, Anaeromyces robustus
  ACP_DOMAIN
taatgaaatcttaaagagagaagttcgtagaatgttaatgtataatgataatgatgaattagatgaattacaaccactttctgaattaggtttagattctattatgatgatggaattccgtcaaattattaaagctgttactaacattgttgtaccactttccattattac

SEQ ID NO: 14313 - DNA, 171 bp, Anaeromyces robustus
  ACP_DOMAIN
agaagataatgtttatgctattatggaaagtgaattaaagagaattcttcaatatagtgaaaatgatgaaattgatccatatcaatctttaacagaattaggtattgattctattatgatgatggaattacgtactattttaagaactgctacaggtgtaaatattccatt

SEQ ID NO: 14314 - DNA, 225 bp, Anaeromyces robustus
  ACP_DOMAIN
tgatgaagctattaaaattatttattattctgttaaagaaattattccttctactcctgaatttgaagattttaatccagaaagaccatttaatttttatggtattgattctcttgctactattaaattaactaatattatttcaagaaaattaggtaaacgttatactccagctgttctttttaattatggtaatgctcttgaacttgctaaatttgtaactaa

SEQ ID NO: 14315 - DNA, 210 bp, Anaeromyces robustus
  ACP_DOMAIN
tgaaaaattaatatgtaatgtatatagtaaaacattaaatattgatgaaagtaaaattggaaaaatgagcgatttctttgaattaggaggtgatagtttaaacgctataagaattatatcaatgattgaaaaggaattgaatataaaactctatataaaagatatattatcgcatcctttagtaagtgaaattagcgaatatattgaaga

SEQ ID NO: 14316 - DNA, 222 bp, Anaeromyces robustus
  ACP_DOMAIN
aatatccaaagttgaaaagattatttgcaaaatttattcgaatgtatttaatattaacgaaaatagtgttggattaatgaatgaattttatgaacttggaggtgacagtttaattgttattagtattttatcattaattgaaaaagaattaaagataaaattaaatgttaaagatattctttcacatcctttaattaaagatttatgtgattatatagaaac

SEQ ID NO: 14317 - DNA, 216 bp, Anaeromyces robustus
  ACP_DOMAIN
aattaatatgatttattcttgtattgtagaaattattccatctacagtaccatttaatgaatttaatgcagatgaagccttttcttcatttggattaaattcaattaattccattaaattaattaaattattaaatagtaaattaaaaacaaattattctactgttatgcttttcaattataattctccaacagaattagctaaagctttagctag

SEQ ID NO: 14318 - DNA, 171 bp, Piromyces finnis
  ACP_DOMAIN
agaagataatatctatgaaattatggaacatgaattaaagaatgttctccaatacggtgaaaatgatgaaattgatccataccaatctttaactgaattaggtattgactctatcatgatgatggaattacgtactattatgagaactgccactggtatcaacattccatt

SEQ ID NO: 14319 - DNA, 216 bp, Piromyces finnis
  ACP_DOMAIN
tattcgtattattcatgaatctattaaagaaattattccatctactccagattttttagaatttaatgcagaagccccatttactatatacggtattgaatctttagcaactattaaattagcaaacattttatcaagaaaattcaataaaagatattcaccagctattctttttaattatggtaccaccatgcttcttgctaaacatataactgg

SEQ ID NO: 14320 - DNA, 204 bp, Piromyces finnis
  ACP_DOMAIN
ttatcagtcaattaaagaaattattccttcaactcctgacttcgaattattcaatcctgaaaatcctttcaatatttatggtattgattcactctctactatcaaattaactaatatattatcaagaaaattgaataaatacttctctcctgccatcctcttcaactacggtaatacttatgctctcgctaaattcattactgg

SEQ ID NO: 14321 - DNA, 171 bp, Piromyces finnis
  ACP_DOMAIN
tcaagatattttaaagaaagaaattcgtagaatgttaatgtacaatgaagatgatgaaattgacgaaatgcaaccactttctgaattaggtatggattctattatgatgatggaattccgccaagttattaaagctgtcactgatattatgattccactttctattatttc

SEQ ID NO: 14322 - DNA, 183 bp, Piromyces finnis
  ACP_DOMAIN
caaggataaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattagg

SEQ ID NO: 14323 - DNA, 183 bp, Piromyces finnis; identical to SEQ ID NO: 14322
  ACP_DOMAIN

SEQ ID NO: 14324 - DNA, 183 bp, Piromyces finnis; identical to SEQ ID NO: 14322
  ACP_DOMAIN

SEQ ID NO: 14325 - DNA, 183 bp, Piromyces finnis; identical to SEQ ID NO: 14322
  ACP_DOMAIN

SEQ ID NO: 14326 - DNA, 183 bp, Piromyces finnis; identical to SEQ ID NO: 14322
  ACP_DOMAIN

SEQ ID NO: 14327 - DNA, 183 bp, Piromyces finnis; identical to SEQ ID NO: 14322
  ACP_DOMAIN

SEQ ID NO: 14328 - DNA, 210 bp, Piromyces finnis
  ACP_DOMAIN
aaagaatgaagttattaccaaattacaagatttattaggattagtagatgaagaaatagatgttaacgttccattacaagtttatggtttagattctttaacttcaatggaaattgttaaatggattgaaaatgataagaatgttgatcttccacaaactgcattattaaatagtgaaatcacaacagaagaacttattaatatgattgc

SEQ ID NO: 14329 - DNA, 183 bp, Piromyces finnis; identical to SEQ ID NO: 14322
  ACP_DOMAIN

SEQ ID NO: 14330 - DNA, 204 bp, Piromyces finnis
  ACP_DOMAIN
ttatcaatccattaaagaaattataccatctactccagattttgatcaatttgatccagaaatgtcattcactatgtatggtatcgattctctctctaccgttaaattaacaaatattttatcgagaaagttaaagaagaactattctccttctattattttcaattatgcttctccacttttacttgctcaatatttatctca

SEQ ID NO: 14331 - DNA, 273 bp, Neocallimastix californiae
  ACP-like
tgaggataatattttcgaagttatggaattagaattgaaaaaggttcttcaatacggtgaaaatgatgaaattgatccttatcaatccttatctgaattaggtattgattccattatgatgatggaattacgtaccattttaaagaatgttacaggaattaatattcctttggtagtattctccactcaaaatatttgtctttaccgtcttgtagaatatgtcaagaccaagttagtgaaggaaaaggaagaagctgctaagagtaaggcaac

SEQ ID NO: 14332 - DNA, 219 bp, Neocallimastix californiae
  ACP-like
tattccagaaattttaaaggaggaagttcgtagaatgttaatgtataatgaaaatgatgaattagatatcttccaacctctctctgaattaggtattgattctattatgatgatggaacttcgtcaaattattaaggctgtaactaatattactgttccactttctattattaccacgccaaacttaacactctctaagatctttgaatatcttaaggg

SEQ ID NO: 14333 - DNA, 312 bp, Neocallimastix californiae
  ACP-like
gattcatgaatcaattaaggaaattattccttctactccagaatttaataaatttaatccagatgcgcccttcaccgtatatggtattgattccctatcggttatcaagttaaccaacgtcttgtcaagaaaattcaataaaaagtattctcctgctattctttttacctatggtacgacggcttctcttgccaaatatttaaaaggttatgaaaatattagctatcttccctctcaagaaaaagaccatggagcctccagtaataaaaagattgcaatcattggtatggcttttcgtttacctggagctat

SEQ ID NO: 14334 - DNA, 303 bp, Neocallimastix californiae
  ACP-like
ggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattataatggatggatctcccgcaacttcagcaccggttgctgcaccaattgttaaagataccatggcatcaattactccagtagttccaac

SEQ ID NO: 14335 - DNA, 264 bp, Neocallimastix californiae
  ACP-like
tttgaaaaatgaagtagttgaaaaattacaagatttattaggtttagttgatgaaaatattgatactaatgtaccattgcaagtttatggtttagattctttaacttcaatggaaattgttaaatgggttgagaatgataaaaaagtagaactaccacaatcagctttattaagtagtgaaattactactgaagaacttgttaatatgattgcatcaaagattactggtgaagatttagttaaagcaccttcttatgatcaata

SEQ ID NO: 14336 - DNA, 270 bp, Neocallimastix californiae
  ACP-like
ggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatggttcttcttctgctccagttactgaatcaactcaagttgctccagc

SEQ ID NO: 14337 - DNA, 231 bp, Neocallimastix californiae
  ACP-like
aaagaatgaaatatgtgatagattacaaaatatgttaggtttagtagatgaaaaaattgatccagctattccacttcgtgtttatggtttagattccttaactactatggaattaaccaattggattcaaagtgaattaaaggttacattaccacaaagtcaattattaagtgatgagataactacaaatgaattagttagtataattattaatttattagctaataataa

SEQ ID NO: 14338 - DNA, 273 bp, Neocallimastix californiae
  ACP-like
ggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcaatcaaagtcaattattaggtgatgatattactactgaagatttaattaatattattatggatgattcttcttctactcaagatgttaccctagccccagttgctgttccaac

SEQ ID NO: 14339 - DNA, 300 bp, Neocallimastix californiae
  ACP-like
cagggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatggttcttcttctgctccagttacagaatccactccagtagctccagctccagaagctccagtagttgctccaat

SEQ ID NO: 14340 - DNA, 300 bp, Neocallimastix californiae
  ACP-like
taagaataaattaaccaaggatattactgataaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatggttcttcttctgctccagttacagaatccactccagtagctccagctccagaagctccagtagttgctccaat

SEQ ID NO: 14341 - DNA, 270 bp, Neocallimastix californiae
  ACP-like
ggataaattaactaaggatattacagaaaaattacaaagtatgttaggattaattgatgaagaaattgatgttactattccacttcgtgtctatggtttagattctttaacagctatggaattaaccaaatggattgaaagcgaaatgaatattgaattcagtcaaagtcaattattaggtgatgatattactactgaagatttaattaatattattatggatggttcttcttctgctccagttactgaatcaactcaagttactccagt

SEQ ID NO: 14342 - DNA, 276 bp, Neocallimastix californiae
  ACP-like
ggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatggttcttcttctacttcagttacagaatccactccagtagctccagtagttgc

SEQ ID NO: 14343 - DNA, 330 bp, Neocallimastix californiae
  ACP-like
atatgagtcaataaaggaaattattccttcaactccagagtttgaaaaatttgatccagaatctccatttactgtttatagtatcgattctcttgctattattaaattaaccaatattttatcaagaaagttcaatgagagatactctccagctattctttttaactatggtaccaccagtcttcttgctcaatatataacgggtcatgacagtgataacattaacattaataaaactatgaataatatacaaatgccaaaggaaagtaattccaaaacttctgataaaatcgccattattggtatggcattacgtttaccaggtactat

SEQ ID NO: 14344 - DNA, 318 bp, Neocallimastix californiae
  ACP-like
cattaaagaaattattccttctactccagattttgaagatttcaatattaatgcaccatttactatctacagtattgattctcttgctaccagaaaattaactagtgttttaaatcgaaagaccttaaaaccattctctgcttccaccttatttaactatggtactccatatgatcttgcgagatatattactggttatgataaaaagttgaaagagaaagcttctcctctttcttcccttccaaaatcgattaaggatgtttcgatggataaaagagtggcagtgattggtatggctcttcgtttacctggtgccat

SEQ ID NO: 14345 - DNA, 315 bp, Neocallimastix californiae
  ACP-like
atccattaaagaaattattccttccacaccagattttgaacagttcgttcctgaaaagtcctttaccatgtatggtatcgattctttaactactgtcaagctaactaaccttctctctcgcaaattaaagaaaaactactctccttccattattttcaactatgcctctccattacttttagctaaatatttagcccaaccaacgcaacttgcttcatccttaaaagctggtccaaccaatgatagtagttgttgtaatcgcaaatccaatgcgatcgccatcattggtatgggtttacgtcttccaggtgctat

SEQ ID NO: 14346 - DNA, 327 bp, Neocallimastix californiae
  ACP-like
ttatcaatcaatcaaggaaattattccatctaccccagaattcgaatctttcaacccagaaagtccattcacaatctatggtattgattctctttcaactattaaattaactaatgtattatcaagaaaattgaataagcattactcaccagctattcttttcaactatggtaatacttttgaactcgctaaattcttatctggtaatgttgatcaaaagaatgtatcagaaattcgtgaatctattccagcttccttaaatgaaaaacagtctaatggaaaaattgctattattggtatgggtcttcgtttacctggtgctattaa

SEQ ID NO: 14347 - DNA, 324 bp, Neocallimastix californiae
  ACP-like
taaggacaaattaaccaaggatattactgaaaaattacaaagcatgttaggtttaattgatgaagaaattgatgttaccattccacttcgtgtctatggtttagattctttaactgctatggaattaaccaaatggatagaaagtgaaatgaatattgaattcagtcaaagtcaattattaggagatgatattactactgaagatttaattaatgttatcatggatggttcctcttcagctccggctccagctgctgctccaattgctcagacaaagtctttccaaccaactccaattgccccagtatctcaagcaaaaccttt

SEQ ID NO: 14348 - DNA, 318 bp, Neocallimastix californiae
  ACP-like
taaggacaaattaaccaaagatattactgaaaaattacaaagtatgttgggtttaattgatgaagaaattgatgttaccattccacttcgtgtctatggtttagattctttaactgctatggaattaaccaaatggattgaaagtgaaatgaatattgaattcagtcaaagtcaattattaggagatgatattactaccgaagatttaattaatgtcatcatggatggttcctcttcagctccggctccagctgctgccccagtatctcaagcaaaacctttccaaccaacaacggttgccccaatggctcaagtaaa

SEQ ID NO: 14349 - DNA, 273 bp, Neocallimastix californiae
  ACP-like
ggacaaattaaccaaggatattactgaaaaattacaaagcatgttaggtttaattgatgaagaaattgatgttaccattccacttcgtgtctatggtttagattctttaactgctatggaattaaccaaatggatagaaagtgaaatgaatattgaattcagtcaaagtcaattattaggagatgatattactactgaagatttaattaatgttatcatggatggttcttcttcagcttcggttccagttcaagtcgcagcaccagctactat

SEQ ID NO: 14350 - DNA, 246 bp, Neocallimastix californiae
  ACP-like
taaagataatatctttgagattatggagaccgaattaaagagaattcttcaatacggtgaaaatgatgaaattgatccttaccaatccttaaccgaattaggtattgattcccttatgatgatggaattccgtactatcctaaagaatgttactaccgtcaatattccattagtcgtcttctccacccaaaatatttgtctcttccgtcttgtcgagtacgttaagggtaaattatcgaaggatga

SEQ ID NO: 14351 - DNA, 207 bp, Neocallimastix californiae
  ACP-like
tgtaatttattcttgcatggctgagattattccatctacggttcctttcgatgaatttaacatttatgatactttcacttcctcaggatttaactccattaattccgtaaagttaataaaattattaaatagcaaattaaagacaaactattccactgtcatgctctttaattttaattctccctatgaattagcgagagcattaat

SEQ ID NO: 14352 - DNA, 207 bp, Neocallimastix californiae; identical to SEQ ID NO: 14351
  ACP-like

SEQ ID NO: 14353 - DNA, 207 bp, Neocallimastix californiae
  ACP-like
tgtaatttattcttgtataactgaaattataccatctacagttcctttcgatgaatttaatattcatgacacttttacttcctcaggattcaactcaatcaattcagttaagctaataaaactattaaatagtaaattaaagacaaaatattctactgtcatgctattcaattataatacaccttatgaattagctaaagcattaat

SEQ ID NO: 14354 - DNA, 333 bp, Anaeromyces robustus
  ACP-like
attaatttatgaagctattaaagaaattgtaccttctacacctgaatttgaagaatttaatattaatgctccatttactatttatagtattgattctataggtacacgtaaattaacaaatattttaggtagaagaacaggaaaaccatttactacatctactttatttaattatggtactacttatgatcttgctaaatatattacaggttatactgataaagataaatttggtaaagatttaattccaaaatctattgttgctaataaaaaggatattaatagtaataaaattgctattattggtatggctttacgtttaccaggagctat

SEQ ID NO: 14355 - DNA, 333 bp, Anaeromyces robustus
  ACP-like
attaatttatgaatctattaaagaaattgttccttctactcctgaatttgaagaatttaatattaatgctccatttactatttatagtattgattctataggtacacgtaaattaacaaatattttagctagaagaacaggaaaaccatttacttcatctactttatttaattatggtactacttatgatcttgctaaatatattacaggttatactgataaagataaatttggtaaagatttaattccaaaatctattgcttctaataaaaaggatagtgatagtaataaaattgctattattggtatggctttacgtttaccaggtgctat

SEQ ID NO: 14356 - DNA, 345 bp, Anaeromyces robustus
  ACP-like
tatttatcaatctattaaagaaattattccatctactccttcttatgaagaatttaatccagaaagaccatttaatctttatggtattgattcacttgctactgttaaattaaccaatgttttatcaagaaaaatgggaaaacgttattcaccagctattcttttcaattatggtaattctcttgaattagcaaaattcataactaataatgaaaataaaaagaatactactaatactaaaaaggatgatttatcagctaaagaaagtattcctcgttcattaaatgaaggtggagttaaagaaaaaattgctattattggtatgtctttacgtttaccaggttc

SEQ ID NO: 14357 - DNA, 222 bp, Anaeromyces robustus
  ACP-like
tattaatgaaatcttaaagagagaagttcgtagaatgttaatgtataatgataatgatgaattagatgaattacaaccactttctgaattaggtttagattctattatgatgatggaattccgtcaaattattaaagctgttactaacattgttgtaccactttccattattacttcaccaaacttaaaccttaaagaaattatacaattccttgaaaataa

SEQ ID NO: 14358 - DNA, 267 bp, Anaeromyces robustus
  ACP-like
agaagataatgtttatgctattatggaaagtgaattaaagagaattcttcaatatagtgaaaatgatgaaattgatccatatcaatctttaacagaattaggtattgattctattatgatgatggaattacgtactattttaagaactgctacaggtgtaaatattccattagttgttttctcaacacaaaatatttgtctttcacgtcttgtagattatgttaaatctaaattagctaaagaaaaagaagaagctgctaaaaagac

SEQ ID NO: 14359 - DNA, 177 bp, Anaeromyces robustus
  ACP-like
atttgaagattttaatccagaaagaccatttaatttttatggtattgattctcttgctactattaaattaactaatattatttcaagaaaattaggtaaacgttatactccagctgttctttttaattatggtaatgctcttgaacttgctaaatttgtaactaataataatgataa

SEQ ID NO: 14360 - DNA, 87 bp, Anaeromyces robustus
  ACP-like
taccaataatactattcctcgttcattaaatgatgaaactcattatgaaaaaattgctattattggtatggctcttcgtttaccagg

SEQ ID NO: 14361 - DNA, 312 bp, Anaeromyces robustus
  ACP-like
tgttgctccagaaactgaaactgaaaaattaatatgtaatgtatatagtaaaacattaaatattgatgaaagtaaaattggaaaaatgagcgatttctttgaattaggaggtgatagtttaaacgctataagaattatatcaatgattgaaaaggaattgaatataaaactctatataaaagatatattatcgcatcctttagtaagtgaaattagcgaatatattgaagatatattaactaataataaaaattcatatcaaatggaagttataaagaaatataatagtaaagaattcccaataacttcaca

SEQ ID NO: 14362 - DNA, 249 bp, Anaeromyces robustus
  ACP-like
tgcaccaatatccaaagttgaaaagattatttgcaaaatttattcgaatgtatttaatattaacgaaaatagtgttggattaatgaatgaattttatgaacttggaggtgacagtttaattgttattagtattttatcattaattgaaaaagaattaaagataaaattaaatgttaaagatattctttcacatcctttaattaaagatttatgtgattatatagaaactattttaagtaataatgaaaa

SEQ ID NO: 14363 - DNA, 210 bp, Anaeromyces robustus
  ACP-like
tatgatttattcttgtattgtagaaattattccatctacagtaccatttaatgaatttaatgcagatgaagccttttcttcatttggattaaattcaattaattccattaaattaattaaattattaaatagtaaattaaaaacaaattattctactgttatgcttttcaattataattctccaacagaattagctaaagctttagctag

SEQ ID NO: 14364 - DNA, 279 bp, Piromyces finnis
  ACP-like
agaagataatatctatgaaattatggaacatgaattaaagaatgttctccaatacggtgaaaatgatgaaattgatccataccaatctttaactgaattaggtattgactctatcatgatgatggaattacgtactattatgagaactgccactggtatcaacattccattagttgttttctccactcaaaacatttgcctttaccgtcttgtagaatatgttaagagtaaaatggttaatgaaaagaaagaagaagccgatgctaagactccagttat

SEQ ID NO: 14365 - DNA, 333 bp, Piromyces finnis
  ACP-like
tattcgtattattcatgaatctattaaagaaattattccatctactccagattttttagaatttaatgcagaagccccatttactatatacggtattgaatctttagcaactattaaattagcaaacattttatcaagaaaattcaataaaagatattcaccagctattctttttaattatggtaccaccatgcttcttgctaaacatataactggatatgaaaacacaagttacagcagtcaattattggataaaatcccaaaggaattagataacaaaagctccaacaaaattgcaattattggtatggcacttcgtttacctggtgctat

SEQ ID NO: 14366 - DNA, 315 bp, Piromyces finnis
  ACP-like
taaagaaattattccttcaactcctgacttcgaattattcaatcctgaaaatcctttcaatatttatggtattgattcactctctactatcaaattaactaatatattatcaagaaaattgaataaatacttctctcctgccatcctcttcaactacggtaatacttatgctctcgctaaattcattactggaaatacagaaaaaagaaataaagactttaaagaatctattccttcttcttcacctcatgaaaagaaaaatagtgaaaagatcgctatcatcggtatgggtcttcgtttacctggcgctattaa

SEQ ID NO: 14367 - DNA, 213 bp, Piromyces finnis
  ACP-like
tcaagatattttaaagaaagaaattcgtagaatgttaatgtacaatgaagatgatgaaattgacgaaatgcaaccactttctgaattaggtatggattctattatgatgatggaattccgccaagttattaaagctgtcactgatattatgattccactttctattatttcttcaccaaatgtttatctttctaagatttaccaataccttaa

SEQ ID NO: 14368 - DNA, 276 bp, Piromyces finnis
  ACP-like
taaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagttgctgcaccagttgctgcaccagttgtcgctccagt

SEQ ID NO: 14369 - DNA, 282 bp, Piromyces finnis
  ACP-like
taaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagttgctgttccagctgttgctccagcaccagttgctgccccagt

SEQ ID NO: 14370 - DNA, 282 bp, Piromyces finnis; identical to SEQ ID NO: 14369
  ACP-like

SEQ ID NO: 14371 - DNA, 276 bp, Piromyces finnis
  ACP-like
taaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagttgctgcaccagttgctgcaccagttgtcgctcaatc

SEQ ID NO: 14372 - DNA, 276 bp, Piromyces finnis; identical to SEQ ID NO: 14368
  ACP-like

SEQ ID NO: 14373 - DNA, 279 bp, Piromyces finnis
  ACP-like
taaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagttgctgcaccagttgctgcaccagttgtcgctcaatcatt

SEQ ID NO: 14374 - DNA, 258 bp, Piromyces finnis
  ACP-like
aaagaatgaagttattaccaaattacaagatttattaggattagtagatgaagaaatagatgttaacgttccattacaagtttatggtttagattctttaacttcaatggaaattgttaaatggattgaaaatgataagaatgttgatcttccacaaactgcattattaaatagtgaaatcacaacagaagaacttattaatatgattgcaactaagattgttggtgaagataccattaaagcaccatcctacgatca

SEQ ID NO: 14375 - DNA, 273 bp, Piromyces finnis
  ACP-like
taaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagctgctgtttcagttgcttccccaattcaatcaaa

SEQ ID NO: 14376 - DNA, 306 bp, Piromyces finnis
  ACP-like
atccattaaagaaattataccatctactccagattttgatcaatttgatccagaaatgtcattcactatgtatggtatcgattctctctctaccgttaaattaacaaatattttatcgagaaagttaaagaagaactattctccttctattattttcaattatgcttctccacttttacttgctcaatatttatctcaaccaactcaaattaatccagttatgaaggatacccaaaaatcgttcaacagtaacaaatcaaatagtattgctattattggtatgggtttacgtcttccaggtgctat

SEQ ID NO: 14377 - DNA, 357 bp, Neocallimastix californiae
  ACPS
aattggtgttgatattgaattagttaccgaggttccaattaccaatgaaaacttccttgaaagaaatttcactaaggaagaaattaagtactgtatgagtagaccagatccacaatctagctttgctggtagatggagtgctaaggaagctgttattaaggcagtatcttctcgtgctacttctaaggtttggactaaaggtgaagctgccccacttattgatattgaaattttacctggtgaatcaggtgccccagtggttaaattttataatgatgctgaaaaagctgttaaagatgctggtattaacaatgttaaagttactatttctcattctggtggtttctcttgtgctat

SEQ ID NO: 14378 - DNA, 357 bp, Neocallimastix californiae
  ACPS
tattggtgttgatattgaattagttactgaaattccaattaataatgaaaatttcattgaaaggaactttacaaaggaagaaattaaatattgtatgagtagaccagatccacaatctagttttgctggtagatggagtgctaaggaagctgttgttaaggctgtttcttctcattcctcctctaaagtttggactaaaggtgaagctgccccactcattgatattgaaatcttaccaggtgaatcaggtgctcctgttgtccaatttcataatgatgctgaaaaagctgttaaagaagccggtgttaaaagtgttaatgttactatttctcattctggtggtttctcttgtgctat

SEQ ID NO: 14379 - DNA, 363 bp, Anaeromyces robustus
  ACPS
tgttggtatagatattgctcttatctctgaattaaatgttgataatgaaggatttattgaacgtaatttcactaataatgaaattcaatattgtgaagctaaaccagatagacgttctagttttgctggtaaatgggccgctaaagaagctgttataaaggctatttcttcttattccttagaagctcaaaaaatatgggaaggtgctggtgctccattaaaggatattgaagttgttattgctgaatctggagctccaaaagttcttttaagtccaactttaaatgaaaaggttaaatctgttggtgttaatgatgttaaggttactattagtcattccggtcaatttgctgttgctatggc

SEQ ID NO: 14380 - DNA, 357 bp, Anaeromyces robustus
  ACPS
tattggtgttgatgttgaattagttagtgaaattccaattactaatgaaactttcttagaaagaaatttcacaaaggatgaaattacttattgtatgagtagaccagatccacaatctagttttgctggtagatggtctgctaaggaagctgttataaaggctgtttcttctcgtgctacttcaaaagtttggactaaaggtgaagctgccccacttgtagatattgaaattttaccaggtgaatcaggtgccccagttgttaaattccataatgatgctgaaaaggctgttaaagatgccggtattaaagatgttaaagttaccatttctcattctggtggtttctcttgtgctat

SEQ ID NO: 14381 - DNA, 357 bp, Piromyces finnis
  ACPS
tattggtgttgatgttgaattagtaactgaaattccaatttccaatcaaaatttccttgaaagaaactttactccaaaggaaattgaatactgtatgagtagaccagacccacaatctagctttgctggtagatggtccgctaaggaagctgttatcaaggctgtttcttctcgttccacttctaaggtttggactaaaggtgaagccgcaccattagtagatattgaaattttaccaggtgaatccggtgctccagttgttgaattccatggagatgctgaaaaggctgttaaagaagctggaattaatagtgtaaaagtaactatttctcattctggtggtttctcttgcgctat

SEQ ID NO: 14382 - DNA, 363 bp, Piromyces finnis
  ACPS
tgttggtgttgatgttgctttaatttctgaaataaatattgaaaatgaaagtttcgtagaacgcaactttacttcaactgaaataaattactgtaagagcaaaccagatgctcgctctagctttgccggtagatgggctgctaaggaagccgttattaaggctatttcctcatattcattagaagctcaaaagatctgggaaggtgctggtgctccattaaaggacattgaagttgttatggctgaatctggtgctccaaaggttcttttaagtcaagaattaaaagacaagattaagtctgttggtgttaatgatgttaaggttactatcagccactctggtcaattcgctattgctatggc

SEQ ID NO: 14383 - DNA, 357 bp, Piromyces finnis; identical to SEQ ID NO: 14381
  ACPS

SEQ ID NO: 14384 - DNA, 363 bp, Piromyces finnis; identical to SEQ ID NO: 14382
  ACPS

SEQ ID NO: 14385 - DNA, 264 bp, Neocallimastix californiae
  Acyl_carrier_prot-like
agaattaaatgaggataatattttcgaagttatggaattagaattgaaaaaggttcttcaatacggtgaaaatgatgaaattgatccttatcaatccttatctgaattaggtattgattccattatgatgatggaattacgtaccattttaaagaatgttacaggaattaatattcctttggtagtattctccactcaaaatatttgtctttaccgtcttgtagaatatgtcaagaccaagttagtgaaggaaaaggaagaagc

SEQ ID NO: 14386 - DNA, 270 bp, Neocallimastix californiae
  Acyl_carrier_prot-like
tgctaagaagaaatctgttactaaagataatattccagaaattttaaaggaggaagttcgtagaatgttaatgtataatgaaaatgatgaattagatatcttccaacctctctctgaattaggtattgattctattatgatgatggaacttcgtcaaattattaaggctgtaactaatattactgttccactttctattattaccacgccaaacttaacactctctaagatctttgaatatcttaagggtaagatgaatggtaatagtgg

SEQ ID NO: 14387 - DNA, 285 bp, Neocallimastix californiae
  Acyl_carrier_prot-like
tcatgaatcaattaaggaaattattccttctactccagaatttaataaatttaatccagatgcgcccttcaccgtatatggtattgattccctatcggttatcaagttaaccaacgtcttgtcaagaaaattcaataaaaagtattctcctgctattctttttacctatggtacgacggcttctcttgccaaatatttaaaaggttatgaaaatattagctatcttccctctcaagaaaaagaccatggagcctccagtaataaaaagattgcaatcattggtat

SEQ ID NO: 14388 - DNA, 240 bp, Neocallimastix californiae
  Acyl_carrier_prot-like
aactagtggtcttaacaaggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatgga

SEQ ID NO: 14389 - DNA, 237 bp, Neocallimastix californiae
  Acyl_carrier_prot-like
tagtggtcttaataaggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattataatgga

SEQ ID NO: 14390 - DNA, 240 bp, Neocallimastix californiae
  Acyl_carrier_prot-like
tagtggtattaacaaggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcaatcaaagtcaattattaggtgatgatattactactgaagatttaattaatattattatggatga

SEQ ID NO: 14391 - DNA, 231 bp, Neocallimastix californiae
  Acyl_carrier_prot-like
agctttgaaaaatgaagtagttgaaaaattacaagatttattaggtttagttgatgaaaatattgatactaatgtaccattgcaagtttatggtttagattctttaacttcaatggaaattgttaaatgggttgagaatgataaaaaagtagaactaccacaatcagctttattaagtagtgaaattactactgaagaacttgttaatatgattgcatcaaagattactgg

SEQ ID NO: 14392 - DNA, 282 bp, Neocallimastix californiae
  Acyl_carrier_prot-like
aaagaatgaaatatgtgatagattacaaaatatgttaggtttagtagatgaaaaaattgatccagctattccacttcgtgtttatggtttagattccttaactactatggaattaaccaattggattcaaagtgaattaaaggttacattaccacaaagtcaattattaagtgatgagataactacaaatgaattagttagtataattattaatttattagctaataataataataataataatggaacaaatttctataatgccccatctaacaataatag

SEQ ID NO: 14393 - DNA, 243 bp, Neocallimastix californiae
  Acyl_carrier_prot-like
accaactagtggtcttaacaaggataaattaactaaggatattacagaaaaattacaaagtatgttaggattaattgatgaagaaattgatgttactattccacttcgtgtctatggtttagattctttaacagctatggaattaaccaaatggattgaaagcgaaatgaatattgaattcagtcaaagtcaattattaggtgatgatattactactgaagatttaattaatattattatgga

SEQ ID NO: 14394 - DNA, 243 bp, Neocallimastix californiae
  Acyl_carrier_prot-like
tcttaataagaataaattaaccaaggatattactgataaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatggttcttcttc

SEQ ID NO: 14395 - DNA, 231 bp, Neocallimastix californiae
  Acyl_carrier_prot-like
caaggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatggttc

SEQ ID NO: 14396 - DNA, 237 bp, Neocallimastix californiae
  Acyl_carrier_prot-like
cagggataaattaactaaggatattacagaaaaattacaaagtatgttaggattaattgatgaagaaattgatgttactattccacttcgtgtctatggtttagattctttaacagctatggaattaaccaaatggattgaaagtgaaatgaatattgaattcagtcaaagtcaattattaggtgatgatattactactgaagatttaattaatattattatggatggttcttcttc

SEQ ID NO: 14397 - DNA, 294 bp, Neocallimastix californiae
  Acyl_carrier_prot-like
gtcaataaaggaaattattccttcaactccagagtttgaaaaatttgatccagaatctccatttactgtttatagtatcgattctcttgctattattaaattaaccaatattttatcaagaaagttcaatgagagatactctccagctattctttttaactatggtaccaccagtcttcttgctcaatatataacgggtcatgacagtgataacattaacattaataaaactatgaataatatacaaatgccaaaggaaagtaattccaaaacttctgataaaatcgccattat

SEQ ID NO: 14398 - DNA, 327 bp, Neocallimastix californiae
  Acyl_carrier_prot-like
agaaattcaaaaagcagtaatgattgtttatgaatccattaaagaaattattccttctactccagattttgaagatttcaatattaatgcaccatttactatctacagtattgattctcttgctaccagaaaattaactagtgttttaaatcgaaagaccttaaaaccattctctgcttccaccttatttaactatggtactccatatgatcttgcgagatatattactggttatgataaaaagttgaaagagaaagcttctcctctttcttcccttccaaaatcgattaaggatgtttcgatggataaaagagtggcagtgattgg

SEQ ID NO: 14399 - DNA, 255 bp, Neocallimastix californiae
  Acyl_carrier_prot-like
ttttgaacagttcgttcctgaaaagtcctttaccatgtatggtatcgattctttaactactgtcaagctaactaaccttctctctcgcaaattaaagaaaaactactctccttccattattttcaactatgcctctccattacttttagctaaatatttagcccaaccaacgcaacttgcttcatccttaaaagctggtccaaccaatgatagtagttgttgtaatcgcaaatccaatgcgatcgccatcattgg

SEQ ID NO: 14400 - DNA, 300 bp, Neocallimastix californiae
  Acyl_carrier_prot-like
gcttatttatcaatcaatcaaggaaattattccatctaccccagaattcgaatctttcaacccagaaagtccattcacaatctatggtattgattctctttcaactattaaattaactaatgtattatcaagaaaattgaataagcattactcaccagctattcttttcaactatggtaatacttttgaactcgctaaattcttatctggtaatgttgatcaaaagaatgtatcagaaattcgtgaatctattccagcttccttaaatgaaaaacagtctaatggaaaaattgctattat

SEQ ID NO: 14401 - DNA, 288 bp, Neocallimastix californiae
  Acyl_carrier_prot-like
tcttaataaggacaaattaaccaaagatattactgaaaaattacaaagtatgttgggtttaattgatgaagaaattgatgttaccattccacttcgtgtctatggtttagattctttaactgctatggaattaaccaaatggattgaaagtgaaatgaatattgaattcagtcaaagtcaattattaggagatgatattactaccgaagatttaattaatgtcatcatggatggttcctcttcagctccggctccagctgctgccccagtatctcaagcaaaaccttt

SEQ ID NO: 14402 - DNA, 315 bp, Neocallimastix californiae
  Acyl_carrier_prot-like
tcttaataaggacaaattaaccaaggatattactgaaaaattacaaagcatgttaggtttaattgatgaagaaattgatgttaccattccacttcgtgtctatggtttagattctttaactgctatggaattaaccaaatggatagaaagtgaaatgaatattgaattcagtcaaagtcaattattaggagatgatattactactgaagatttaattaatgttatcatggatggttcctcttcagctccggctccagctgctgctccaattgctcagacaaagtctttccaaccaactccaattgccccagtatc

SEQ ID NO: 14403 - DNA, 255 bp, Neocallimastix californiae
  Acyl_carrier_prot-like
taaggacaaattaaccaaggatattactgaaaaattacaaagcatgttaggtttaattgatgaagaaattgatgttaccattccacttcgtgtctatggtttagattctttaactgctatggaattaaccaaatggatagaaagtgaaatgaatattgaattcagtcaaagtcaattattaggagatgatattactactgaagatttaattaatgttatcatggatggttcttcttcagcttcggttccagttca

SEQ ID NO: 14404 - DNA, 252 bp, Neocallimastix californiae
  Acyl_carrier_prot-like
ggaaatttctaaagataatatctttgagattatggagaccgaattaaagagaattcttcaatacggtgaaaatgatgaaattgatccttaccaatccttaaccgaattaggtattgattcccttatgatgatggaattccgtactatcctaaagaatgttactaccgtcaatattccattagtcgtcttctccacccaaaatatttgtctcttccgtcttgtcgagtacgttaagggtaaattatcgaagga

SEQ ID NO: 14405 - DNA, 201 bp, Neocallimastix californiae
  Acyl_carrier_prot-like
ggctgagattattccatctacggttcctttcgatgaatttaacatttatgatactttcacttcctcaggatttaactccattaattccgtaaagttaataaaattattaaatagcaaattaaagacaaactattccactgtcatgctctttaattttaattctccctatgaattagcgagagcattaattagtccccaatc

SEQ ID NO: 14406 - DNA, 201 bp, Neocallimastix californiae; identical to SEQ ID NO: 14405
  Acyl_carrier_prot-like

SEQ ID NO: 14407 - DNA, 201 bp, Neocallimastix californiae
  Acyl_carrier_prot-like
aattataccatctacagttcctttcgatgaatttaatattcatgacacttttacttcctcaggattcaactcaatcaattcagttaagctaataaaactattaaatagtaaattaaagacaaaatattctactgtcatgctattcaattataatacaccttatgaattagctaaagcattaataagcttgcacactgaatc

SEQ ID NO: 14408 - DNA, 297 bp, Anaeromyces robustus
  Acyl_carrier_prot-like
ttatgaagctattaaagaaattgtaccttctacacctgaatttgaagaatttaatattaatgctccatttactatttatagtattgattctataggtacacgtaaattaacaaatattttaggtagaagaacaggaaaaccatttactacatctactttatttaattatggtactacttatgatcttgctaaatatattacaggttatactgataaagataaatttggtaaagatttaattccaaaatctattgttgctaataaaaaggatattaatagtaataaaattgctattat

SEQ ID NO: 14409 - DNA, 324 bp, Anaeromyces robustus
  Acyl_carrier_prot-like
agaaattcaagaagctattaaattaatttatgaatctattaaagaaattgttccttctactcctgaatttgaagaatttaatattaatgctccatttactatttatagtattgattctataggtacacgtaaattaacaaatattttagctagaagaacaggaaaaccatttacttcatctactttatttaattatggtactacttatgatcttgctaaatatattacaggttatactgataaagataaatttggtaaagatttaattccaaaatctattgcttctaataaaaaggatagtgatagtaataaaattgctattat

SEQ ID NO: 14410 - DNA, 321 bp, Anaeromyces robustus
  Acyl_carrier_prot-like
ttatcaatctattaaagaaattattccatctactccttcttatgaagaatttaatccagaaagaccatttaatctttatggtattgattcacttgctactgttaaattaaccaatgttttatcaagaaaaatgggaaaacgttattcaccagctattcttttcaattatggtaattctcttgaattagcaaaattcataactaataatgaaaataaaaagaatactactaatactaaaaaggatgatttatcagctaaagaaagtattcctcgttcattaaatgaaggtggagttaaagaaaaaattgctattattggtat

SEQ ID NO: 14411 - DNA, 267 bp, Anaeromyces robustus
  Acyl_carrier_prot-like
taatgaaatcttaaagagagaagttcgtagaatgttaatgtataatgataatgatgaattagatgaattacaaccactttctgaattaggtttagattctattatgatgatggaattccgtcaaattattaaagctgttactaacattgttgtaccactttccattattacttcaccaaacttaaaccttaaagaaattatacaattccttgaaaataagaatcaagataaatctactacaggtacatcatctacatcaaatgttcc

SEQ ID NO: 14412 - DNA, 246 bp, Anaeromyces robustus
  Acyl_carrier_prot-like
tacagaagataatgtttatgctattatggaaagtgaattaaagagaattcttcaatatagtgaaaatgatgaaattgatccatatcaatctttaacagaattaggtattgattctattatgatgatggaattacgtactattttaagaactgctacaggtgtaaatattccattagttgttttctcaacacaaaatatttgtctttcacgtcttgtagattatgttaaatctaaattagctaaaga

SEQ ID NO: 14413 - DNA, 255 bp, Anaeromyces robustus
  Acyl_carrier_prot-like
tgttaaagaaattattccttctactcctgaatttgaagattttaatccagaaagaccatttaatttttatggtattgattctcttgctactattaaattaactaatattatttcaagaaaattaggtaaacgttatactccagctgttctttttaattatggtaatgctcttgaacttgctaaatttgtaactaataataatgataaaaagaatacaaaattattaaataaaaaaaataataatgataaatttat

SEQ ID NO: 14414 - DNA, 201 bp, Anaeromyces robustus
  Acyl_carrier_prot-like
ttgcaaaatttattcgaatgtatttaatattaacgaaaatagtgttggattaatgaatgaattttatgaacttggaggtgacagtttaattgttattagtattttatcattaattgaaaaagaattaaagataaaattaaatgttaaagatattctttcacatcctttaattaaagatttatgtgattatatagaaactat

SEQ ID NO: 14415 - DNA, 201 bp, Anaeromyces robustus
  Acyl_carrier_prot-like
atgtaatgtatatagtaaaacattaaatattgatgaaagtaaaattggaaaaatgagcgatttctttgaattaggaggtgatagtttaaacgctataagaattatatcaatgattgaaaaggaattgaatataaaactctatataaaagatatattatcgcatcctttagtaagtgaaattagcgaatatattgaagatat

SEQ ID NO: 14416 - DNA, 204 bp, Anaeromyces robustus
  Acyl_carrier_prot-like
tgtagaaattattccatctacagtaccatttaatgaatttaatgcagatgaagccttttcttcatttggattaaattcaattaattccattaaattaattaaattattaaatagtaaattaaaaacaaattattctactgttatgcttttcaattataattctccaacagaattagctaaagctttagctagtagtaaaaatag

SEQ ID NO: 14417 - DNA, 267 bp, Piromyces finnis
  Acyl_carrier_prot-like
gaaggaaatttcagaagataatatctatgaaattatggaacatgaattaaagaatgttctccaatacggtgaaaatgatgaaattgatccataccaatctttaactgaattaggtattgactctatcatgatgatggaattacgtactattatgagaactgccactggtatcaacattccattagttgttttctccactcaaaacatttgcctttaccgtcttgtagaatatgttaagagtaaaatggttaatgaaaagaaagaaga

SEQ ID NO: 14418 - DNA, 249 bp, Piromyces finnis
  Acyl_carrier_prot-like
agaatttaatgcagaagccccatttactatatacggtattgaatctttagcaactattaaattagcaaacattttatcaagaaaattcaataaaagatattcaccagctattctttttaattatggtaccaccatgcttcttgctaaacatataactggatatgaaaacacaagttacagcagtcaattattggataaaatcccaaaggaattagataacaaaagctccaacaaaattgcaattattgg

SEQ ID NO: 14419 - DNA, 252 bp, Piromyces finnis
  Acyl_carrier_prot-like
cgaattattcaatcctgaaaatcctttcaatatttatggtattgattcactctctactatcaaattaactaatatattatcaagaaaattgaataaatacttctctcctgccatcctcttcaactacggtaatacttatgctctcgctaaattcattactggaaatacagaaaaaagaaataaagactttaaagaatctattccttcttcttcacctcatgaaaagaaaaatagtgaaaagatcgctatcat

SEQ ID NO: 14420 - DNA, 171 bp, Piromyces finnis; identical to SEQ ID NO: 14321
  Acyl_carrier_prot-like

SEQ ID NO: 14421 - DNA, 294 bp, Piromyces finnis
  Acyl_carrier_prot-like
caaggataaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagttgctgcaccagttgctgcaccagttgtcgctccagttgttgctcaatc

SEQ ID NO: 14422 - DNA, 270 bp, Piromyces finnis
  Acyl_carrier_prot-like
caaggataaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagttgctgttccagctgttgctccagc

SEQ ID NO: 14423 - DNA, 270 bp, Piromyces finnis; identical to SEQ ID NO: 14422
  Acyl_carrier_prot-like

SEQ ID NO: 14424 - DNA, 285 bp, Piromyces finnis
  Acyl_carrier_prot-like
caaggataaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagttgctgcaccagttgctgcaccagttgtcgctcaatcatt

SEQ ID NO: 14425 - DNA, 294 bp, Piromyces finnis; identical to SEQ ID NO: 14421
  Acyl_carrier_prot-like

SEQ ID NO: 14426 - DNA, 285 bp, Piromyces finnis; identical to SEQ ID NO: 14424
  Acyl_carrier_prot-like

SEQ ID NO: 14427 - DNA, 276 bp, Piromyces finnis
  Acyl_carrier_prot-like
caaggataaattaactaaggatatctctgaaaagttacaaagtatgttaggtttaattgatgaagaaattgatgttactattccacttcgtgtctacggtttagattccttaactgctatggaattaaccaaatggattgaaagtgaaatgaacattgaattcagtcaaagtcaattattaggagatgatattactactgaagatttaattaatgttattatggaaggttcatcttcagctccagctgctgtttcagttgcttccccaattcaatc

SEQ ID NO: 14428 - DNA, 237 bp, Piromyces finnis
  Acyl_carrier_prot-like
tttaaagaatgaagttattaccaaattacaagatttattaggattagtagatgaagaaatagatgttaacgttccattacaagtttatggtttagattctttaacttcaatggaaattgttaaatggattgaaaatgataagaatgttgatcttccacaaactgcattattaaatagtgaaatcacaacagaagaacttattaatatgattgcaactaagattgttggtgaagatac

SEQ ID NO: 14429 - DNA, 267 bp, Piromyces finnis
  Acyl_carrier_prot-like
aattataccatctactccagattttgatcaatttgatccagaaatgtcattcactatgtatggtatcgattctctctctaccgttaaattaacaaatattttatcgagaaagttaaagaagaactattctccttctattattttcaattatgcttctccacttttacttgctcaatatttatctcaaccaactcaaattaatccagttatgaaggatacccaaaaatcgttcaacagtaacaaatcaaatagtattgctattattgg

SEQ ID NO: 14430 - DNA, 876 bp, Neocallimastix californiae
  Acyl_transf_1
cacaggtcaaggcagtattaagccaggagttggtaaggaattatttagaacccaacccgtcttccgtgccgctatggaaaagtgtgatgctgtggttaagaagtctaccggaatttctattcttgatgccctctatgatcaaaatcaaggtcatcacttaaagaaggctcaaattgctcaacctgctttattcgcttatgaatatgctatgtacatgctttggaaatcttggggtattaagccagtcattgttaatggtcacagtttaggtgaaattgttgccgctgccgccaccggcgctatagatattgatttagccattgatttcattattgaaagagccagatgcatgggtgaatatggtgaaaagccaggagctatggttagtgttttccaaagtgaagatgtcgtcaaggaagcaattgaagaatttggttatgaagaagaagtttcaattgccgctatcaatggtgtaactcatactgttatttccggttatgaagatgaagttgatgatcttaccgagtatttcaatgaaatgaaggttaagactaaaaagttaaacgttaccgatgccttccattctccattaatggacccagccattgaagaattaaatggttggattgaagaaaagaatgatgcccagttcagacaaactttaaaggtaaagttcatttccaacgttgatagtaccattaagcctgtcggtgatcgtcttgaaaaggattactggggtaagcatgctagaaatgccgttcgtttcgttgacggtgtaaagtctatgattgaatccgaaaagaagttattggctgtcattgaagttggtccagccgccacgttgaccaacatgagttctcgtttcgttcgtgaaac

SEQ ID NO: 14431 - DNA, 921 bp, Neocallimastix californiae
  Acyl_transf_1
tgcttttactggtcaaggtgttgctaaggttggtatgggtaagcacttctaccaaactcaaccagttttccgtgaagctatggacagatgtgatgctgttactcgtcgtcttcttggcgtttccattgttgaggttttatataatgtttcaaacattccaaatggtactgaagaaggtgaaaaggctctcaagaagtcctctgttgcccaaccagctttattcgcttatgaatatgctatgagtcaattatggattagttggggaattaaaccatctatggttcttggtcattcacttggtgaaattgttgccactaccattgctggtggtattgactttgaattagctatggaattcattgttgaaagagcttcatgtatggaaaagtatggtattaagccaggtgctatggtttctatcttcactactgaagatgttgtcaaagaagctattgaagaatttgaatttgaaaatgtttccattgctgctattaatggtacaactcaaattgttatttctggtaatgcagatgaagtaaaagaattagaggaatactttattgaacaggatattaaggctaaacaattaaatgttactgaagctttccactctgctttaatggatccagctattgaaaagttatacgaatggattgatagtaagccagatgaaaaattccgtcaaccattaaaatatggtcttatttctaatgttactggtaagcttattccagctggtgaacgtcttccaaagaactactggggtgagcatgctagaaatgctgttcaatttgttaaggctgttgaaaccttattagccaatagtgaaactttattaaatgttattgaagttggtccagcttccgttttaactaacatgagttctcgtattttacgtgaaaagaaggttgataagtttgc

SEQ ID NO: 14432 - DNA, 867 bp, Neocallimastix californiae
  Acyl_transf_1
cactttttcaggacagggtactcaatatcctgatatgggtcgacaactgtatcattctaacccttattttgctaatattattgactattgtaacgaaatcgttctttccatctccaaaaaagatttattaaaggaaaccggtttattcggtgatttgccagtaaatgaagaaaacttaatggatcctcaatattccttcttagcgatcggtattattcaattggctcttgtagaattttggaaggcctatggtgtagaaccttcattggtctttggtcatagtatgggtgaagtagctgctgcatatgctgcgggtattttaactttagaagatgccattctcctactgtatcattatggtcttatcagtcaaaatttggaggaaaataatgagaagagtggattaattgctttaggttgtggcgtagatgaagctaaaactgaatatataaaggataggaagaaggtctatattgcttccattaatagttacaaggatgttacgcttggtggtgatctcaaccaattggaagagatcatggatcaagcaaaacaaaaaaatgtcttcaccgttatgctaaaggtcaataaggctttccataccccattcattctttcagctaaggagaaattccttaaaggtattgaaggtattcatttaagagttcagccaccaaagattccattcatctcttctactcatggtaatgaatatcaaggtccatttgatgccaactattggtggtccaatattattaatccagtgaactttagtcaagcagtaaaaattgctcataccaaggttgataaggtcttagaaattagtagtacgccagttttaggtatctatataagtagtgtcttcca

SEQ ID NO: 14433 - DNA, 873 bp, Neocallimastix californiae
  Acyl_transf_1
tgctttttctggtcaaggttctcaatttataaatatgggtagacgtatgtatcaagtaaatggtcttttcaagagaattgtagactattgtgctgccgttcttgttacctacaatggtggtgaagatatttttgaaaagtaccatattttcaagggtgatgtttctcaaattagtgaagctgatctttctcttccacaatactctattcttgctattggtgttgctcaaattgctcttactgaaatttggaaggctatgggtgttactccagaagctgtttttggtcacagcatgggtgaagttgctgctgcctatgctgctggtattcttacacttgaagatgctatcttattattatacatgcgtggacatattcttgctcaattagatggtaccggaaaaggtatgctagctcttggatgttccgttgagcaagctcaatacttcatgaataataagccaaatgttttcatttctgctgttaatagtgctaactctatcactttagccggtgatattagccaaattaatgctatcgctcaagaagctaaggctcaaaacctcttcgctgttgttttaaaggttaagcaagctttccattctccatatgttgaaggtgctgaacaagcctttaaggaaagcattagaggtattagtgaacgtacttccgctccaaagtgtaaatttatttctgcatgctttggtcaagaatatgaaggtccatttgatgaaaactactggtgggctaacattcgaaatccagtaagtttctatgctgctgctagtattggtactcaattctctaaacgtgtattggaaattggtgctcacccagttcttagtgtgtatcttaaagaaatttatggtaaaga

SEQ ID NO: 14434 - DNA, 1104 bp, Neocallimastix californiae
  Acyl_transf_1
cgttttcactggtcaaggtgctcaagaagttggtatgggtcaagatctctacaacaaatctgctgttgccaaggctgtttgggatagagctgatgcctacttaatgaagaagtacggttactctatcttggaaattgttcgtactaatccaaagtcccttaccgtttactttggcggtgaagatggtgaaaagattcgtgaaaactatatcaatatgacttgtgaaattattgattctaatggaaaggttcaaaccaaacgtatgttcccagaaattgatgaaaacaccctctactatgaatacaaatccccaactggtttgttaaatgctactcaattcactcaaccagcaattacccttactgaaaaggctgcctttgaagatatgtatgaaaagggttacatttgtgatgatgcagtttacgccggtcactctcttggtgaatacgctgctctttcctgtgttgctaacaccttaagtattgaaagtatggctgaaattgtcttctaccgtggtcttgtcatgcaatcctctgtcgaaagagatgaattaaaccgttctgactacgctatgtgtgccgttaatccagttcgtgtccatccatacttctcattcgatttattagttgaagttgtaaagaagattaacgccgaacatggtggtctcttggaaattgtaaactacaatgttgaaaactatcaatacgttgttaccggtgacttaacctctcttgaagctcttaagaacttattaactaatcttcgtgctgaagctaagaagttcatcaccttatacaaggaagatgctactcaagctatggaacttttaaacgaaaaggttcgtacctacgttaaattagctgaagaacgtaaggctaaggaaggtttcttcaatattgaaagaggtgctgctactattccacttcgtggtattgatgttccattccactccagttacttactttggggtgttccaaccttccgtgaattacttcaccaacgtgtccgtcgtgaagatgttgatgttaaatgtcttgttggtcgttacattccaaacttgatgggtgaaccattctctgttgaaaaggattatgctattcgtct

SEQ ID NO: 14435 - DNA, 813 bp, Neocallimastix californiae
  Acyl_transf_1
ttttgtatttagaggaatgagccaattaaattcaaatattggctatagtttataccaatataaccaaaaatttgccgaaattgttgattactgtgataaggtacttgaaaaggtaagtggtggcgtttgctcacttaagagagaatttggtttattccaatcagaaaatttgaatttcctttctcttcaaaatccaaagatgtcaattattggtaatggcatgatacaattggctttgggtcatctattaaagagctatggtattaaaccatcttctgttgttggttacaattctggtgaaatcgctgctgcttatacagcaggtattattagtttagaggatgctatcttagttttatatcaatacagtactattttagaaaaagttccaaacaaaaagaatattttcactcttgaacttggatgttcagctggtcaagctcaaactaatattataaatcaattatccagtactatctatatttcaggtaataatgctgataatatttgtacactctgtggtagcagagaaagtcttaatcaagctgtttcaatcgcacagcaaaatggtattccagttttatctaatttaattccaggttcttgtggtatttgtacaccatatctaaatgattttaaggatgaattctttgcttcattaaagggtattggtaataattgcaagaccccagttattaaatttatttctacgactttgggacaaccatttaatggaccattaaatgaatattattggtgggcaaatttatcaagtactgtaaactttagtcatgctctttctcttgcaatgaa

SEQ ID NO: 14436 - DNA, 1080 bp, Neocallimastix californiae
  Acyl_transf_1
tgtcttcactggtcaaggtgctcaagaagtaggtatgggtatggacttgtatgaaaagtcaccagtagctagagaaatttgggatcgtgctgatgctcacttgatggaaaattatggtttctctattattgatattgttaagaataatccaactgaaattactatctactttggtaatgttaagggtcaacaaattcgtaagaattatcaacagatgacttatgaacatgttaattctgatggtgttgttgaaagtctttcactcttcccagaaattgatgacgacagtgtttcctacaccttccgtcacattggaggtttattatcggctactcaattcacacaaccatcccttgttttaatggaaaaggctgcttttgaagaaatgagatctcgtggtttcattcaacaaaacagtgcttttgctggtcatagtttaggtgaatatgctgccttaactgctattggtgatgtcttaagtattgaaacgttggttgatgtcgttttctatcgtggtatgactatgcaaagagccgttcaacgtgattctaagggtcgttccgattatgctatgtgcgccgttaatccaactcgtgttagccgtactttcaacgaaagtgccttacaatatcttgttgctaacattaagaaggttactgaaggtttaattgaaattgtaaactacaatgttgataactggcaatatgttgtttctggtgatcttatttccttacaagttcttactcttgtcttaaactacttaaaggctgaaaagattgatttaactgttttattgaacactctttctgttgaagaagttcaaaagcaagttaatgaaattattagtacttcctttgaaaaggctaaggaacaaaagaaaaagcatggctatattaaattagaacgtggtgctgcttctattccattacgtggtattgatgttccattccactctagtttcttattaagaggtgttgctccattccgtcaatacttgatgagtaagtttgatccaaacttgattgacgttaaccgtttaatcggtaattatattccaaacttaactgctgaaccattctc

SEQ ID NO: 14437 - DNA, 1080 bp, Neocallimastix californiae; identical to SEQ ID NO: 14436
  Acyl_transf_1

SEQ ID NO: 14438 - DNA, 819 bp, Neocallimastix californiae
  Acyl_transf_1
tttctattgtaataatagctactttgctgactgcattgattattgtgatcaggtattaaagatgataagtggacgttctcttcttgaagattatggtcttttccaatccgtaaaggaagaagaaaaggaaaaggaaaaggaaaagaaaaacaaattaagagaagatcttctcaaggatcctactactactcttttaattaatggtataattcaattaggattagtggcactctaccgttattatggcatttctccaaatgcagttattggttatggtgctggtgaaattgctgctgcctatgctgcagaaaagatagatttaaaatcggctgttcaaattctttatcattatggaagggtattatcgatggtgaagaaggatgataatctatccaaggtgtatagtatcttggtaggttgtcctgttggtaaattgagtcaggtgatactttccaagttaagtccaacggagaaggaattaatttcgatttccggagttccttctccaacgcaatgtgtattgaatggagaaatggaaatactaaagaagattatggagcaagcaaagactgaaaagattccaatacttggtagcctaatggattctttcgccatccacaccaaaaagatttctgaagcaatgaaggaagaactggtaaagcgtttaacgaacattaaatccaagccttcctccattgccatgttctcgaccaccaaattcagtaaagaaggaaagccatataccgacgcattagatggtcagtactggtggatgaatatgagaaatccagtgctctatgctcattccctctcccaaac

SEQ ID NO: 14439 - DNA, 1080 bp, Neocallimastix californiae
  Acyl_transf_1
tgttttcactggtcaaggtgctcaagaagttggtatgggtatggatttgtatgaaaagtctccagttgcaagagaaatttgggatcgtgcggatgctcacttaatggaaagctatggtttctccatcattgatattgtcaagaataacccaaccgagattactatttactttggtaatgttaagggtcaacaaattcgtaagaactatcaacaaatgacttatgagcatgttaatgctgatggtgttattgaaagtctttcactcttcccagaaattgatgatgacagtgattcttatactttccatcacattggaggtttattatcggcaactcaattcactcaaccatcgcttgttttgatggaaaaggcagctttcgaagaaatgagaactcgtggtttcatccaacaaaatagtgctttcgctggtcacagtttaggtgaatatgccgccttaactgctattggtgatgtcttaagtattgaaaccttagtggatgtcgtcttctatcgtggtatgaccatgcagagagctgttcaacgtgattccaagggtcgttctgattatgctatgtgtgccgtcaacccaacgcgtgttagccgtactttcaatgaaagtgctttacaataccttgttgccaacattaagaaggttactgaaggtttaattgaaattgtcaactacaatgttgataactggcaatatgttgtttctggtgatcttatttccttacaagttcttacgcttgtcttaaactacttaaaggctgaaaagattgatttaactgttttattaaatacactttcagtggaagaagttcaaaaacaagtaattgaaatgatcactaccgcctttgaaaaggctaaggatcaaaagaagagacatggattcattaaattagaacgtggtgctgcttctattccattacgtggtattgatgttccattccactctagcttcttattaagaggtgttgctccattccgtcaatacttaatgagtaaatttgatccaaacttgattgatgttaatcgtttaatcggtaattatattccaaacttaactgctgaacccttctc

SEQ ID NO: 14440 - DNA, 1095 bp, Neocallimastix californiae
  Acyl_transf_1
cgttttcactggtcaaggtgctcaagaagttggtatgggtcaagaactctacaacaaatctgctgttgccaaggctgtttgggatagagctgatgcctacttaatgaagaagtatggttactctatcttagaaattgttcgtactaatccaaagtctcttaccgtctactttggtggtgaagaaggtgaaaagattcgtgaaaattacatcaacatgacctgtgaaattattgattccaacggaaaggttcaaaccaagcgtatgttcccagaaatcgatgaaaacactctctactacgaatacaagtccccaactggtttattaaatgctactcaattcactcaaccagctattactcttactgaaaaggctgcctttgaagatatgctcgaaaatggttacatctgtgatgatgctgtctatgctggtcactctcttggtgaatatgccgctctttcttgtgtcgctaacaccttgagtattgaaagtatggctgaaattgtcttctaccgtggtcttgttatgcaatcctctgtcgaaagagatgaattaaaccgttctgactacgctatgtgtgccgttaatccagttcgtgtccatccatacttctcttacgatttattagttgaagttgttaagaagattaacagtgaacacggaggactcttggaaattgttaattacaacgttgaaaactatcaatacgttgttaccggtgatttaacttctcttgaagctcttaagaacttattaactaaccttcgtgctgaatcaaagaagttcattgccttatacaaggaagatgctactcaagctatggatctcttaaacgaaaaggtttgtatctacgttaaattagctgaagaacgtaaggctaaggaaggtttcttcaatattgaaagaggtgctgctactattccacttcgtggtattgatgttccattccactccagttacttactttggggtgttccaaccttccgtgaattacttcatcaacgtgtccgtcgcgaagatgttgatgttaaatgtcttgttggtcgttacattccaaacttaatgggtgaaccattctctgttgaaaaggattacgc

SEQ ID NO: 14441 - DNA, 780 bp, Neocallimastix californiae
  Acyl_transf_1
cactggtcaaggtagtatcaagccaggcgttggtcaagaattattcagaagtcaaccagttttccatgcagctatggaaaagtgcgatgctgttgttaagaaggttaccggtgtttctatcattgatgccctctatgatcaaagtcaagcccatcacttaaagaaggctcaaattgctcaacctgccttattcgcttatgaatatgccatgtgtatgctttggaagtcttggggtgttgaacccgtcatcgtcaatggtcacagcttaggtgaaattgtggctgctgctgttactggtgctatcgatattgatttagccatcgatttcattattgagagagccagatgtatgggtgaatatggtgaaaagcctggagctatggtcagtattttccaaaatgaaaaaactgtcaaggaagccattgaagaatttggttacgaagaagaagttgcgattgcggccatcaatggtgtcactcataccgttatctctggttatgaggaggaggtcgatgatattacccaatactttagtgaaatgaacattaagacgaagaagttaaacgttaccgatgctttccattctccattaatggacccagctatcgaagaattaaataactggattgaagaaaaggatgatgctaagttcagacagtccttaaaggttaagttcatctctaatcttgatggtaccattaagccagttggtgatcgtcttgaagaagattactgggctaaacacgctagaaatgctgttcgtttcgttgatggtgttaa

SEQ ID NO: 14442 - DNA, 609 bp, Neocallimastix californiae
  Acyl_transf_1
tgttcaatttagcttggtatctctctataaatactatggtattacgcctagtgttgttattggctatggtgcaggtgaaattactgcggcgtatgcagctgaaaaaatagatttgaaggatgccgttcagattctttaccactacggtcaagtcctatccatggcaaacaattcatcaccaaaagtttactcttttctggttggttgtcctgtgggaagattgaatcatatgatggtttccaagttgactccatccgaaaaggatcttatttctatttctggtattccaaatccaagacaatgcattctttgtggtgagatggaaattttgaaaaaagttatgaagatgatcaaggatgaaaaggtaccaattctcagtggctttatggaaagctttggtatacattctaagataattacagaagctatgaaggatgaattaacaaagcgtcttgaaaacatttcatctcattcttcttctattgcgatgttttcaactgcaaaattcaatgagaagagcgaaccgtacactggtgctttagatggttcatactggtggatgaatatgagaaatccagtactttatgcccatactctttctcaaacagt

SEQ ID NO: 14443 - DNA, 1098 bp, Anaeromyces robustus
  Acyl_transf_1
tgtctttactggtcaaggtgctcaagaagttggtatgggacaagaattatataataaatcggctgtcgctaaatccgtttgggatagagctgatgcctatttaatgaaaaagtatggttattccattttagaaattgttcgtactaatccaaaatctttaaccgtttactttggtggcgaagaaggcgaaaagattagagaaaactatatgaatatgacttgtgaaattattgattctaatggtaaggtacaaactaaacgtatgttcccagaaattgatgaaaatactctttactatgaatacaaatcacccaatggtttattaaatgctactcaatttactcaacctgctattacccttactgaaaaggctgcctttgaagatatgcttgaaaatggttacatttgtgatgatgccgtttatgctggtcactctcttggtgaatatgctgctcttagttgtgttgctaatactttaagtattgaaagtatggctgaaattgtattctaccgtggtcttgttatgcaatcctctgtagaaagagatgctcttaaccgttctgattatgctatgtgtgctgttaatccagtacgtgttcatccttacttctcttatgatttattagtagaagtcgttaagaagattaatagtgaacatgatggtggtcttcttgaaattgttaattataatgtagaaaattaccaatatgtcgttactggtgatattacttccttggaagctcttaagaatttattaactaaccttcgtgctgaagctaagaaattcattactttatataaggaagatgctagtcaagctatggatctcttaaatgaaaaggtcgttcattatgttaaggaagctgaagaacgtaaagctaaggaaggatggttcaatttagaaagaggagctgctactattccacttcgtggtattgatgttccattccattctagttatttattatggggagtcccaaccttccgtgaattacttcatcaaagagttcgtcgtgaagatgttgatgttaaatgtcttgtaggacgttatattccaaacttgatgggtgaacctttctctgttgaaaaggattatgc

SEQ ID NO: 14444 - DNA, 876 bp, Anaeromyces robustus
  Acyl_transf_1
tactttttcaggtcaggccactcaatacccagatatgggtcgtcaactttatcattctaatccttattttgctagtattattaattattgtaatgaaattattattcgtttgtcacaaaaagatcttattaaagatactggattgtttagtgatacaccagtagatgaagaaaaattaattgatccacaatattctttccttgctataggtattattcaattagcccttgttgaattttggaaattatatggtgttgaaccagctcttgtttttggtcatagtatgggtgaagttgctgctgcttatgctgctggaattttaaccatagaagatgctatcttattactttataattatggtcttattagtcaaaatgttgatgatattcatgaaaagagtggtatgttagctcttggttgtagtgctgaagaagctaaaactacttatttaaatggtaaagataaaaatagagtttatattgcttctattaatagtgaaaaagatataacacttggaggtgatcttaatcagttagatgctatcatgactcaagctaaaaataataatgttttcacggtaatgttaaaagttaaaaaggcattccatacaccatatattattacagcaaaacaaaaatttattcaaggcattcaaggtattggtagtagagttaattcaccaaaaattccatttatttcttcaacttatggtaaagaatatcaaggaccatttgatgaagaatattggtggactaatattattaatccagttaactttagtcaagctacaaaagtagctcgtactaaagtagaaaaagtattagaaattggttcaacaccggtattaggtatatatatgagtaaaattttcaatcc

SEQ ID NO: 14445 - DNA, 921 bp, Anaeromyces robustus
  Acyl_transf_1
tgcattcactggtcaaggtgttgctaaggttggtatgggtaaacatttctaccaaacacaaccagtcttccgtaaggctatggacaaatgtgatgaagtcactcgtcgtcttcttaatgtatctattgttgaagttttatacaatatttctaatgcaccaaatggtattgaaaaaggtgaaaatgctcttaaaaaatcttctgttgctcaaccagccttatttgcttatgaatatgctatgagtcaactttggataagttggggtgttgaaccatctatggttcttggtcactctcttggtgaaattgttgctactactattgcaggtggtattgatttcgaattagctatggaattcattgttcaaagagcttcttgtatggaaaaatatggtattaaaccaggagctatggtttcaattttcactactgaaagtgctgtcaaagaagctattgaagaatttgaatttgaaaatgtttctattgctgctattaatggtactactcaaactgttatctctggtaatgctgatgaagttaaagaattagaagaatatttcattgaacaagaaattaaggctaaaccattaaatgttactgaagctttccattctgctttaatgaatccagctattgaaaagttatacgaatggattgaaactaaaccagatgataaattccgtaaaccattgaagtacggtcttatttctaatgttactggtgaacttattccagctggtgaacgtcttccaaagaactattggggtgaacatgcaagaaatgctgttcaatttgttaaggctgttgaaaccttattagctaacagtgagactttattaaatgttattgaagttggtccatctaatgtcttaactaatatgagtgctcgtattttacgtgaaaagaagattgataaatacac

SEQ ID NO: 14446 - DNA, 879 bp, Anaeromyces robustus
  Acyl_transf_1
cactggtcaaggtagtattaaaccaggtgttggtcaagaattatatagaagtcaaccagttttccgtgatgctattgataaatgtgatactgttttaaagaaggtcactggtatttcacttgttgatgttctttacaatccacaacaagctcatcatttaaagaaagctcaaattgcacaaccagctttatttgcttttgaatatgctatgtgtatgctttggaaatcttggggtgttgaaccaactattgttaatggtcatagtttaggtgaaattgttgctgctgctgttactggcgcaatggatattgatttagctattgatttcattgttgaaagagctagatgtataggcgaatatggtgaaaaaccaggtactatggttagtatttttgaaaaggaagatgttgttaagaaggctattgaagaatttgatactcaagaagaagttgctgttgctgccattaatggtgtagcccacaccgttatatctggttatgaagatgaagttgatgatattactgaatatttcaaacaaatgaatgtcaagactaagaaattaaatgttactgatgctttccactctccattaatggaaccagctattgaagaattagataaatggattgaaggaaaggatgatgaaaaattcagacaaccattaaaggttagatttatttctaatgttgatggtaagattaaggaagttggtgaacgtcttgatgaaaattattgggctgaacatgctagaagtactgttagatttgttgatggtgttaaatctatgattgaatctgaaaataataatatattagctgtgattgaagttggtccagctgctactttatctcatatgagtgcacgttatgttcgtgaaaa

SEQ ID NO: 14447 - DNA, 1074 bp, Anaeromyces robustus
  Acyl_transf_1
tgtctttactggtcaaggtgctcaagaagttggtatgggtatggacttgtatgaaaaatctgctgttgctagagaaatttgggatcgtgctgatgctcacttaatggaaacttatggtttctctattattgatattgttaaaaataatccaactgaaattactatttactttggtaatgttaagggtcaacaaattcgtaagaattatcaacaaatgacttatgaacatgttaatgctgatggtgttattgaaagtctttctcttttcccagaaattgatgatgatagtacttcctacactttccatcatattggaggtttattatctgctactcaatttacacaaccttccttagtattaatggaaaaggctgcttttgaagaaatgagatctcgtggtttcattcaacaaaatagtgctttcgctggtcacagtttaggtgaatatgctgccttaactgctattggtgatgttttaagtattgaaactttagttgatgtcgttttctatcgtggtatgactatgcaaagagctgtccaacgtgattctaagggacgttccgattatgctatgtgtgctgttaacccaactcgtgttagtagtactttcaatgaaaatgctttacaatatcttgttgctaatattcaaaaggttactgaaggattaattgaaattgtaaattacaatgttgataactggcaatacgttgtttctggtgatcttatttctcttcaagttcttactaatgttttgaactacttaaaggctgaaaagattgatttaactgttttattaaatactctttccgtagaagaagtacaaaaacaagttattgaaattgttactaatgcttttgaaaaggctaaagaacaaaagagaaagcgtggatttattaacttagaacgtggtgctgcttctattccacttcgtggtatcgatgtaccattccactctagtttcttattaagaggtgttgctccattccgtcaatatttaatgagtaaatttgatccaaatcttattgatgttaatcgtttaattggtaattacattccaaacttaaccgctgaacc

SEQ ID NO: 14448 - DNA, 819 bp, Anaeromyces robustus
  Acyl_transf_1
ttttgtctttagaggtattagtgaattaaattcaaactttagttatagtttatacaagtataatcaaaagtttgctaaaattgttgactattgtgataaggttcttgagaaagttagtcaaggtttatcccttaagagagattatggtcttttccagaaggaaaactttgatgaaaccactttaagagatccaaaaatttctgttattggtagtggtattattcaacttaccatggctcatctcttaaaatcctatgctattattccatcctctgttgttggttatagtattggtgaaatttccgctgcttatgccgctggtattatttccttagaggatgcggttcttattttatatcaatatagttctattttagaaaaggttccaggtaaggaagatatttacactgttgaattaggatgttcttctgatcaagctcaagttaatattcttagtcaattatctgctccagtttatattgttagtaatagtactagtaatatatgtacactctgtggtaatagtaccttcttaaatcaagctattcaaatggctcaacaattaaatatcccaattttatccaatttaacaccaggatcaaatggaatttgtactccatatcttaatgactttaaggatgaattctatgaatctttaagagatattggtagtagatgtaaggatccagttattccatttatttcaactactttaggtcaaccatttaatggtccattaaatgaattctattggtgggctaatttaactagtactgttaactttagttctgctctttcacttgctatgaatgagcaacc

SEQ ID NO: 14449 - DNA, 873 bp, Piromyces finnis
  Acyl_transf_1
caccggtcaaggtagtattaaatcaggtgttggtttagaattatacagaactcaaccagttttccgtgatgctcttaacaagtgtgatgttgttgttaaaaaggctaccggtatttctcttattgacgctctttacaatccaagtcaaagtcatcacttaaacaaggcacaaattgctcagccagctttatttgcttacgaatatgctatgtgtatgctttggaaatcatggggtattaacccaactattgtcaatggtcacagtttaggggaaattgttgctgctgcttctactggtgctatggatattgatttagctattgatttcattattgaaagagctagatgcatgggtgaatatggtgaaaaaccaggtactatggttagtgtatttgaaaaggaagatgtcattaaggaagcaattgaagaatttggatatgatgaagaagtttctgttgctgctattaatggtgttactcacactgttatctctggttatgaagatgaagttgacgatatcaccgaatactttagtcaaatgaacattaagaccaaaaaattaaatgttactgatgctttccattcaccattaatggatccagctgttagcgaattaaataaatggattgaaagaaaggatgactccaaattcagacaagacttgaaggttaaatttatttctaatgtcgatggtaacattaaaccagttggctctcgtcttgaagaagactattggggtaagcatgctagaaatgctgttcgtttcgttgatggtgttaaatccatgattgaatccgaaaagaagttattagctgttattgaagttggtccagccgctaccttaactaacatgagctctcgtttcgttcgtga

SEQ ID NO: 14450 - DNA, 810 bp, Piromyces finnis
  Acyl_transf_1
ttttgtttttagaggtattagtgagttaaaaaccaatttaggttatagcttataccaaaataataaaatgtttgctgatgttgttgactattgtgacaagattcttgagaagattagccagggctactctgttaagaaaaacaccggtcttttcttaaaggaaaacttagatgctgctacccttcaaagtccaaagatttctgttgttggtagtggtatgatccaacttgctatggctcatcttttaaagacctatggtattgttccatcctctgttgttggttacaatactggtgaaatcgctgctgcttatgccactggtattatttctttagaagatgccattcttattttataccaatttagtaatatattagaaaaggtcccaggtaaggaagatatctatacccttgaacttggttgttctgctgaacaagctcaatctagcataattaatcaactctctacttccgcttatattactggtaataatgctagcaatatttgtacactttgtggtagtagtgctgccttaaaccaagctattcaattagctcaacaatccaatattccaattttatctaatttaattccaggatcatgtggtatttgtactccattccttaacaatttcaagaatgaattccatgaagccttaaaggacattggtagccgctgcaaagctccagcaactccatttatctcaactactttaagtcaaccattcaatggtccattaaatgaatattattggtgggctaactttactagtactgttaactttaatgttgctctttcccttgctatgaa

SEQ ID NO: 14451 - DNA, 918 bp, Piromyces finnis
  Acyl_transf_1
tgctttcactggtcaaggtgttgctaaggttggtatgggtaagcatttctatcaaactcaaccagttttccgtaaggctatggacaaatgcgatgaagttactcgtcgtcttctcgatgtttctattgtcgaagttctttacaatatctcaaattctccaaatggtgtcgaagaaggtgaaaaggctcttaagaaatcttcagttgctcaaccagctttatttgcttatgaatatgctatgagtcaactttggattagttggggtgttgaaccatcaatggttcttggtcattcacttggtgaaatcgttgctacaactattgcaggtggtattgactttgaattagctatggaatttattgttcaaagagcttcttgcatggaaaagtatggtgtaaaaccaggtacaatggtttctgtatttactactcaagatgttgttgaagaagcaattgaagaatttggttttgaaaatgtatctattgctgctatcaatggtaccactcaaattgttatttctggtaatactgatgaagttaaggaattagaagaatacttcacacaacaagaaattaaggctaaacaattaaatgttactgaagccttccattctgctcttatggatccagctattgaaaaattatatgaatggattaatactaaaccagatgaaaagttccgtcaaccattaaagtatggtcttatttctaatgttactggtgaacttattgaggctggtgaacgtcttccaaagaattattggggagaacatgctagaaatgctgttcaatttgttaaggctgttgaaaccctattagctaatagtgaaactttattaaatgttattgaagttggtccagctaatgttttaactaatatgagttctcgtattttacgtgaaaagagaattgacaaatt

SEQ ID NO: 14452 - DNA, 918 bp, Piromyces finnis; identical to SEQ ID NO: 14451
  Acyl_transf_1

SEQ ID NO: 14453 - DNA, 804 bp, Piromyces finnis
  Acyl_transf_1
tctttactgtaataataaatacttttctgattgtattgattattgtgatggtattttcaaggctttaagtcaacgttctcttcttcaagattacggcttatttactactgaaatgatggataacaataaatttaaaaaatttaattctgatcttagaaaggatccattagtcatgataatgtttggtggtatggttcaattaactttgtctgccttattaaaatattatggtctatttcctaatgcagttattggttatggtgctggtgaaattgttgctgcctatgttgctgataagatggatttaaagactacggttaaagttctttaccactatggtagagttttaagtcacgcttactctcaagaaaataaggtttatactcttactttaatctgtccaattagtaaaattaaacaaaccattttcaccaaactaaatcaagatgaaaaagatggcatatcaatttcgggtattccaagtccaaagttctgtttacttagtggtgactataatatcatgaaaaaggtttccgatattgccaagagtgaaaatattgccatttatggtgctatgcaaaataattatggcttacattcaatgatgattaatgataaaatgaaggaagatcttgtgaacagtcttaaggacattcctttacaaacttctgatattgctttcttcactaccactaagctcaataaggatggtaagccatacgaaggaaaactagacggtgaatactggtggatgaatatgagaaatccagttctttatgctcacgctttatctcaaacagtcgc

SEQ ID NO: 14454 - DNA, 1083 bp, Piromyces finnis
  Acyl_transf_1
tgtcttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactgaaatcactatttactttggaaatgtaaagggtcaacaaattcgtaaaaattatcaacaaatgacttatgaacatgttaataatgaaggtgttgttgaaagtctctcacttttcccagaaattgatgatgatagtgtttcttacactttccgtcatattggtggtttattatcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaagagctgtccaacgtgattctaagggacgttctgactatgctatgtgcgctgtcaacccagttcgtgttggtagtacttttaatgaaagtgctcttcaatatcttgtcgctagtattaaaaaggttactaatggtttaattgaaattgtaaactataacgttgataactggcaatatgttgtttctggtgatcttatttccttacaagtacttactcttgtcttaaactacttaaagtttgaaaagattgatttaactgtattattaaagactctttctgaagaagaacttcaaaagcaagttaatgaaattattaacaatgcctatgtaaaggcaaaggatcaaaagaagaagcacggatttattaaattagaacgtggtgctgcttcaattccattacgtggtattgatgtaccattccactctagtttcttattaagaggtgttgctccattccgtcaatacttaatgagtaagtttgatccaaaattaattgatgttaaccgtttaattggtaattatattccaaacttaactgctgaaccattctctct

SEQ ID NO: 14455 - DNA, 1083 bp, Piromyces finnis; identical to SEQ ID NO: 14454
  Acyl_transf_1

SEQ ID NO: 14456 - DNA, 1083 bp, Piromyces finnis; identical to SEQ ID NO: 14454
  Acyl_transf_1

SEQ ID NO: 14457 - DNA, 1083 bp, Piromyces finnis; identical to SEQ ID NO: 14454
  Acyl_transf_1

SEQ ID NO: 14458 - DNA, 873 bp, Piromyces finnis
  Acyl_transf_1
caccttctcaggtcaaggtactcaatatccagaaatgggtcttcaactttacaatatgaacccatatttcgcaagtattattgattactgcaattctatccatacccaaatttctaaaaaagatcttttaaaggagactggcttatttggtaagggtcctgtaaatgaagaaaaacttttagatccacagtattcattcccagctattggaataatagaattagctctagttgaactatggaaacgttatggtgttgaaccagctcttgtctttggtcatagtatgggtgaagttgctgctgcttatgctgctggtattttaactattgaggatgctattcttttactttataactatggacaaataagcgaaaatgtagttgatgctggtgcaaagagtggtatgttagctattggttgtagctctgaagaagctcaatcaatttacttaaagggtaaagataaggtttttattgcttcaattaatagtccaaaagatattactcttggtggtgatcttgaacaacttaatgaaattatggctgaagccaggaagaacaatgtcttttctgttatgttaaaggtaaagaaggctttccatacttcctacattattacagctaaggacaaattccttcaaagtatccaaggtattggtaatagagttaaagcaccaaagattccattcatatcctctacctatggcagagaatatcaaggtccatttgatgaagaatattggtggacaaatatcattagtccagtcaactttagccaagcaaccaagattgctcgttcaaagatcgataaagttttagaaattggttccacaccagttttaggtatctatatgagtaacgatttccatcagga

SEQ ID NO: 14459 - DNA, 876 bp, Piromyces finnis
  Acyl_transf_1
tgctttctctggtcaaggttctcaatttataaatatgggtagacgtatgtatcaaaccaatgatctctttaagaaggttgtcgattattgtgctgctgttcttgttactattaatggcggtgaagatatctttgaaaagtatagcatctttaagggagatgttgctcaaattagcgaaaccgatctttctcttccacaattctctgttcttgctattggtattgctcaaattgctttaattgaagtttggaagtctatgggtgttacaccaaaggctgtctatggtcatagtatgggtgaagttgctgctgcttatgctgctggtgttcttactatcgatgatgctgtcttattattatacatgcgtggtcatattcttgctcaattagatggtactggtaagggtatgttagctcttggatgctcagttgaaaatgctcaacgcttcatggctaataagccaaatgttttcatttctgctgttaacagtgctaattctattactttagccggggatcttgaacaaattaatgctgttgcaagagaagctcaagctgaaaaactttttgctgttgtattaaaggttaagcaagctttccattctccatacgttgaaggtgctgaaaaggctttcaaggaaagtattagaggcattggtgaacgtactaaagctccaaattgtaagtttgtttctgcttgttttggtcaagaatatgaaggtccattcgatgaaaattactggtgggctaatattcgtaatccagttagtttccatgctgctgcttctattgctactcaattctctaagcgtgttttagaaattggtgctcatccagttcttggtatgtatcttaaggaaatctatggtaaggataa

SEQ ID NO: 14460 - DNA, 453 bp, Piromyces finnis
  Acyl_transf_1
ctaccgtactcaacctgtctatgctaaagccttagaagaatgtgataagattatcactgagttaagtaactttaagattttattggtcaatttggttatttgtatgggcgaattgatacaaccagaattattacaagaatacaaaaagcaagtagatgaagatccatgtatggctcaattcattgctctttccatgaactatgctttaataaaacttttagaacatttatctatttcaccaaatcttgttgtgggttataaatttggtgaaattacagctgctcttgcctgtggtaagatttctttgagaaatgctttccttattattcattacatttgtaaaataattcgtaagaatatccaactttctgatgaaactattacttcagatatcactcaattaatgattataaaggatgaatcgaaggcattttcatctgcaaagaataatga

SEQ ID NO: 14461 - DNA, 1068 bp, Neocallimastix californiae
  ACYL-COA THIOESTERASE I
aaatagttcaatacgtcaaattgtcagaacatcagttgaaggtgaatatttgagattccacttttctaatttccttggtaattctaatttagaattacgttctgttcatgttgccaagtctgctagtcaaggtactggtaaaattataaaagatactgatactgttattacttttgatggaaaagaaagtgttactattccagctcaaaaggaaattacatctgatactattaaattctctgccccagccctcaccgaacttgctgttactatctattatggtaatattccaaatactatgactagtcatgttgcttctagagcaaactctttcattgaatctggaaatgctgtttcaaaagaaagtattagtaccaataataaaacccttcattggtacaccctttctgccattgatgtttttgttaacaagaataaggattataaggctgttgtctgttttggtgattctattactgatggtagaggtgttactaatgataagaataacagatggactgatattctcgctaccagattacaacagaatccagcaacaaaaaatattggtgtattaaaccaaggtattggtgctactactgtagctggaacttactataatccaactagtccagctggtcaagctagatttgaaaaagatgtcttgaaacaaacaaatgttaaatacttaattatcttatacggtgttaatgatattctctacaataatagtaatgctcaaactatcattaatgtttataaagatttaattaaaaaggctcacaacaatggaattaaggttttcggaggtacaattttaccattcggtaaaaacagtggtttcaactcaaataaggaaagtcaaagaacaactgttaataactggattatgaacacaccagcttctcaaggtggttttgatggttacattgactttgcttcagctgttgctgataaatctaacaaacaatggttgaatactaattggaactttgaaaatgatggtcttcatccaaatgctgttggttatgaagctatgggtaaagctattgatttaaatctcttcat

SEQ ID NO: 14462 - DNA, 336 bp, Neocallimastix californiae
  ADH_N
ccaaattgaagttaaggttactcataatggtttatgtcacagtgatattcacatgaaggataacgactggggaaattcttcttatccattcattccaggtcatgaagttattggtaatgttgttgccttaggtgctaatgctgaaaaactttctggtcttaaggttggtgacagagttggttatggttggattcgtgatagttgtggtttctgtgaatgttgtattgaaggtcaagaaaatctttgtgaaaagggttatgaaggtactattgttggtcatcatggtggtttccaagatcgtattagaatgccagctaaatttgcttttaagattcc

SEQ ID NO: 14463 - DNA, 306 bp, Neocallimastix californiae
  ADH_N
tatttgtaaaccattagccattgcggtatgtacttcggatgttcatactgtatgggaaggagctattggagatcgtcatgatatgattttaggtcatgaatgttgtgctgaagtagttgaagttggttctgaagtcaaagatttcaaaccaggggatagagttattgttccagctattactcctgattggaattctttagaagctcaagctggttattcgatgcattcacatggcatgcttgctggttggaaattctctaacattaaggatggggtattctctgaatatttccatgtcaatgatgc

SEQ ID NO: 14464 - DNA, 195 bp, Neocallimastix californiae
  ADH_N
taatgaagttttagtgaaatttttagcagctccaattaatccttctgatattaatcaaattgaaggtgtttatccaattaaaccaagatttagagaatatggtgcagtgggtggtaatgaaggtgtcgctgaagtagttgctgctggttctaaagttaaaaacttaactataggtgattgggttattccagattc

SEQ ID NO: 14465 - DNA, 339 bp, Neocallimastix californiae
  ADH_N
tgatgttgaaattgatattaaatattgtggtatttgtcactcagatattatgattgtacaaattaatcaaccaggaaaaggtgttgttccaggtcatgaaattaccggtgttgtaaaatctgttggtaaggcagttacaaatttcaaagtaggtgatcatgttggtgtaggttgttttgttaactcctgtagtaactgtgaatactgtaaacgtggtgatgaacaattttgtgataagggtgtagttgttgtatttaatagtaaggattatgatggtgcaataacctatggtggttatactcaaactattatcgtcaaagataaatttgttttacatat

SEQ ID NO: 14466 - DNA, 339 bp, Neocallimastix californiae
  ADH_N
tgatgttgaaattgatattaaatattgtggtatttgtcactcagatattatgatagtacaaaataatcaaccaggaaatggtattgttccaggccatgaaattgctggtgttgtaaaatctgttggtaaagcagttacaaatttcaaagttggtgatcatgttggtataggttgttttgttaactcctgtagtaactgtgaatactgtaaacgtggtgatgaacaattctgtgataaaggtgtagttattgtatttaatagtaaggattatgatggtgcaattacctatggtggttatactcaaactattatagtcagagataaatttgttttacatat

SEQ ID NO: 14467 - DNA, 198 bp, Anaeromyces robustus
  ADH_N
tgatgaagtcttagttaaattcttagcctcaccaattaatccttctgatattaatcaaattgaaggtgtttatccaattaaaccaagatttaaggaatatggtgctgttggtggtaatgaaggtgttgctgaagttattgctgctggttcaaaagttaagaatttaactgttggtgattgggttattccagatacaaa

SEQ ID NO: 14468 - DNA, 195 bp, Anaeromyces robustus
  ADH_N
taatgaagttttagttaaatttttagcttctccaattaatccttctgacataaatcaaattgaaggtgtctatccaataaaaccaagatttaaagaatttggtgctgttggtggaaacgaaggtgttgccgaggttattgctgccggtccaaaagtcaagaatttagttgtcggtgactgggttattcctgacac

SEQ ID NO: 14469 - DNA, 195 bp, Piromyces finnis
  ADH_N
tgatgaagttttagttaaatttttagctgcaccaattaatccttccgatattaatcaaatcgaaggtgtttatccaattaagccaagatttaaaaagtatggtgctgttggtggaaacgaaggtgttgctgaagtcgttgctgctggtaacaaagttaaaaatttaactgttggtgattgggttattccagatac

SEQ ID NO: 14470 - DNA, 519 bp, Neocallimastix californiae
  adh_short
ggttgttattattactggtgctggtggtggtctaggtcgtgcttacgctaaacattttgctaaattaggtgcttctgttgttgttaatgatttaggtgtccttttacgtggtagaggtgctaacactcaagttgctgatagtgttgttgaagaaattaagcaaatgggtggtattgctgttccgtcttatgattctgttgaagaaggtgaaaagattgttgaaaccgctattaagaactttggtcgtgttgatattattattaataatgctggtattttaagagatagatcttttggtagaatgactgatactgattggatgatgacatatagagttcacttaaagggtacttataaggttacaagagctgcttggccatacatgatgaaacaaaagtatggtagaattattaatattacttctgcggctggtctttttggtaactttggtcaatctaattatgctgctgctaaatctggtgttattggtctcactaatgcattagctttagaaggtaa

SEQ ID NO: 14471 - DNA, 516 bp, Neocallimastix californiae
  adh_short
tgtagtcattaccggtgccggtggtggctttggtcgagcccatgcattcttatttgcttctcgaggtgcaactcttgttttaaacgataatgcaatcatatctaataataatggacaaccaaaatatctagtcgatgatgttgttcgtgaaattactaaagctggttttcatgctattgctaattatgaaccaattggaaatggtgataagatcattgaagctgcaatgaatgcttttggaagagttgatattttaattaataacgctggtgttacttgcaataaacctttcaaagaaatgtctgataaggattgggaatatgttcataatgttaatcttcatggtgcttataaggttactaaagctgtttggccaattatgcaaaaacaaaagtacggtagaattattaatattgtttctgcagcaggtctttatggtagttatggtcaaactaattactcctcagcaaaaatggctttacatggctttactttatctttagctagagaaggtta

SEQ ID NO: 14472 - DNA, 87 bp, Neocallimastix californiae
  ADH_SHORT
tgcagcaggtctttatggtagttatggtcaaactaattactcctcagcaaaaatggctttacatggctttactttatctttagctag

SEQ ID NO: 14473 - DNA, 87 bp, Neocallimastix californiae
  ADH_SHORT
tgcggctggtctttttggtaactttggtcaatctaattatgctgctgctaaatctggtgttattggtctcactaatgcattagcttt

SEQ ID NO: 14474 - DNA, 516 bp, Neocallimastix californiae
  adh_short
agttattgttactggtgctggtggtggtcttggtcgtgcctatgctaagcactttgctaaattaggtgcctcagtcgttgttaatgatttaggtgtccttttacgtggtagaggtgctaacacacaagttgctgatggtgttgttgaagaaattaaaaagatgggtggtattgctgttccatcctatgattctgttgaagaaggtgaaaaaattgttgaaactgctataaagaactttggtcgtgttgatattattattaataatgctggtattttaagagatagatcttttgcaagaatgactgatactgattggatgatgacatacagagttcatttaaaaggtacctataaagttactagagctgcttggccatatatgatgaagcaaaagtatggtagaattattaatattacctctgctgccggtcttttcggtaactttggtcaatctaactatgctgctgctaaatctggtgtcatcggtctcactaatgccctagctttagaaggtaa

SEQ ID NO: 14475 - DNA, 516 bp, Neocallimastix californiae
  adh_short
agtagtcattaccggtgccggtggtggctttggtcgggcccatgccttcttatttgcttctcgaggtgctactcttgttttaaacgataatgccatcatttctaatagtaatggtcaaaaaaaatatttagttgatgatgttgttcatgaaattactaaggctggtttccatgccattgctaattatgaaccaattggaaatggtgataagattattgaagctgctatgaatgctttcggaagagttgatattttaattaataacgctggtgttacttgcaataaaccattcaaagaaatgtctgataaggattgggaatatgttcataatgttaatcttcatggtgcttacaaggttaccaaggctgtctggccgattatgcaaaaacaaaagtatggtagaattattaatattgtttctgcagctggtctttatggtagttatggtcaaagtaactactcttcagctaaaatggccttacatggttttactttatccttagctagagaaggtta

SEQ ID NO: 14476 - DNA, 87 bp, Neocallimastix californiae
  ADH_SHORT
tgcagctggtctttatggtagttatggtcaaagtaactactcttcagctaaaatggccttacatggttttactttatccttagctag

SEQ ID NO: 14477 - DNA, 87 bp, Neocallimastix californiae
  ADH_SHORT
tgctgccggtcttttcggtaactttggtcaatctaactatgctgctgctaaatctggtgtcatcggtctcactaatgccctagcttt

SEQ ID NO: 14478 - DNA, 516 bp, Anaeromyces robustus
  adh_short
tgttattgtaactggtgctggtggtggtcttggtcgtgcttacgctaagcatttcgccaaattaggtgcttctgtcgttgttaacgatttaggtgtccttttacgtggtagaggtgctaacactcaagttgctgatagtgttgttgaagaaattaagaaaatgggtggtattgctgtcccaagttatgattctgttgaagaaggtgaaaagattgttgaaactgctattaaaaactttggccgtgttgatgtcattataaataatgctggtattttaagagatagatcatttgctagaattactgatactgattggatgatgacttataaagttcacttaaagggtacctataaagttactaaggctgcttggccatatatgataaaacaaaaatacggtagaattattaatattacttctgctgctggtctttttggtaactttggtcaatctaattatgctgcagctaaatctggtgttattggttttaccaatgctttagcattagaaggtaa

SEQ ID NO: 14479 - DNA, 516 bp, Anaeromyces robustus
  adh_short
agtcgtcattaccggtgccggtggtggttttggtcgagcccatgcttttttatttgcttctagaggggctactcttgttttaaacgataatgctgtcgtttcacataagaaaggtcaaacaaaatatgtcgttgatgatgtcgtcaatgaaattacaaaggctggtttccatgccattgctaactatgaaccaattggaaatggtgataagatcattgaagctgctatgaatgctttcggaagggttgatattttaattaataatgctggtgttacttgtaataaacctttcaaagatatgactgataaagattgggaatatgtacataatgtcaatcttcatggtgcctataaggttactaaggcagtttggccaattatgcaaaaacaaaaatatggtagaattattaatattgtttctgctgctggtctttatggtagttatggacaagttaattattcttcagctaagatggctttacatggtttcacattatcattagctagagaaggtta

SEQ ID NO: 14480 - DNA, 87 bp, Anaeromyces robustus
  ADH_SHORT
tgctgctggtctttttggtaactttggtcaatctaattatgctgcagctaaatctggtgttattggttttaccaatgctttagcatt

SEQ ID NO: 14481 - DNA, 87 bp, Anaeromyces robustus
  ADH_SHORT
tgctgctggtctttatggtagttatggacaagttaattattcttcagctaagatggctttacatggtttcacattatcattagctag

SEQ ID NO: 14482 - DNA, 516 bp, Piromyces finnis
  adh_short
agtagtcattaccggtgccggtggtggttttggtcgagcccatgcctttttattcgcttctcgaggcgcaactcttgttttaaatgataatgctattatttcaaataataatggtcaaccaaaatatttagttgatgatgttgttaatgaaattactaaagctggtttccatgccattgctaactatgaaccaattgaaaacggagataagatcatcgaagctgctatgaacgctttcggaagaattgatattttaattaataatgctggtgttacttgcaataagccattcaatgaaatgtcagataaggactgggaatatgtacaaagtgtcaatcttcatggtgcctacaaggttaccaaggctgtctggccaattatgcaaagacaaagatatggtagaatcattaatattgtttctgctgctggtctttacggtagttacggtcaagctaattattcttcagccaagatggctttacacggattcactttatctttagctagagaaggtta

SEQ ID NO: 14483 - DNA, 516 bp, Piromyces finnis
  adh_short
tgttattgttactggtgctggtggtggtcttggtcgtgcttacgccaagcactttgctaagttaggagcttctgttgttgttaacgatttaggtgtccttttacgtggtagaggtgccaatactcaagttgctgatagtgtcgttgaagaaattaagagtatgggaggtattgctgttccaagttatgactctgttgaagaaggtgaaaagattgttgaaactgccatcaaaaactttggtcgtgttgatgttatcattaacaacgctggtattttaagagatagatcctttgctagaatgaccgatactgattggatgatgacctacaaggttcacttaaagggttgttacaaggttactaaagctgcttggccatacatggttaaacaaaagtacggtagaattattaatattacatctgctgccggtcttttcggtaactttggtcaatctaactatgctgctgctaaggctggtgttattggtctcactaatactttagccttagaaggtaa

SEQ ID NO: 14484 - DNA, 87 bp, Piromyces finnis
  ADH_SHORT
tgctgccggtcttttcggtaactttggtcaatctaactatgctgctgctaaggctggtgttattggtctcactaatactttagcctt

SEQ ID NO: 14485 - DNA, 87 bp, Piromyces finnis
  ADH_SHORT
tgctgctggtctttacggtagttacggtcaagctaattattcttcagccaagatggctttacacggattcactttatctttagctag

SEQ ID NO: 14486 - DNA, 735 bp, Neocallimastix californiae
  adh_short_C2
aaactcaattggtgaatgtgttcttaagtacctcttagctggtggtgctaaggttgttgctactacctctagctaccgtcgtgctaccatggaacactttagaagtgtatatgaacaagttggtactaagggttccactttagttgttgttccattcaaccaaggttctaagaaggatgtcaatgatctcattgaattcatctactctaaggatagtcgtgtcaacggtctcggttgggatcttgacttggttattccattcgctgctatctctgaaaatggtcgtgatattagtgacttggatggtaagagtgaattagctcaccgtattatgatgaccaatgttattcgtattcttggtgctgttcgtactcaaaagatgaaggttggttcacttgtctctgctcaagttatccttccattatctcctaaccacggtacttttggtggtgatggtttatacggtgaatctaagattggtttggagaacctcttaaaccgttggagatctgaaacctggtctaagtacctttctatcactggtgcctgcatcggttggacgagaggtaccggtttaatgaacagtaacaaccttatctctgaaggtattgaaagccaaggtacctgccgtactttcactaccactgaaatggccttcaacttgattggtcttgtttctgatgttatggtctccctttctcgtaagagtccaatctacgctgatcttaacggtgg

SEQ ID NO: 14487 - DNA, 693 bp, Neocallimastix californiae
  adh_short_C2
taactccattggttcccaaattattaagggattattaaatggtggtgctaagattattgctactacttccagattcagtaaggcaaccatgcaatactaccgtcaactctatgaagatcatggttctaagggatcttgcttaattgttgttccattcaatgccgcttctgttgaagatgttaatcgcttaatcgattacatttactctaaggatccaaagaatggtttaggatgggatcttgattacgttattccattcgctgccatctccgaaaatggtagaactttagaaaacattgacagtagaagtgaattagctcatagaattatgcttactaacttattaagaatgttaggtaagattgttagccagaaggaggctcacaagtatgatactcgtccagctcaatgtattcttccaatgtctccaaaccatggtaccttcggtggtgatggtctctactctgaatccaagattgctcttgaaaccctcttcaaccgttggcattcagaaggatggggaggttaccttaccgttgctggtgccgtcattggttggaccagaggtactggtttaatgaatagtaataaccttgttgctgaaggtattgaaatgtttggtgttcacactttcagtactcatgaaatggccttcaaccttattggtttaatgcacagtgacatttgtaagct

SEQ ID NO: 14488 - DNA, 693 bp, Neocallimastix californiae
  adh_short_C2
taattccattggttctcaagtgattaagggattattaaatggtggtgctaagattattgctactacttctagattcagtaaggctactatgcaatactaccgtcaactctatgaagatcatggttctaagggatcatgtttaattgttgttccattcaatgctgcttctgttgaagatgttaatcgtttaatcgaatacatttactccaaggatccaaagaatggtttaggatgggatcttgattatgttattccattcgctgctatctccgaaaacggtagaactttagaaaacattgatagtagaagtgaattagctcatagaattatgctcaccaatttattaagaatgttaggtaagattgttactgaaaaggaatcgcataagtatgatacacgtcccgctcaatgtattcttccaatgtcaccaaaccatggtacctttggtggtgatggtctctactctgaatccaagattgctcttgaaaccctcttcaaccgttggcattcagaaggatggggaggttatcttactgttgctggtgctgtcattggttggactagaggaaccggtttaatgaatagtaataaccttgttgctgaaggtattgaaatgtttggtgttcacactttcagtactcatgaaatggccttcaaccttattggtttaatgcacagtgatatttgtaagct

SEQ ID NO: 14489 - DNA, 726 bp, Anaeromyces robustus
  adh_short_C2
aaattctattggtgaaaatgttttgaaatatcttattgctggtggtgctaaggttgttgctactacttcaagttatcgtcgtcaaactttagaacactttagaagtgtttatgaacaagtaggtactaagggctctactttagtcgttgtaccatttaatcaaggatctaagaaggatgttaatgatcttatagaatttatttattccaaggatagtcgtgttaatggtcttggatgggatcttgatttagttattccgtttgctgccatttctgaaaatggacgtgatattagtgatttagatggtaagagtgaattagctcatcgtattatgatgactaatgttattcgtattcttggtgctattcgtaatcaaaagatgaaggttcgttcccttgtttcctgtcaagttgttcttccactttcaccaaatcatggtacttttggaggagatggtttatacggagagtccaagattggattagaaaacttattaaaccgttggagatctgaaacttggtcaaactatttatctattactggtgcttgtattggttggaccagaggtactggtttaatgaatagtaataatcttatttctgaaggtattgaaagtgaaggacattgtcgtacatttactactactgaaatggctttcaatttaattggtcttgtttctgatgttatggtttctctttcacgtaagaatccaatttatgctgattt

SEQ ID NO: 14490 - DNA, 723 bp, Anaeromyces robustus
  adh_short_C2
taactctattggttctcaagttattaagggattattaaatggtggtgctaagattattgctactacatctagatttagtaaggctactatgcaatactaccgtcaactttatgaagatcatggttctaaaggttcatgtttaattgttgttccatttaatgctgcttcagttgaagatgttaatcatctcattgaatatatttattctaaggatccaaagaatggtttaggttgggatcttgattatgttattccatttgctgctatttctgaaaatggtagaactttagaaaacattgatagtagaagtgaattagctcatagaattatgcttactaacttattaagaatgttaggtaagattgtttctgaaaaagaagctcataagtatgatactcgtccagctcaatgtattttaccaatgtctccaaatcatggtacattcggtggtgatggtctttactctgaatcaaagattgctcttgaaacacttttcaaccgttggcattcagaaggatggggaggttatcttaccattgctggtgccgttattggttggacaagaggtactggtttaatgaatagtaataatttagttgctgaaggtattgaaatgtttggtgttcacaccttcagtactcatgaaatggctttcaatttaattggtttaatgcatagtgaaatttgtaagatgtgtcttaagaacccagtctttgctgatct

SEQ ID NO: 14491 - DNA, 702 bp, Piromyces finnis
  adh_short_C2
taactctattggttctcaaattattaagggattattaaatggtggtgctaaaattattgctaccacttcaagattcagtaaggttactatgcaatattatcgtcaactttatgaagaccatggttctaagggttcatgcttaattgtagttccattcaatgctgcttctactgaagatgttaatagattaattgaatacatttactccaaggatccaaagaatggtttgggttgggatcttgattatgttattccatttgctgctatctctgaaaatggcagaaccttagaaaacattgatagtagaagtgaattagctcacagaattatgcttactaacttattaagaatgttaggtaagattgttagtgaaaaggaagctcacaagtatgacactcgtccagctcaatgtattttaccaatgtctccaaatcatggtacttttggtggtgatggtctttactctgaatccaagattgctcttgaaactctcttcaacagatggcattctgaaggatggggaggttaccttactatcgtcggtgctgtaattggttggactagaggtacaggtttaatgaacagcaataaccttgttgctgaaggtattgaaatgtttggtgttcacactttcagtactcatgaaatggcatttaaccttattggtttaatgcataatgatatttgtaaaatgtgtcttaa

SEQ ID NO: 14492 - DNA, 702 bp, Piromyces finnis; identical to SEQ ID NO: 14491
  adh_short_C2

SEQ ID NO: 14493 - DNA, 702 bp, Piromyces finnis; identical to SEQ ID NO: 14491
  adh_short_C2

SEQ ID NO: 14494 - DNA, 702 bp, Piromyces finnis; identical to SEQ ID NO: 14491
  adh_short_C2

SEQ ID NO: 14495 - DNA, 45 bp, Neocallimastix californiae
  ADH_ZINC
tcatgaagttattggtaatgttgttgccttaggtgctaatgctga

SEQ ID NO: 14496 - DNA, 45 bp, Neocallimastix californiae
  ADH_ZINC
tcatgaaattaccggtgttgtaaaatctgttggtaaggcagttac

SEQ ID NO: 14497 - DNA, 45 bp, Neocallimastix californiae
  ADH_ZINC
ccatgaaattgctggtgttgtaaaatctgttggtaaagcagttac

SEQ ID NO: 14498 - DNA, 360 bp, Neocallimastix californiae
  ADH_zinc_N
tttaggtcatttagctgttcaatttgctagtaaaatgggttatgaagttactgctctttctacttcttataataaaaaagaagaagctactggttttggttgtcataactttgttttattaaaggaagctgctgaaaaagttccaaattatttcgatttaattattaatacttctccatatgatatggattggaaaatgcttttaggtttacttagaccaaatggtaaattatgtttaattggtattccagctgttgatatgaaagttccagttatgccaattattttctctcaaaagactatttgtggttctattgttgctggtagaaaattcactaatgaaatgcttgaatttgctgc

SEQ ID NO: 14499 - DNA, 363 bp, Neocallimastix californiae
  ADH_zinc_N
agttggtcttatgtctgttgctggtgcttctcttagaggtgcttcacgtattatttgtgttggaactcgtaaagtttgtcaagatgttgctagaaaatatggtgctaccgattttatttcatacaagaatggaactattgaagaacaagttatgaaattaactgatggcaaaggtgtcgatcgtgtatgtattgctggaggtacggtaaaaactttcgaatctgctattaaatgtcttaaaccaggaggtaagattggtaatgttaattatcttggttccggcgaattcgttaccattcctcgtgtagaatggggtgttggtatgggtcataaggatatccgaggtggtcttatgccaggtgg

SEQ ID NO: 14500 - DNA, 408 bp, Neocallimastix californiae
  ADH_zinc_N
tgttggtcaagttgtttgccaacttgctaagcttaagggtttaagagttgttgcttgtgcttcctctccagaaaagattggtttcttaaagcaagccattaaggtcgatgaagctttcagttaccgtgacttcccagacaaggaatccttcactgctcaattacgtaaggtttgtccaaacggtatcgatatctactacgataacgttggtggatacattcttgattctgctcttgaacttatgaacattcacggtagagttattatgtgtggtatgatctctcaatacaaccttaccgaaaagtacaagtacactcttagagatattacttccagaagacttactcttcaaggttgtttattcaacgattacttcccacaatgcatgggtgaattcatgcaagatat

SEQ ID NO: 14501 - DNA, 363 bp, Neocallimastix californiae
  ADH_zinc_N
agttggtcaatctgttattcaaattgctaaagcttggggtattaaaactattaatgtcatacgtgacagaccaaattttgaagaagttgctggagaattacataaacttggtgctacattagttattaaagaagaggatttacgttctaattctactcgcgaacttgttaagaacttaggtagtccagttcgtttagctttaaattgtgtcggaggaaagtcagcttctggaattacacgtttacttggccaaaatgctactattgttacctatggaggtatgtctaagcaaccacttactttcggtactggtccatttatttttaagaatttacgtgcaagtggtttttggatttctcgttg

SEQ ID NO: 14502 - DNA, 369 bp, Neocallimastix californiae
  ADH_zinc_N
tttaggtcaccttggtgtacaatttgctcatgctatgggagctgaagttaccgttcttggtcattcagaatccaaaaaagaggaagccaagaaacttggagccgattgttatgaaattttaaagactgatgaagatttcaaaaaatattacagaacctttgattttattttaaattgtgctactgctaatcttaatttagataaccattttaaattattaaaaccaaatggtgtcctatgttttgttagtattgtaccagaggaacaaaggtttagtgaattaaatctttttggtaatcaagcttccataacagtttctaatgttggtggtattggtatcactcaagaaatgttaaacttttctgctga

SEQ ID NO: 14503 - DNA, 345 bp, Neocallimastix californiae
  ADH_zinc_N
tgtaggtcaagctgccgtgaagttatgtcaactctggggtgctaatattattgccagtgcttctgcttcgaagcaacaattccttcgtgatacttatggtcttgagcatgtaaccaactccagagatccagaagaattctaccgtgatgtgatgaagtggactgatggtaagggcgttgactttgtgttaaactctctttccggaaagagtcttaaaatgggtattaagtgtttgaagaatggtggtaagtttgttgaaattggaaagactgatattttaaatgacagcaagttaggtctacattgtcttcttaataatatctcctttgtctcatcacatattga

SEQ ID NO: 14504 - DNA, 297 bp, Neocallimastix californiae
  ADH_zinc_N
tgttggtcaagcagctattaaattatgccaatattggggtgcaaagatatttgttagtacttcagctaaaaaagtccaatacttgaaggatatgtatggtttagaatacattactaattccagagattcgaagactttttataacgatattatgaaatggacaaataatgaaggtgttgactttgttttgaatgccctcgctggtgatggtattacatatggacttaagtgcttaaagaagggtggtcattttgttgaaattggaaagaagaatattatctttaatactccattagg

SEQ ID NO: 14505 - DNA, 369 bp, Neocallimastix californiae
  ADH_zinc_N
tttaggccatcttggtgtacaatttgctcatgctatgggtgctgaagttaccgttcttggtcattcagaatccaaaaaagaggaagccaagaaacttggagccgattgttatgaaattttaaagactgatgaagatttcaaaaaatattacagaacttttgattttattttaaattgtgctactgctaatcttagtttagataaccatattaaattattaaaaccaaatggtgtcttatgttttgttagtattgtaccagaggaacaaaagtttactgaaatgaatctttttggtaatcaagctaccataacagtttctaatgttggtggtattgatatcactcaagaaatgttaaacttttctgctga

SEQ ID NO: 14506 - DNA, 363 bp, Anaeromyces robustus
  ADH_zinc_N
tgttggtcaatctgttatacaaattgctaaagcttggggtattaaaaccatcaatgttgttcgtgacagaccaaattttgatgaacttgcctctgaattacataaacttggtgctacattagttattaaagaagaagacttacgtgctaattctactcgtgaactcgttaaaagtttaggaagtccagttcgtttagctttaaattgtgttggtggtaaatctgcttctggtatcactcgtttacttggtcataacgctactatcgttacatatggtggtatgtctaagcaaccacttacttttggtactggtccatttattttcaagaatttacgtgcttgtggctactggaattctcgttg

SEQ ID NO: 14507 - DNA, 369 bp, Anaeromyces robustus
  ADH_zinc_N
tgttggacaatctgttattcaaatcgccaaggcctggggtatcaaaacaattaatgttgtccgtgatagaccaaactttgatgaatttgctgccgaattacataagcttggtgcaactttagttattaaagaagaagatttacgtgctaattctactcgagaacttgtaaaaaacttaggtaatccagttcgtttagccttaaactgtgttggtggtaaatctgcttctggtataacccgtttacttggtaataacgctacaattgttacctatggtggtatgtctaaacaaccacttactttcggaactggtccatttatcttcaaaaatttacgtgcttgtggtttctgggtttctcgttggaataa

SEQ ID NO: 14508 - DNA, 411 bp, Anaeromyces robustus
  ADH_zinc_N
tgttggtcaagttgtttgtcaacttgctaaacttaagggtttaagagttgttgcttgtgcttcatctccagaaaagattggtttcttaaaacaagctcttaaggttgatgaagcttttagttaccgtgacttcccagacaagaaatcttttactgaacaattacgtaaggtttgtccaaatggtattgatatctattacgataatgttggtggatacattcttgattctgctcttgaagttatgaacattcatggtagagttattatgtgtggtatgatctctcaatacaaccttaaggacaaataccaatacactcttagagatattacttccagaagacttactcttcaaggttgtttattcaatgatttcttcccacaatgtatgggtgaatttatgcaagatatgat

SEQ ID NO: 14509 - DNA, 291 bp, Anaeromyces robustus
  ADH_zinc_N
tgtaggtcaagctgctataaaattatgtaaatactggggtgctaaaatttatgttagtacttcaacaaaaaagagagaatatttaaagaatttatatggattggagtatattactgattcaagaaatccaaagattttctatgaagatattatgaaatggactaataatgaaggtgttgactttgtccttaatgctcttgcaggtgatggtattacctatggtttaaaatgtttaaaaaaaggtggatgttttgttgaaattggtaaaaagaatattattttgaatacacc

SEQ ID NO: 14510 - DNA, 408 bp, Piromyces finnis
  ADH_zinc_N
cgttggtcaagttgtttgtcaacttgctaagcttaagggtttaaaggttgttgcttgtgcttcttctccagaaaaaattggtttcttaaagggtgctattaaggttgatgaagctttcagttaccgtgacttcccagacaaggaatccttcgttgctcaattacgtaaggtttgtccaaacggtattgatatctactttgataatgttggtggatacattcttgattctgctcttcaacttatgaatgttcatggtagagttgttatgtgtggtatgatctctcaatacaaccttaaggacaagtaccaatacacccttcaagatatctctaacagaagacttactcttcaaggttgcttattcaacgattacttcccaagatgcatgggtgaatttatgcaagatat

SEQ ID NO: 14511 - DNA, 363 bp, Piromyces finnis
  ADH_zinc_N
tgttggtcaagctgttattcaaattgctaaagcatggggaattaagactattaatgttgttcgtgacagaccaaactttgatgaacttgctgatcaattacataagcttggtgccactttagtcattaaagaagaagacttacgtgctaacagtactcgtgaacttgttaagaatttaggaagtccagttcgtttaggtttaaactgtgttggtggtaaatcagccaatggaattacacgtttacttggacataatgcttctcttgttacttacggtggtatgtccaagcaaccacttacttttggtactggaccatttatttttaaaaacttaaaagcctgtggtttctggaactctcgctg

SEQ ID NO: 14512 - DNA, 276 bp, Piromyces finnis
  ADH_zinc_N
tgttggtcaagctgctattaaattatgtcaatactggggtgctaaggtatatgtcagtacttctgctcgtaagagaaaatacttggaggacttgtatggattagaacacattacagattccagaaatccaaagactttctatgaagatattatgaagtggaccaacaacgaaggtgtggactttgtcttaaatgctcttgctggtgatggtattacctatggtcttaagtgcttaaagaaaggaggtcgtttcattgaaattggaaagaaaaacat

SEQ ID NO: 14513 - DNA, 345 bp, Piromyces finnis
  ADH_zinc_N
tgttggtcaagctgctgttaagttatgtcaactctggggtgctaacattattgcctcagcatcagcttctaaacaacaattccttcgtgacacctatggtattgaacatgtcaccaactctcgtgatccagaacaattctacagtgatgttatgaaatggaccaatggtaagggtgttgactttgtcttaaactctctctctggaaagagtctccgtatgggtattaaatgcttaaagaacggtggtaagtttgttgaaattggaaaaactgatatcttgaatgatagtcaattaggtttacattgtctccttaacaatatttccttcatttcttctcacattga

SEQ ID NO: 14514 - DNA, 1014 bp, Neocallimastix californiae
  ALCOHOL DEHYDROGENASE RELATED
ggctactactttcaaggcttgggctgctcttaacgctaaagaaaagttacaaccatacgaatacactccagaaccattagctgatgaccaaattgaagttaaggttactcataatggtttatgtcacagtgatattcacatgaaggataacgactggggaaattcttcttatccattcattccaggtcatgaagttattggtaatgttgttgccttaggtgctaatgctgaaaaactttctggtcttaaggttggtgacagagttggttatggttggattcgtgatagttgtggtttctgtgaatgttgtattgaaggtcaagaaaatctttgtgaaaagggttatgaaggtactattgttggtcatcatggtggtttccaagatcgtattagaatgccagctaaatttgcttttaagattccagaaaagcttccaagtgaatatgctgctcctttaatgtgtgctggtgctacagtttataatccacttcgtttattcattgaaaaaccaaatgttaaagttggtgttattggtattggtggtttaggtcatttagctgttcaatttgctagtaaaatgggttatgaagttactgctctttctacttcttataataaaaaagaagaagctactggttttggttgtcataactttgttttattaaaggaagctgctgaaaaagttccaaattatttcgatttaattattaatacttctccatatgatatggattggaaaatgcttttaggtttacttagaccaaatggtaaattatgtttaattggtattccagctgttgatatgaaagttccagttatgccaattattttctctcaaaagactatttgtggttctattgttgctggtagaaaattcactaatgaaatgcttgaatttgctgccttaaatggtgttaaaccaaaaattgaacttatgaagttatctcaatgtaatgaagctatcgaaaaggttttagctaacaaggctagatacagaattgttttagaatctga

SEQ ID NO: 14515 - DNA, 1053 bp, Neocallimastix californiae
  ALCOHOL DEHYDROGENASE RELATED
gaaaggttatgctatggtcaaaattggtgaacctggttgggttgaaaaagaaaaacccaaatgtgggccaatggatgctatttgtaaaccattagccattgcggtatgtacttcggatgttcatactgtatgggaaggagctattggagatcgtcatgatatgattttaggtcatgaatgttgtgctgaagtagttgaagttggttctgaagtcaaagatttcaaaccaggggatagagttattgttccagctattactcctgattggaattctttagaagctcaagctggttattcgatgcattcacatggcatgcttgctggttggaaattctctaacattaaggatggggtattctctgaatatttccatgtcaatgatgctgatggtaatcttgctcatttaccttcctctattaatactgtagatgcttgtatgctttcagatatggttccaacaggttttcatgctgttgaacttgctgatattcaatttggtgatgttgttcttcaaattggtattggtccagttggtcttatgtctgttgctggtgcttctcttagaggtgcttcacgtattatttgtgttggaactcgtaaagtttgtcaagatgttgctagaaaatatggtgctaccgattttatttcatacaagaatggaactattgaagaacaagttatgaaattaactgatggcaaaggtgtcgatcgtgtatgtattgctggaggtacggtaaaaactttcgaatctgctattaaatgtcttaaaccaggaggtaagattggtaatgttaattatcttggttccggcgaattcgttaccattcctcgtgtagaatggggtgttggtatgggtcataaggatatccgaggtggtcttatgccaggtggtagacttagaatggaaaagcttgcttccctagttgtggctggtcgtctcgatctctcaccattaagtactcacgtatataacggttgggaagaagttccaaaagcattacaaattatgaaagataaaccagctgaccttattaaacctgttatcaaattctc

SEQ ID NO: 14516 - DNA, 1054 bp, Neocallimastix californiae
  ALCOHOL DEHYDROGENASE RELATED
gtctttagaaaacgttagttgtgtcttaaaccacttcccaggtgaaggtatggttaaacttgatgacatgaaaattgttaagagcgtcgttccagaattaggtgaaaacgatgttttacttaagaacctttgctgttctgttgatccattcatgcgtggtcgtatgagaaagggtgttaaatcctacgttgcttccttcgaagaaggtaagccaatgccagtcttctctgttactcaagttgctaagattggttctgctgttactgacattaatgttggtgacaagtacatgtgcttcaacggtattgaaaagtacaccgttcttccacaacaagttattaagggtgaaggtgaaaagaatcttggtagtttcaacaagattgatccaaacaacccactcaaggactctttctaccttggtttattcggtatgccaggtatgactgcttgggctttcttcaacaaggccggtaagccaaaagaaggtgaaactatcttcgttactgctgccgctggtgctgttggtcaagttgtttgccaacttgctaagcttaagggtttaagagttgttgcttgtgcttcctctccagaaaagattggtttcttaaagcaagccattaaggtcgatgaagctttcagttaccgtgacttcccagacaaggaatccttcactgctcaattacgtaaggtttgtccaaacggtatcgatatctactacgataacgttggtggatacattcttgattctgctcttgaacttatgaacattcacggtagagttattatgtgtggtatgatctctcaatacaaccttaccgaaaagtacaagtacactcttagagatattacttccagaagacttactcttcaaggttgtttattcaacgattacttcccacaatgcatgggtgaattcatgcaagatatgattccaaagttacaacaaggtaagctcatctacaaggaacacatttacaagggtgttgaaaagaccccagaagctttccttggtttattcaacagtgaaaactttggtaaggttgttattgaacca

SEQ ID NO: 14517 - DNA, 1041 bp, Neocallimastix californiae
  ALCOHOL DEHYDROGENASE RELATED
ttcaaaagctatggtatgttcaaaatatggacaaccaaaagatgttttaagtttaaaagaattaaaaattccaaaaattagggataatgaagttttagtgaaatttttagcagctccaattaatccttctgatattaatcaaattgaaggtgtttatccaattaaaccaagatttagagaatatggtgcagtgggtggtaatgaaggtgtcgctgaagtagttgctgctggttctaaagttaaaaacttaactataggtgattgggttattccagattccaaagctttcggaacttggcaaactttcgctgctagttcagaaaatgaattacaaaaaattagtaaaaacggtatttctaagataagcgctgcaactatttctgttaatcctccaacagcttatagaatgttaaaggactttgttaacttaaaaaaaggtgatgttgttattcaaaacggagctaatagtgcagttggtcaatctgttattcaaattgctaaagcttggggtattaaaactattaatgtcatacgtgacagaccaaattttgaagaagttgctggagaattacataaacttggtgctacattagttattaaagaagaggatttacgttctaattctactcgcgaacttgttaagaacttaggtagtccagttcgtttagctttaaattgtgtcggaggaaagtcagcttctggaattacacgtttacttggccaaaatgctactattgttacctatggaggtatgtctaagcaaccacttactttcggtactggtccatttatttttaagaatttacgtgcaagtggtttttggatttctcgttggaacaaagaagcttcaaagaaagataagcaatatatgtttgatgatatttgtgaacttgttcgaggtggtcatttagcagaaccatggcatgaagaaactaaatgggaaacaagtgatgataataagaccttaaataaaaagttcatgacagctcttggtaaagctggcgctagttttggaaacaaaaaacaaattttaacctttga

SEQ ID NO: 14518 - DNA, 1029 bp, Neocallimastix californiae
  ALCOHOL DEHYDROGENASE RELATED
gaccactaaagttaaaggatataaggttgaaggtaatcaattcagtaattttggagtatcacttgttgaaagaagagctttaagagatgatgatgttgaaattgatattaaatattgtggtatttgtcactcagatattatgattgtacaaattaatcaaccaggaaaaggtgttgttccaggtcatgaaattaccggtgttgtaaaatctgttggtaaggcagttacaaatttcaaagtaggtgatcatgttggtgtaggttgttttgttaactcctgtagtaactgtgaatactgtaaacgtggtgatgaacaattttgtgataagggtgtagttgttgtatttaatagtaaggattatgatggtgcaataacctatggtggttatactcaaactattatcgtcaaagataaatttgttttacatataccagattcacttgatttagctgtggctagtccacttctttgtgcaggtattactacttacagtccattaaaacgttataatattggtaaaggatctcgtgttgcaattatgggtttaggtggtttaggtcaccttggtgtacaatttgctcatgctatgggagctgaagttaccgttcttggtcattcagaatccaaaaaagaggaagccaagaaacttggagccgattgttatgaaattttaaagactgatgaagatttcaaaaaatattacagaacctttgattttattttaaattgtgctactgctaatcttaatttagataaccattttaaattattaaaaccaaatggtgtcctatgttttgttagtattgtaccagaggaacaaaggtttagtgaattaaatctttttggtaatcaagcttccataacagtttctaatgttggtggtattggtatcactcaagaaatgttaaacttttctgctgaaaaaggtattaaaccaatgattgaaatgattaaagttaaagatattccagaagcatatcaaaaaattattgattgtaaagtacattatagatatgttattgatatgag

SEQ ID NO: 14519 - DNA, 990 bp, Neocallimastix californiae
  ALCOHOL DEHYDROGENASE RELATED
gaccactaaagttaaaggatataaggttgaaggtagtcaattcagtaattttggagtatcacttgttgaaagaagggctttaagagatgatgatgttgaaattgatattaaatattgtggtatttgtcactcagatattatgatagtacaaaataatcaaccaggaaatggtattgttccaggccatgaaattgctggtgttgtaaaatctgttggtaaagcagttacaaatttcaaagttggtgatcatgttggtataggttgttttgttaactcctgtagtaactgtgaatactgtaaacgtggtgatgaacaattctgtgataaaggtgtagttattgtatttaatagtaaggattatgatggtgcaattacctatggtggttatactcaaactattatagtcagagataaatttgttttacatataccagaatcacttgatttagctatggctagtccacttctttgtgcaggtgttactacttacagtccattaaaacgttataatattggtaaaggatctcgtgttgcaattatgggcttaggtggtttaggccatcttggtgtacaatttgctcatgctatgggtgctgaagttaccgttcttggtcattcagaatccaaaaaagaggaagccaagaaacttggagccgattgttatgaaattttaaagactgatgaagatttcaaaaaatattacagaacttttgattttattttaaattgtgctactgctaatcttagtttagataaccatattaaattattaaaaccaaatggtgtcttatgttttgttagtattgtaccagaggaacaaaagtttactgaaatgaatctttttggtaatcaagctaccataacagtttctaatgttggtggtattgatatcactcaagaaatgttaaacttttctgctgaaaaaggtattaaaccaatgattgaaatgattaaagttaaagatattccagaagcatatcaaaaaattat

SEQ ID NO: 14520 - DNA, 1041 bp, Anaeromyces robustus
  ALCOHOL DEHYDROGENASE RELATED
ttctaaagcaatggtttgtgaaaagcatggtcaaccaaaagatgttttaagattaaaagaaattaaaatttcaaaaattaaggatgatgaagtcttagttaaattcttagcctcaccaattaatccttctgatattaatcaaattgaaggtgtttatccaattaaaccaagatttaaggaatatggtgctgttggtggtaatgaaggtgttgctgaagttattgctgctggttcaaaagttaagaatttaactgttggtgattgggttattccagatacaaaagcttttggtacatggcaaacctatgctactagtccagaaaatgaattacaaaaaattagtaaaaatggtatttctagtattagcgctgccaccatttctgtaaacccaccaactgcttacagaatgttaaaggattttgttaatttaaaaaaaggtgatgttgttattcaaaatggtgctaatagtgctgttggtcaatctgttatacaaattgctaaagcttggggtattaaaaccatcaatgttgttcgtgacagaccaaattttgatgaacttgcctctgaattacataaacttggtgctacattagttattaaagaagaagacttacgtgctaattctactcgtgaactcgttaaaagtttaggaagtccagttcgtttagctttaaattgtgttggtggtaaatctgcttctggtatcactcgtttacttggtcataacgctactatcgttacatatggtggtatgtctaagcaaccacttacttttggtactggtccatttattttcaagaatttacgtgcttgtggctactggaattctcgttggaataaagaagcttcaaagaaagataaacaatatatgtttgatgatatctgtgaacttattcgtggtggacatttagccgaaccatggcatgatgaaactaaatgggaagttagtgatgataataaaactttaaataaaaagttcatggaagctctcagcaaggctggtaaaagctttggaaataaaaaacaaattttaacttttga

SEQ ID NO: 14521 - DNA, 1041 bp, Anaeromyces robustus
  ALCOHOL DEHYDROGENASE RELATED
ttctaaagctatggtttgtgaaaagcatggtcaaccaaaagatgttttaagtttaaaagaactaaaaatttccaaaattaaagataatgaagttttagttaaatttttagcttctccaattaatccttctgacataaatcaaattgaaggtgtctatccaataaaaccaagatttaaagaatttggtgctgttggtggaaacgaaggtgttgccgaggttattgctgccggtccaaaagtcaagaatttagttgtcggtgactgggttattcctgacactaaagcttttggtacttggcaaacttttgccgctagtccagaaaatgaattccaaaaaattaacaaaaatggtatttcaaagattagcgcagctactatatctgtaaacccaccaactgcttatagaatgttaaaagattttgttaatttaaagaaaggtgatgttgttatacaaaatggtgctaatagtgctgttggacaatctgttattcaaatcgccaaggcctggggtatcaaaacaattaatgttgtccgtgatagaccaaactttgatgaatttgctgccgaattacataagcttggtgcaactttagttattaaagaagaagatttacgtgctaattctactcgagaacttgtaaaaaacttaggtaatccagttcgtttagccttaaactgtgttggtggtaaatctgcttctggtataacccgtttacttggtaataacgctacaattgttacctatggtggtatgtctaaacaaccacttactttcggaactggtccatttatcttcaaaaatttacgtgcttgtggtttctgggtttctcgttggaataaagaagcttcaaaaaaagataaacaatatatgtttgatgatatttgtgaacttattcgtggtggtcatttagctgagccatggcatgaagaaaccaaatgggaaactagtgatgataataaaactttaaataagaagttcaagagtgcccttagtaaagctggtgctagctttggtaacagaaaacaaattttaacatttga

SEQ ID NO: 14522 - DNA, 1051 bp, Anaeromyces robustus
  ALCOHOL DEHYDROGENASE RELATED
gactttagaaaacgttagttgtattttaaacaattacccagatggtatggttactgttgataacatgaaagtagttaaaagtccagttccagaattaggtgaaaatgatgtattacttaagaacctttgttgttctattgacccattcatgcgtggtcgtatgagagaaaatgttaagtcttatgttccttcttttgaaaagggaaaggttatgcaagttttttctgttactcaagttgaaaaaattggttctgctgttactgatattaatgttggtgataaatatatgtgtttcaatggtattgaaaaatacaccgttcttccacaacaagttattaaaggtgacggtaaacaatctcttggtagtttcaccaaaattgatcaaagaaacccaattaaggattccttctatctcggtttattcggtatgccaggtatgactgcttgggctttcttcaacaaggtcggtaagccaaaagaaggtgaaaccatctttattactgctgctactggtgctgttggtcaagttgtttgtcaacttgctaaacttaagggtttaagagttgttgcttgtgcttcatctccagaaaagattggtttcttaaaacaagctcttaaggttgatgaagcttttagttaccgtgacttcccagacaagaaatcttttactgaacaattacgtaaggtttgtccaaatggtattgatatctattacgataatgttggtggatacattcttgattctgctcttgaagttatgaacattcatggtagagttattatgtgtggtatgatctctcaatacaaccttaaggacaaataccaatacactcttagagatattacttccagaagacttactcttcaaggttgtttattcaatgatttcttcccacaatgtatgggtgaatttatgcaagatatgattccaaagttagaaaagggacaaattatttacaaggaagatatttatgaaggtgttgaaaaggcaccagaagcctttattggtttattcaacagtaataactttggtaaggttgttattgttcca

SEQ ID NO: 14523 - DNA, 1056 bp, Piromyces finnis
  ALCOHOL DEHYDROGENASE RELATED
gactattgaaaacgttagttgtaccttaaacagatacccagagggtatggttaaacttgatgattttaagattgttcaaggtccaattccagaaattagtgataatgatgttttactcaaggttctttgctgttctgttgatccattcatgcgcggtcgtatgaagaaggataacccaagttcttatgttccaccatgtcaaccaggtaaagttatccaagttttctctattacccaagttgaaaagattggtgctaatgttaccgatattaatgttggtgacaagtacatgtgtttcaacggtattgaaaaatacactgttgttccacaacaagctattaagggagatggccaaaagaacctcggtaactacaacaagattgatccaaacaatccaataaaggattcattctaccttggtttattcggtatgccaggtatgactgcttgggctttctttaacaaggttggtaagccaaaagaaggtgaaaccatttttgttagtgctgcttctggtgccgttggtcaagttgtttgtcaacttgctaagcttaagggtttaaaggttgttgcttgtgcttcttctccagaaaaaattggtttcttaaagggtgctattaaggttgatgaagctttcagttaccgtgacttcccagacaaggaatccttcgttgctcaattacgtaaggtttgtccaaacggtattgatatctactttgataatgttggtggatacattcttgattctgctcttcaacttatgaatgttcatggtagagttgttatgtgtggtatgatctctcaatacaaccttaaggacaagtaccaatacacccttcaagatatctctaacagaagacttactcttcaaggttgcttattcaacgattacttcccaagatgcatgggtgaatttatgcaagatatgattccaatggttcaatccggtaaacttatctacaaggaagatgtttacaagggtgttgaaaagactccagaagcttttattggtttattcaacagtaaaaactttggtaaggttgtcattgaaccatt

SEQ ID NO: 14524 - DNA, 1038 bp, Piromyces finnis
  ALCOHOL DEHYDROGENASE RELATED
ttctaaagctatggtttgtgaaaagcatggtaaaccaaaagatgttttaagattaaaggaacttactattccaaaaattaaagatgatgaagttttagttaaatttttagctgcaccaattaatccttccgatattaatcaaatcgaaggtgtttatccaattaagccaagatttaaaaagtatggtgctgttggtggaaacgaaggtgttgctgaagtcgttgctgctggtaacaaagttaaaaatttaactgttggtgattgggttattccagatactaaagcttttggtacttggcaaacttttgctgctagtccagaaaatgaattacaaaaaatcagtaaaaatatttcaaaaattagtgctagtactatttctgttaatccaccaactgcttacagaatgttaaaagacttcgttaacttaaagaaaggtgatgttattattcaaaatggtgctaatagtgctgttggtcaagctgttattcaaattgctaaagcatggggaattaagactattaatgttgttcgtgacagaccaaactttgatgaacttgctgatcaattacataagcttggtgccactttagtcattaaagaagaagacttacgtgctaacagtactcgtgaacttgttaagaatttaggaagtccagttcgtttaggtttaaactgtgttggtggtaaatcagccaatggaattacacgtttacttggacataatgcttctcttgttacttacggtggtatgtccaagcaaccacttacttttggtactggaccatttatttttaaaaacttaaaagcctgtggtttctggaactctcgctggaataaggaagcttcaaagaaggataagcaatatatgtttgatgatctttgtgaacttattcgtggaggttatttagctgaaccatggcatgatgaaactaagtgggaacttagtgatgataacaaaactttaaacagaaaattcatgaaagcacttagcaaagcaggagctagcttcggtaacaagaaacaaatcttaactttcga

SEQ ID NO: 14525 - DNA, 390 bp, Neocallimastix californiae
  Aldolase_TIM
gaatcctaatacgcataaaaaatggattgatctggcttcaaccatgggatggagattctacattttagatgaaggatggcaaccagatagttatgacaatgatggtagttattactcgggttggtttgattggtggccagaagttagagattatgctaaaaggaagggggtacaacttattgcctgggttcacaagaatgatgtggatacaccggaaaagagaagaaaaaggtttaaggaatggtcagaggaaggaattgttggtattaaagttgatttcttcttcaatgaggctcaaagtaccttacaacttcatcaagatatttataaagaggcggccaggtaccatttactcgttaatgttcatggttctaatccaccatcaggaga

SEQ ID NO: 14526 - DNA, 795 bp, Neocallimastix californiae
  Aldolase_TIM
cgcaccaaaattagttaaatctgctaataatggtaagatttacgttgaaactcgtttcagtcgtttacttggtaaaccaccacttatggttggtggtatgactccaactactgctaatgaaaaccttgttagtgcttgtattaatgctggttatcatattgaattggctggtggtggtcaacactctactcaaatgattcgtgatcgtattaagaagattatgtcaaaggttccttctggtgaaggtattactatgaatattatgttcttaaatgccttccaatggggtttccaatatccattagttcaagaaatgagaaaggaaggtgttccacttgatggtttatgtattgctgctggtgttccaagtcttgatgttgctaatgaaattcttggtaatttaaaggcctgtggaattaaacatgttgctttcaaaccaggtagtgtatctgctattcaacaagttattgctattgctaagcaaaatccagatatgccaattattatgcaatggactggtggtcgtgctggtggtcaccactctttcgaagatttccatcaaccaattattgatacttatgcttctattcgtcgtcaaccaaatattattattgttgttggtagtggttttggtgatgctgaaggtacccttccatacttaactggtgaatgggctcgtaagtttggttatccaccaatgccatttgatggtattttattcggtagtagaattttagttgctgctgaagctggtaccagtgaagaagttaagaagttattagttaaatctgaagg

SEQ ID NO: 14527 - DNA, 795 bp, Neocallimastix californiae
  Aldolase_TIM
cgcaccaaagttggtaaaatctgctaataatggaaaaatttacgttgaaacccgtttcagtcgtttactcggaaagccaccacttatggtaggtggaatgacgccaactactgcaaatgaaaatcttgttagtgcatgtatcaatgcaggttatcatattgaattagctggtggtggtcaacactccactcaaatgattcgtgaccgtattaagaagattatgtcaaaagttccttctggtgaaggtattaccatgaatattatgttcttaaatgccttccaatggggtttccaatatccattagttcaagaaatgagaaaggaaggtattccacttgatggcttatgtattgctgctggtgttccaagtcttgatgttgctaatgaaattctcggtaatttaaaggcctgtggtataaaacatgttgccttcaagccaggtagtgtatctgctattcaacaagttattgctattgctaagcaaaacccagatatgccaattattatgcaatggactggtggtcgtgctggtggtcaccactcttttgaagatttccatcaaccaatcattgatacttatgcttctattcgtcgtcaaccaaacattattatcgttgttggtagtggtttcggtgatgctgaaggtacccttccatacttaactggtgaatgggctagtaaattcggttatccaccaatgccatttgatggtattttattcggtagtagaatcttagttgctgctgaagctggtactagtgaggaagttaagaagttattagttgaatctgaagg

SEQ ID NO: 14528 - DNA, 795 bp, Anaeromyces robustus
  Aldolase_TIM
cgctccaaaattagttaaatctgctaataatggtaagatttatgttgaaactcgtttcagtcgtttacttggtaaacctccacttatggttggtggtatgactccaactactgctaatgaaaatcttgttagtgcttgtattaatgctggatatcatattgaattagctggtggtggtcaacactctactcaaatgattcgtaaccgtattaagaagattatgtctaatgttccatgtggtgaaggtattactatgaatattatgttcttaaatgctttccaatggggtttccaatatccattagttcaagaaatgagaaaggaaggtatcccacttgaaggtttatgtattgctgctggtgttccaagtcttgacgttgctaatgaaattctttccaacttaaaggcttgtggtattaaacatgttgctttcaaaccaggtagtgttagtgctattaaacaagttattgctattgccagacaaaatccagatatgccaattattatgcaatggactggtggtcgtgctggtggtcaccactcctttgaagatttccatcaaccaattattgatacttacgctattattcgtcgccaaccaaatattattattgttgttggtagtggtttcggtaatgctgaaggtactcttccatatttaactggtgaatgggctcgtaagtttggttatccaccaatgccatttgatggtattttattcggtagtagaattttagttgctgctgaagctggaactagtgaagaagttaaaaaattattagttgaatctgaagg

SEQ ID NO: 14529 - DNA, 762 bp, Piromyces finnis
  Aldolase_TIM
taagatttacgttgaaactcgtttcagtcgtttaattggtaaaccaccacttatggttggtggtatgactccaactacagctaatgaaaatcttgtcggtgcttgtataaacgctggataccacattgaattagctggtggtggtcaacactccactcaaatgattcgtgaccgtattaagaaaattatgtctaaggttccatctggtgaaggtatcactatgaatattatgttcttaaatgctttccaatggggattccaatacccacttgttcaagaaatgagaaaggaaggtattccacttgaaggtttatgtattgctgctggtgttccaagtcttgatgttgctaatgaaattctcgctaacttaaaggcttgcggtattaaacatgttgcttttaagccaggaagtgtttctgctatccaacaagttattgctattgctaaacaaaatccagatatgccaataattatgcaatggactggtggtcgtgctggtggtcaccactctttcgaagatttccatcaaccaattattgatacctatgctgctattcgtcgtcaaccaaatatcattattgttgttggtagtggtttcggtgatgcagaaggtactcttccatacttaactggtgactgggctcgtaagttcggatatccaccaatgccatttgatggtattttattcggtagtagaatcttggttgctgctgaagctggtactagtgaagaagttaagaaattattagttgcttctgaagg

SEQ ID NO: 14530 - DNA, 762 bp, Piromyces finnis; identical to SEQ ID NO: 14529
  Aldolase_TIM

SEQ ID NO: 14531 - DNA, 762 bp, Piromyces finnis; identical to SEQ ID NO: 14529
  Aldolase_TIM

SEQ ID NO: 14532 - DNA, 762 bp, Piromyces finnis; identical to SEQ ID NO: 14529
  Aldolase_TIM

SEQ ID NO: 14533 - DNA, 2379 bp, Neocallimastix californiae
  ALPHA-L-FUCOSIDASE 2
atggagtaatggtggtgaaagatctaatcaaacttggcttttcgaaaaggttgaaggtccttctgaagaagatcttcatccaaaggcagcattgaaactttggtatgattctcctgcaagagcttggaccgatgctttaccagtaggtaattctcatcttggtggtatggtttatggtggagctcaacgtgatgaaattcaattgaacgaagatactttctgggccggaggtccacataataatattccaagaaatgctgcttctgctttaccacaagctagaagaatgattttcgaaggtagatttggtcaagctcaagattacattgataaaaacttctttaccggtcaaaatggtatgggttatcttacattaggtagtctctttatcaatttctctgatgtaagtggattctccaattattatcgtgatttagatcttaataatgctatcgctaccagtaaatttactgccaatggatctaatatagaacgttccttatttgcttcaatggctgatgatgttattgtttacaatattgctacggatggtaaacctcttaacttcagtgtcaatcataaatgtccacttcaaacgaatgcttcttcaagtggtaaccgtttaattcttaagattagaggtaaggatcaagaaggtgttggtgctaaacttaatgcctacgttatcgttgaaattgtttctgatggaagagttagtgctagtggttcaagccttaatgtatccaatgctaaggaagctaccatcttaatttccgctgccactaactttgttaactatcatgatgtttctggtgatgctgctaagaaggctgaagccgctctcagtaaagttaagaatgttgattattctaccttaaagagtaaacacattgaagcttacaagaagcaattcgatcgtgtaaagatctctcttccaacaagtagtgcttctgccgatcaaactgtcaatagaattcttaacttcaatagatctgatgatcaagatcttgtcgctttaatgttccaatacggtcgttacctcttgataacttcttctcaaccaggtggtcaagcagctaaccttcaaggtatttggaatgattccactgatgctccatgggatagtaaatacacaatcaatatcaatgcccaaatgaattactggccagctgaagttactaacctcagtgaatgtcatgaaccaatgtttgatctcattcgtgatctttccgttactggtaaggaagctgcctccaaaatctacggtgctgaaggttggatggctcaccacaacacagatatctggcgtgttaccggtccaattgatggtgccttctggggaatgtggccaaacggtggtggatggttatctactcacatctggcaacattaccttttcactggtgacaaagacttccttaagaacaactatgccatcttaagagatagtgctaagttctatgttacaagtatgcaaaaggatccaaacaccggattcttggttactgtaccatccacttctccagaacatggttattcttcagatggttcatccatgaccgctggttgtactatggataaccaaattgctttcgatgtcttgaaccaagctcttcttgctgctcaaacccttggtgttgatgaaagcttccaatccaccttaaagagtaccatgaacaatattgctccaatgaaggttggtcaatacaatcaattacaagagtggtttgttgatgctgataatccaagagatgatcatcgtcatgtatctcacctttacggtctctacccaagtggtcaaatttctccattcaagcaaccacttttatttgaagctgctaagaatacccttaatcaacgtggtgatatggctaccggttggagtattggttggaagattaacctttgggctagacttttagatggtaaccatgcctataaaattattcaaaatatgattaatcttgttcgtgataacgatggaggtaatggtagagtctataccaatctttttgatgctcacccaccattccaaattgatggtaactttggtttctgtgctggtattgctgaaatgcttttacaaagtcatgatggtgctgttcatctccttccagccttaccaaatgtttggaaagaaggtagtgttagtggtttagttgctcgtggtggttttgaagtcagtatggattggaagaatggtaaaattagtaaggccactattaaatctaagattggtggttccttacgtattcgtagtaatactccactctctggacaaggtattaaaactgctcaaggtacctgtaaaaacgctttacttctttcaccagatgttaaaaaaccagaaatttccaataaatcttccattaagggtcc

SEQ ID NO: 14534 - DNA, 2373 bp, Anaeromyces robustus
  ALPHA-L-FUCOSIDASE 2
atgggttaatggtggtgaaaaagataatcaaatttggattttcgaagctattaaagctccaagtgaagaagatcttgaagtaaaatcagcaggattaaaactttggtataataatccagctggagaatggactgaagctcttccagtaggtaattctcatcttggtgctatgatatatggtggtgctcaacgtgatgaattacaattaaatgaagatactttctgggctggtggtccacataacaatattccaggaaatgctgctaatgctttaccacaagctcgtcaaatgattttcgaaggtagatttggtcaagctgaaaattacattaatcaaaatttcttcactggtcaaaatggtatgggttatcttactttaggaagtcttttcattaatttctctgatattaaggattactcaaattactatcgtgaattagatatcagtaatgctattgctactactacctttaatgctaatggaggaagtatggaaagaacattatttgcttctatgactgatgatgttttagtttatcatatttcttctgaaaaagctactagtttctctcttagtcataaatgtgctctttcaacttctgtttcatcctctggtaatcgtttaattattcaagttagaggtaaagatcaagaaggtgttagaggacaactttctgcttacggtattgctgaagttgttactgatggtagagtaagtgctagtggttcatcactttcagtttctggtgctaaggaagctatgattattttctctgctgctactaactttgttaattatcgtgatgtttctggtgatgctaagaagaaggttgaagctactttacaaaaggttaaaaacgttgcttatgaaacattaaaggaaagacatattgaagcttacaagaaacaattcgatcgtgttaagatagctcttccagttaacagtagtgctcaaaacccaactatggatagattagctaatttcaacagatcaggagatcaagatcttgtagctttaatgttccaatatggtcgttatttattaatttcttcttctcaaccaggaggtcaaccagctaatcttcaaggtatttggaatgatagtactgatgctccatgggatagtaaatataccattaacattaatgctcaaatgaattactggccagctgaagttacaaatcttagtgaatgtcatgaaccattattctcacttattcgtgatctttccgttactggtaaggaagctgcttcaagaatttataaggctgaaggttggatggctcaccataacactgatatctggcgtatctctggtccagttgatggtgctttctggggtatgtggccaaatggtggtggatggctttctactcacatctggcaacattatcttttcactggtgacaaagatttccttgaagaatattatccaatcttaagagatgctgctaaattctttgtttctagtatggttaaagatccaaatactggttacttagttactgttccatctacttcaccagaacatggttattcttctgatggttcatcaatgactgctggttgtactatggataaccaaattgcttatgatgttttaaatcaagctcttcttgctgctaaaactcttggtgttgatgactccttccaaaagactttacaaaatactatgaataatattgctccaatgcaagttggtcaatacaatcaattacaagaatggtttgttgatgctgataatccaagagatgatcattgtcatgtttctcacctttatggtctttacccaagtggacaaatttctccattcaaacaaccacttttattcgaagcttcaaagaatactcttactcaacgtggtgatatggctactggttggagtattggttggaagattaatctttgggctagacttttagatggtaatcatgcctataagattattcaaaatatgcttgttcttattagaagtggtgttgatggtagagtttatggtaatatgtttgatgctcacccaccattccaaattgatggtaactttggtttctgtgcaggtattgctgaaatgcttttacaaagtcatgatggtgctgttcatcttcttccagcacttccaagtgtatggagtgatggtagtattagtggtttagttgctcgtggtggttttgaagttagtattacttggaagagtggtaaggttactaaagctagtattaaatctaaaattggaggatttttacgtgtacgtagtaacactccactttcaggtaaaaatgttacaactgcttctggtgattgtaagaatccacttttactttctgttagtgttaaagatccaaagatttcttcaagagctagtattggaaaacc

SEQ ID NO: 14535 - DNA, 2376 bp, Anaeromyces robustus
  ALPHA-L-FUCOSIDASE 2
atggactaatggtggtgaaaagaatcatcaagtatggacttttgaatcagttagtgctccatctgaaaaagatcttaaagctaaatctatgaaactttggtatgatattccagctagagaatggactgaagcacttccagtaggtaactcgcaccttggagcaatgatatatggtggagtacaacgtgatgaattacaattaaatgaagaaactttctggggtggtggtccacataataatgttgtaaataatgcttttccaaaaattcaacaagctcgtcaaatgatttttgatggtaaatttatgcaagctgaaaattacattaatcaaaattgcttatctggtatagatggtatgccatatcttccattgggaagtcttttcattaattattctgatataaaagaatattcaaattattatcgtgaattagatattagtaatgcaatgacaaccactaaatttactgctaatggtgttaatatggaaagaactttatttgcatctatgactgatgatgtattagtttatcatattacatctgatccaaaaaagcctattagtttttctcttagttatcaattcccaagacttacaaactccatttcaacatctggtaaccgtttaattataaaggttaatggtaaggatcatgaaggtgttaaaggacgtgttactgcatatggtattgctgaagttgtcactgatggtaaagtaaatggtaatggttcaacactttctgtatcaggtgctaatgaagctattatctttttctctgctgctactaattttgtaaactataaagatgtttctggtgatccaaagaaaaaagctgaagctgctttagaaaaggtaatcaatacttcttatgaaacattgaagaaaagacatattgaagcttacaaaaagcaatttgatcgtgtaaaattatctcttccaatgaatgcttatgctcttaatccaactatggatagattagctaatttcaataaatctggagatcaagatcttgtaactttaatgttccaatatggtcgttatttattaatttcatcatcacaacctggtggtcaaccagcaactcttcaaggtatttggaatgataatattgatgctccatgggatagtaaatatactattaatattaatattcaaatgaattattggccagctgaagttactaatcttagtgaatgtcatgaaccattatttgaacttattcgtgatctttcagtttctggtagagaatctgcttcaaaactttataatgctgaaggatggatggctcatcataacactgatgtttggcgtatttcgggacctattgaaggtgcttattggggtatatggcctaatggtggtgcttggctttctactcatatatggcaacattatcttttcactggtgataaagaattccttaaagattattatgaagtattaaaaggagctgctcaattctttgttactgatttagttagagatccaaatactggatttttagtaacagttccatcaggatcaccagaacatggttattcagctgatggttcagctatgactgctggttgtactatggataatcaaattgcttatgatactatgaatcaagcacttcaagctgctaaaattcttggtcttgatcaagatttccaaaaaactttacaacaaactatggatggtttagctccaatgcaagttggtcaatacaatcaattacaagaatggtatgttgatgctgataatccaagagatgatcatcgtcatgtatcacatctttatggtctttatccaagtgcacaaatttcaccatttaaacaaccacttttattcgaagcttcaaagaatagtcttactcaacgtggtgatatggctactggttggagtattggttggaaaatcaatctttgggctagactttttgatggtaatcatgcctataaaattattaagaatttacttaatcttattagatcaggtgtagatggaagagtttatgctaatatgtttgatgctcatccaccattccaaattgatggtaactttggattctgtgctggtattgctgaaatgcttgtacaaagtcatgatggtgctgttcatcttcttccagctcttccagatgtttggggagatggtagtgtaagtggattaatggctcgtggtggttttgaagtaagtattacttggaagagtggtaaggttactaaagccagtattaaatctaagattggtggatctttacgtgtacgtagtaatgttcaactttcaggtaaaggtgttaaaactgctgaaggtgattgtaaaaatccacttttactttctagtgatgttaaaactccaagaatttctccaagatctaatattggaaaacc

SEQ ID NO: 14536 - DNA, 2385 bp, Piromyces finnis
  ALPHA-L-FUCOSIDASE 2
tcaatggactggtggtggtgaaaagggtaatcaaacttggcttttcgagtccgttagtgctccaacagaagaagaaactcatccaaaagctgacttaaaactttggtacaactcacctgctaatgcatggactgaagctcttccagttggtaattcacaccttggtggaatggttttcggaggggcacaaactgatgaaattcaattaaatgaagaaactttctgggccggcggtcctcacaacaatatcccacaaagagctaattcagtcctttcacaagctcgtcaacttattttcagtagcaaatttggtgatgctcaaaatttaattgataaaaacttcttctcaggtcaaaatggtatgggatatcttactttaggtagtctttacattaaattctcagatgttaaagatgtttcaaactattatcgtgatcttgatctcaatactgctattgcaacttccaagtttacttccaatggaatgaatgtagaacgttcattgttcgcttctatggctgacaatgtattagcttacaagattactaatgaaaacaaaccaattagttttactgttagtcataaatgtcaacttagtacttctgtttcaacaagtaataatcgtatgattcttaaaattagaggtaaggatcaagaaggtgttggatcaaaactttctgcttatggtattgtagaaattgttaccgacggtagagtatctgcaagtggttcatcactttctgtttcaggtgcttatgatacagttatttatatcactgctgccaccaactttgtttcttacaacgatgttagtggagatgcccagaaaaaggccgaagccgctattcaaagcgcattaaaatcaacttactcatctcttaaagataaacatcttgctgcttacaaaaagcaatttgatcgtgtaaagatttctcttccagtaaatagcaatgctgaaaatcaaactgtcgatcgtttagccaatttcaatagatctggtgatcaagatcttattgctttaatgttccaatatggtcgttatttattaattacatcatcccaaccaggtggtcaaccagctaatttacaaggtatttggaatgatagtattgatgcaccatgggatagtaaatacactatcaatattaacactgaaatgaactactggcctgctgaagttacaaatcttagtgaatgtcacgatcctcttttctcacttattcgtgatctttcagttaccggaagagaagctgcatcaaaaatatataacgctgaaggttggatggctcatcataacactgatatctggcgtattactggtcctgtagatggtgcttactggggtatgtggccaaacggtggtggatggctctctactcacatctggcaacactacctctttactggtgacaaggatttccttaaccaaaattactctattttaaaagaagctgcaaagttctttgtttcaagtatggttaaagatccaaacactggatatttagctaccgttccatccacatctccagaacatggttacagttatgatggatcatccatgacctctggttgtactatggataaccaaattgctttcgatgttttaaaccaagctcttcttgcagccaaaacccttggtgttgatgaatctttccaaaaaactttacaaaataccatcaatagtattgcaccaatgaaggtaggtcaatacaatcaattacaagaatggtttgttgatgctgataatccaaaggatgatcaccgtcatgtatcacatctttatggtctttacccaagtggtcaaatttcaccattcaaacaacccctcttatttgaagccgctaaaaacactcttacccaacgtggtgatatggccacaggttggagtattggttggaaaattaatctttgggcaagacttttagatggtaaccacgcctataaaatcattcaaaatatgcttaatcttttaccaactggtcaagacaatagtaatggtagagtttatgctaatcttttcgatgctcacccaccattccaaattgatggtaactttggtttttgtgctggtattgctgaaatgcttttacaaagtcatgatggtgctgttcatcttcttccagctattccagatgtctggaatgaaggtagtattagtggtttaattgcaagaggtggtttcgaagttgatatgatttggaagagtaaaaagattaccaaagccactataaagtctaagattggtggagttttacgtattcgtagcaatacccaactttcaggagaaggtttaaagactgctgaaggtacatgtaaaaatcctttattactttcatcagatgttaagaaaccagaaatttcatctaaggctagtattaaaggacc

SEQ ID NO: 14537 - DNA, 150 bp, Neocallimastix californiae
  alpha/beta-Hydrolases
taactactgtggtcaagctactaaggaaatatttgatgctcttggtgctactgataaatacacttacactcaagaaggtggtcacatgcactgttcattaccaaacggacaattcgatgaagtcaaggactttgtaaataagttcctttt

SEQ ID NO: 14538 - DNA, 558 bp, Neocallimastix californiae
  alpha/beta-Hydrolases
gacttgccgtcgtgaagaaatcgccgctacatttgaaaagatcatgttcggtgaaaagccacgtaatccagataaggttgaaggaagaaaatctggtaacaagtataccgtcactgttaccaacaagggcaatactgcctcatttgatgttactatcagtaacgctggtacagctgctaaaccaaagccagctattattggtttagaccaaggttttggtatgggtggtagtttaggcgcttcaaccaatggtcttgatgttgcctcaattacctttaacaccaataatcttgctccagaaaacaatccaagaagtggtgccttctttaaggctaacccaagtagtaatgccggtaccattatggcttgggcctggggtgttagtcgtttaattgatgcccttgagaaggattcaagtgttggtattgatgttaaacaccttgctgttactggttgttcacgtttaggtaaggctgctcttgccattggtgcttttgatgaacgtattgctctaactattccacaagaatccggttctggtggtgcttctctttggcg

SEQ ID NO: 14539 - DNA, 480 bp, Neocallimastix californiae
  alpha/beta-Hydrolases
taaattccctaacggttacagaggtgataagccaactcctcttcttattaactaccatccaattatgggtagtgcctctcaatgggaaggtggttctcaaaccgctaaggccgctcttaatgatggtgccattgtagccttcatggatggtgctcaaggtccaatgggtcaagcttggaatgttggtccttgctgtactgatgctgatgatgtcaaattcactcgtgacttcattaaggaaattaccaataaggcttgtgttgatccaaaacgtatttacgctgctggtttctccatgggtggtggtatgtctaactacgctggttgttacctttctgatgttattgctgctgctgctccatctgctttcgatcttgctaaggaaattgttgatgctggtaagtgtaagccatctcgtccattcccaattcttaacttccgtggtacctctgaccaaattgttatgtataatggtggtct

SEQ ID NO: 14540 - DNA, 72 bp, Neocallimastix californiae
  alpha/beta-Hydrolases
tgaaatgtatgaaaactgtaatggtggtgttaaggttggtctctgtaccattaatggtggtggtcacaatga

SEQ ID NO: 14541 - DNA, 531 bp, Neocallimastix californiae
  alpha/beta-Hydrolases
tcgtggaatcattcaattcccatggtctggtggtagacgtaaggttattattgatcttccagataattatgataaaaataagccttaccgtttaattttcggtatgcaatgtatgggtggttcatctgataatgttcgtagtgaaggttactatggtttaaagccattagatactggaaaaacttctattttcgttgctccagaaggtaatggtcaacaattaccatggggtgaagccgattacagattatttgatgaacttcttgataagttaaaggaagatctttgtattgatgaatctcgtgtcttctctactggtttcagttatggatctatgtattctaatggtctttcctggaatcatcaaaaggtacttcgtggtgttgctgtttatgaaacagctgaacgtaacatctggttaccaaagcacactggtgaaccaattgcatggatgggtgttcttggttttgatgatggtctctgtactccagaaatgggtcgtcatgctcgtgatattattcttgaacacaa

SEQ ID NO: 14542 - DNA, 516 bp, Neocallimastix californiae
  alpha/beta-Hydrolases
gtctggtggtagacgtactgtacgtattgatattccaaacaactacaacaaccaaaatccataccgtttagtcttcggtatgcactgtatgggtggttgggccggaggtgtccaacaagaaggttactatggtttaaagccattagatactggtaagactactattttcgttgctccagaaggtaatggtaacgttgctccatggggacaaggtgattacaaattatttgatgaacttcttgaaaaaatgaagaatgatctttgtattgatgaatctcgtgtcttctctaccggtttcagttacggttctatgttctcaaatggtctttcctgggatcaccaaaaggttcttcgtggtgttgctgtttatgaaactgctgaacgtaatatctggcttccaagacacactggtttaccaattgcatggatgggtgttctcggttttgatgataatgtttgtactccagaaatgggtcgccatgctcgtgatattattcttgaacacaactccgaagg

SEQ ID NO: 14543 - DNA, 93 bp, Neocallimastix californiae
  alpha/beta-Hydrolases
ccgttggtgtactcaatccggtggtcacctttgggatcacaaggacccaggtcaaaaccaatcatgggttccaaaagccacttgggaattcat

SEQ ID NO: 14544 - DNA, 717 bp, Neocallimastix californiae
  alpha/beta-Hydrolases
caaacctgcttgggtttacttaccagctggatatgatgccaatgataaggatactaaatacccattagttattttaatgcacggttatggtatgactgaagatagttggggtcttaccgataagagttctggtggtagaattaagagtatgatggatagaggtatggctaagtctaaggatgaagaagattacgttgaaaagtttattcttgttgttccaactggtttagctagtaaggattacagaaacaacaatgattacaattacactgatccatggtacgccttcggtggtgaacttagaaatgatcttattccatttatgagaagtaaatacaacattaaggatggtcgtgaaaatgttgctatggctggtctttctatgggtgctgaagaaaccttaaaccttggtattggtgaatgtcttgatttaattagttactttggtgccttctctttcccattcggtgaaactatgattgaaaaggctgaaaaggctttcccagataagagtttaacgattaagactctttacactatttgtggtgataatgattccattgcctatgataaatacggagatgctgttgaaaagatgagtaagtgggacagagttgaagatggtaaattcaaatctgaaatttacgttggtggtactcatgacttcccagtctggttcagaggttttgaacactttattccattattattcaaaaa

SEQ ID NO: 14545 - DNA, 483 bp, Neocallimastix californiae
  alpha/beta-Hydrolases
tgtaaaattcccaagtggtttctcaggtgataaggctgctccacttcttattaactatcacccaattatgggtagtgcttctcaatgggaaggtggttctcaaactgcaaaggctgcccttagtgatggtgcaattgttgcctttatggatggtgcacaaggtccaatgggtcaagcttggaacgttggtccatgttgtactgatgctgatgatgttcaatttactcgtgatttcattaaggaaatcactagtaaggcttgtgtagatccaaagcgtatttacgctgctggtttctctatgggtggtggtatgtctaactacgctggttgtttcctttctgatgttattgctgctgctgctccatctgcctttgatcttgctaaggaaattgttgatgctggtaagtgtaagccaactcgtgctttcccaatacttaacttccgtggtactcaagataacattgttatgtacaatggtggtct

SEQ ID NO: 14546 - DNA, 72 bp, Neocallimastix californiae
  alpha/beta-Hydrolases
tgaaatgtacgaaaactgtaaggatggtgctaaggttggtctttgcactattaacggtggtggtcactctga

SEQ ID NO: 14547 - DNA, 486 bp, Neocallimastix californiae
  alpha/beta-Hydrolases
cattgtaaaattcccaagtggttacaccggaaatgaagctactccacttctcattaactatcatccaattggtggtagtgcctctcaatgggaaggtggttctcaaactgctaaggctgcccttagtgatggtgccattgttgccttcatggatggtgctcaaggtccaatgggtcaagcttggaatgttggtccctgctgtactgacgctgatgatgttcaattcactcgtaactttattaaggaaattacgagtaaggcttgtgttgatccaaaacgtatttacgctgcaggtttctctatgggtggtggtatgtctaactatgctggttgttaccttgctgatgtcattgctgctgctgctccatcggcctttgatcttgctaaggaagttgtcgatgctggaaaatgtaagccagctcgtccattcccaattcttaatttccgtggtactcaagatccaattgttatgtacaatggtggtct

SEQ ID NO: 14548 - DNA, 855 bp, Neocallimastix californiae
  alpha/beta-Hydrolases
aaacccaccacaaagtgttaaggctacttattctggaggtactttaactgttgttgtcaatgataatggtggtagtcttactcttacttctaagattaccgttccaagtggtaatggtccattcccagttattattggtatgaacagtgctactggttctcttggtagtaatttattcagtggtttcattcaagttccattcatgcatgatcaatgtgctacatactctatgaatggtcaaaagaacactaacgctccattctacaaaatgtatccaaatcttaaacaagctggtgattacatcgcctggtcttggggtgtttctcgtcttattgatggacttgaacaagttaaaagtcaaattcatgccgatatggctcacatcggtgttactggttgttcttacgctggtaagatggctctctttgctggtgctttcgatgaacgtattgctttaactatcccacaagaatctggtggtggtggtattaacgcctggagagtttctgataccatcggtaatgttgaaaagattgataatactaattactcttggttcatgcaagccttaaagaataactttggtagcaacaaagctggtaaattaccatatgatcaccatgaagctattgctatgattgctccacgtgctgtcttcgctatgggtaacccagattacgaatggttaggtgataagtctggttatacttctgctatggctgcctatgaagtttggaaggctatgggtgttgaagatagatttggtttcaactttattggtaatcatatgcactgttctgctcataataatcaaaacagtgatgttactaagtttattgataagttccttcgtgg

SEQ ID NO: 14549 - DNA, 504 bp, Neocallimastix californiae
  alpha/beta-Hydrolases
tgaacaagaaggtatttcttatggtactctccaaagaattacttattattctgaaaatactaaatccaatcgtccaatgaatattcttcttccaccaaactataatccggaaaagaaatacccaattttatatcttttacatggtattttatctgaccagaattcattaattaaatcaaaatatggtacaccaaacatagctggttatttaatgaataaaggtatggctaaagaaatgattattgcttatccatatacttatgctccaaaagacggtattgaagttgaaccaggatttactaaggaacatgccgccggttatgataattttattaatgaattactctttaatattatgccatatatggaaaagaattatccaattcttactggcagagataatacagctattgctggtttttcaatgggtggtcgtaacagtctttatattggttattctaagccagaattatttggttatattggtgccttctcaccagctcc

SEQ ID NO: 14550 - DNA, 717 bp, Neocallimastix californiae
  alpha/beta-Hydrolases
tggtattaatggaggtaattcattaaatgtctacttaccatatggttacgataagaataagcaatataatatcttttatcttatgcatggtggtggtgagaatgaaaacactatattcagtaatgatgtaaaacttcaaaatattattgatcatttaataatgaatggtgaacttgaaccattaattattgttactccaaccttcaataaatgtgaagctcgtactttttacaaggaattccgtgaatcagttattccattcgttgaaggtaaatattctacttatgcaaaatctgtttctccaagtgatattaaggcttcaagaatgcacagagctttcggtggtttctctatgggttctgcttctacatgggctgtcttagtcaactgtttagatattgtcgcctactatatgccacttagtggtgataactgggaagctaatggtggttacggcaaggctaaatcagttgctgatgctattaacagagcaggtctaaagagtaatgaattctttattttctgtgctactggttcagaagatattgcttatccaaatatgaatccacaaatggatgaaatgaagaagatgcaaccatttatttacacttcagatttctctaagggtaatttctactatcttgtagctccaggtaagactcactggtggggatatgtcaaacattacatttatgatgctcttccatcatttttcca

SEQ ID NO: 14551 - DNA, 525 bp, Neocallimastix californiae
  alpha/beta-Hydrolases
tttcgaatttaattggtctggaggtaaacgtactgtacgtattgatattccaaataattatgataacaagcatccataccgtttagtatttggtatgcactgtatgggtggttgggccggaggtgtccaacaagaaggatattatggtttaaagccattagataccggtaaaactactatttttgttgccccagaaggtaatggccaacaagctccatggggtcaagctgattaccaattatttgatcaacttcttgaaaaattaaagaatgatctttgtattgatgaatctcgtgtcttctcaactggttttagttatggttctatgttcagtaatggtttatcatggaaccatcaaaaagttcttcgtggtgttgctgtctatgaaactgctgaacgtaatatttggcttccaaaacatactggtgaaccaattgcttggatgggtgtacttggtcttgatgatggtctttgtactcctgaaatgggtcgtaaagcaagagatattattcttgaacacaattc

SEQ ID NO: 14552 - DNA, 516 bp, Neocallimastix californiae
  alpha/beta-Hydrolases
gtctggaggtagtcgtaaggttcttattgatattccacaaaattatgatagtagtcatccataccgtttagtatttggtatgcaatgtatgggtggttccgctggaaatgttcgtaatgaaggttattatggattaaagccattggatactggaaagactactatttttgtagctcctgaaggtaacggtcaacaattaccatggggtgaagctgattacaaattatttgatgaacttcttgaaaaattaaagggtgatctttgtattgatgaatctcgtgtcttctctactggttttagttatggttctatgttctcaaatggtctttcttggaatcaccaaaaggttcttcgtggtgttgctgtttatgaaactgcagaacgtaatatttaccttccaacacatactggtgatggtattggttggatgggtgtccttggttttgatgataatctctgtactccagaaatgggtcgtgctgctcgtgatatcattctttcccacaattcacaagg

SEQ ID NO: 14553 - DNA, 102 bp, Neocallimastix californiae
  alpha/beta-Hydrolases
acgttggtgtactcaatcaggtggtcacctttgggatcacaaggatccaggtcaaggtcaatcatgggtaccacaagctacttgggaattcattaacaagtt

SEQ ID NO: 14554 - DNA, 756 bp, Neocallimastix californiae
  alpha/beta-Hydrolases
aaaagatggtgtggaatacccagctattgaaaatatctcttactattccacaactactcaaagtgaacgtccattagttgttgttcttccaccaaattacaatgaaaagaagaagtacccagtcgtttacatattacacggtattatgactgatggtagtttcatgttacaagaaggtttcggtactgttactatcccaggaaatttattccataagcacatggctaaggaatttattatggttcttcctaatcaatacgctccagctccaggaaccgaagttgaacctaatttaaatgaagaatattttgctggttacaataacttcattaatgatttagttaatgatatcatgccatacatgaaaaaacattattctattgctactggtaagaaaaacacggccatatgtggttactcgtttggtggaagaaatagtttatacattggtttaaagagaccagatttatttggttacgtcggttccttctctccagctccaggtattcttccaggggatgatgtctttactggtcatcataatggtttatttaaagaagaaaaggatgtagtttttgcaggtaaaccaccatatcttaccatgatttcttgtggtactaatgatactgtcgttggtaccttcccaaaaagttatcatgaagctttaacccataataaccaacaacatatttggtatgaaatgactggtcttgaccatgctgatgatgccgccattaattctccatattacaactt

SEQ ID NO: 14555 - DNA, 381 bp, Neocallimastix californiae
  alpha/beta-Hydrolases
cgtaaagttcccaagtggttattctggtgataagaatgttccacttcttattaattatcacccaattggtggtagtgctactcaatgggaaggcggttctcaaactgctaaggcagctcttaatgatggtgctattgttgctttcatggatggtgctcaaggaccaatgggacaagcttggaatgttggtccatgttgtactgatgctgatgatgttcaatttactcgtgacttcatcaaagaaatcacaagtcaagcttgtgttgatactaatcgtatttatgcagcaggtttctccatgggtggtggtatgtctaactactcaggttgtatgcttgctgatgttattgcagcagcagctccatctgcatttgatctttc

SEQ ID NO: 14556 - DNA, 516 bp, Neocallimastix californiae
  alpha/beta-Hydrolases
gtctggtggtagacgtactgttcgtattgatattccaaacaactataataaccaaaacccataccgtttagttttcggtatgcactgtatgggttgctgggctggtggtgttcaacaagaaggttactttggtttaaaaccattagatactggtaagactactatttttgttgctccagaaggtaatggtaaccaagctccatggggacaaggtgattacaaattattcgatgaacttctctctaaattaaagaacgatctctgtattgatgaatcacgtgttttctctactggtttcagttatggagctatgttctctaatggtctttcctgggatcatcaaaaggatcttcgtgctgtcgctgtttatgaaactgctgaacgtaatatctggcttccaagacacactggattaccaattggttggatgggtgttctcggttttgatgataatgtatgtactcctgaaatgggtcgtcatgctcgtgatattattcttgaacacaattctgaagg

SEQ ID NO: 14557 - DNA, 39 bp, Neocallimastix californiae
  alpha/beta-Hydrolases
tcgttggtgtactcaatccggaggtcacctttgggatca

SEQ ID NO: 14558 - DNA, 516 bp, Neocallimastix californiae
  alpha/beta-Hydrolases
gtctggaggtaaacgtactgttcgtattgatgttccagataattataataataaaaatccatatcgtttagtctttggtatgcactgtatgggtggttgggctggtggtgtccaacaggaaggttactatggcttaaaaccattagatactggtaagaccactatttttgttgctccagaaggtaatggtaaccaagctccatggggtgaaggtgattacaagttgttcgatgaacttcttgaaaaattaaaaggtgaattttgtatagatgaatctcgtgtcttttctactggtttcagttatggttctatgttctcaaatggtctttcatggaatcatcaaaaagttttacgtggtgttgccgtttatgaaactgctgaacgtaatatctaccttccaaaacacactggtgatggtattggttggatgggtgttctcggttttaacgataatgtttgtaccccagaaatgggacgtcatgctcgtgatattattcttgaacataactcacaggg

SEQ ID NO: 14559 - DNA, 99 bp, Neocallimastix californiae
  alpha/beta-Hydrolases
acgttggtgtactcagtctggtggtcacatctgggatcacaaggacccaggttccaatcaatcatgggttccacaagctacttgggaattcatcactca

SEQ ID NO: 14560 - DNA, 762 bp, Neocallimastix californiae
  alpha/beta-Hydrolases
aaaggaaggtgttgaatacccaactgttaaaaacttgacttattattcgacaactactaaaagtgaacgtccattacacgttcttcttccaccaagttatgatggaaagaaaaagttccctgttgtttacttattacacggtgttatgactaatggtgaatttatgttacaagaaggtttcggtacaattgcaattccaggaaatttgttccataaacacatggctaaggaatttattatggttcttccagatcaatatgctccagctccaggaaccgaagttgaaccaaatttaaatgaagagtactttgctggttacaataatttcattaatgatttagttaatgatatcatgccatacatgaaaaagaattatagaatatttactggtaagaaaaacactgccatctgtggttactccttcggtggaagaaacagtttatatattggtttaatgagaccagatttatttggtttcgttggcgctttctctccagctccaggtattcttccagctgaagatatgttcactcatcataatggtttattcaaggaagaaaaagatgtagtttttcaaggtaaaccaccatatcttactatgatttcctgtggtacaaatgactttgttgttggtacattcccaaaaagttatcatgaagctttagaacataaccaccaagagcatatttggtatgaaatgactggtcttgatcacggtgataatgaatctgttacttctcctctttacaacttcttttcatc

SEQ ID NO: 14561 - DNA, 762 bp, Neocallimastix californiae
  alpha/beta-Hydrolases
acaagaaaacattacttatggtactcttcaaagaataacatactattcctctaatactaaaaccgaccgtccaatgaatattcttcttccaccaaattatgatccagagaataaaaaatatccagttttatatcttttacatggtattttatctgatcaaaattctttaattaaaccaaaatatagtacaccaaatattgctggttatttaatgcatgaaggtcttgctaaggaaatgatcatcgtctttccttacacttatgctccaaaggatggtattgaagttgaaccaggatttactgaagaacactatgcaggttataataatttcattaatgaattacttgatgttattatgccatacatgaacgaaaactatccaattcttactggtagagataatactgcaattgctggtttctctatgggtggtcgtaacagtctttacattggttacactaagccagagttattcggttacattggtgctttctctccagcaccaggtgtacttccagaagaaggtaagaagggtttacttactgaagaaactttccgtattgaagataaacaatatactccatatgttacccttgtttgtactggtacagaagatgacgttgttgctgaatatccatccatttatcatggtgtcttaaccaacaatgaacaaccacatctttggtatgaagttccaactggtggacatgatggtattaccgttagtagtggtgtttacaactttatgcaaactttatttgg

SEQ ID NO: 14562 - DNA, 528 bp, Neocallimastix californiae
  alpha/beta-Hydrolases
ttccttcgaatttaattggtctggtggtaaacgtactgttcgtattgatattccagataactatgacaacaagaaagcctatcgtttagttttcggtatgcattgtatgggtggttgggccggaggtgtccaacaagaaggatactatggtttaaaaccattagatactggtaaaactactattttcgttgctccagaaggtaatggtcaacaagctccatggggtcaagctgattaccaattatttgatcaacttcttgaaaagttaaagaacgatttatgtattgatgaatctcgtgtcttctctactggtttcagttacggttctatgttcagtaatggtctttcctggaatcaccaaaaggttcttcgtggtgttgctgtctatgaaactgctgaacgtaatatttggcttccaaaacatactggtgaaccaattgcttggatgggtgtccttggtcttgatgataatctttgtaccccagaaatgggtcgtaaagctagagatattattcttgaacacaattc

SEQ ID NO: 14563 - DNA, 721 bp, Neocallimastix californiae
  alpha/beta-Hydrolases
ttacaacaagccagcttgggtttacttaccagcaggttatgatccagaagataaggacactaaatatccattatttatcttaatgcacggttttggtcaaactgaagataattggggtcttaccgaccaaggttctggtggtaagattaagggtatgatggatagaggtatggctaaaccaaaggatgaagaaggttctgttgaaaagttcattcttgttgttccaactggtatggccactagaaattacagagaaaatggtaactatgattacactgaaccatactatagatttggtggtgaacttagaaacgatcttattccatatatgaaaaagaattataacattaaagaaggtcgtgaaaatatggccatggctggtctttccatgggtggattccaaacattatatattggtattggtgaatgtcttgatatcatgagttactttggtttcttctcctatccatttactgatgatcttaaggaaaaaattgaaaccaatttcccagagaaggatttaactattaaacgtctttacaccatttgtggagataatgatccaactccattcagtgatttctataattatgttgatgtattaagtaaatgggataaagttgaagatggtaactttagttatgaagtctacccaggaggtactcatgacttcccagtatggtatagaggttttgaacatttcattccacaattatttaaa

SEQ ID NO: 14564 - DNA, 738 bp, Neocallimastix californiae
  alpha/beta-Hydrolases
aattgttaaggaatattacaatggtatcaatggtaataatgcattaaatgtttacttaccatacggctatgacagtaagaagcaatacaatatcttctatcttatgcatggtggtggtgaaaacgaaaacacaattttcagtaatgatgttaagcttcaacctattattgataacatgatcatgaatggtgaacttgaaccattgattattgttactccaactttcaacaaatgtgaagctcgtactttctacaaagaattacgtgaatctgttattccattcgttgaaggtaaatactctacttatgctaaatctacatctccaagtgatattagagcttctagaatgcacagagctttcggtggtttctccatgggttctgcttccacttgggctgtttttgtcaactgtttagatattgttgcttactatatgcctcttagtggtgataactgggaagctaatggtggttacggtaaggctaagaatgttgctgacgctgtcagtagattcggtataaagagcaatgaattctttatcttctgtgctactggttctgaagatattgcttatccaaatatgaatccacaaatggatgaaatgaagaagatgcaaccatttatttacacttctgacttctctaagggtaacttctattatcttgtcgccccaggtaaaactcactggtggggatatgttaagcattacatttatgatgctcttccatctttcttcca

SEQ ID NO: 14565 - DNA, 741 bp, Neocallimastix californiae
  alpha/beta-Hydrolases
tagaattgttaaagaatattataatggtattaatggttctaattcattaaatgtttacttaccatatggttacaatagtaatcaacaatacaatattttctatcttatgcatggtggtggtgaaaatgaaaacactatttttggtagtgacgtttatcttcaatacattattgatcatttaattatgaacggtgaacttgaaccattgattattgttactccaaccttcaataaatgtgaagctcaaaccttctacaaagaattccgtagttccgttattccattcgttgaaggtaaatactcaacatatgccaaatctacctctgaaagcgatattagagcctctagaatgcacagagcttatggtggtttctctatgggttctgtctctacttgggccgttctcattaattgcttagatattgttggttacttcatgccacttagtggtgactgttgggaagctaatgatgcatatggtaaggctaaggccgttgctgatgctattaatagatcaggtttaagaagtaatgaatacttcattttctgtgccactggttctgatgatattgcctatccaaatgttactccacaaattgaacaaatgaagaaaatgtctcaatttatttatacatctgacttctctaagggtaacttctattatcttgttgctccaggaaaaactcactggtggggatatgttaagcattatatttatgatgctcttccatcttttttcca

SEQ ID NO: 14566 - DNA, 858 bp, Neocallimastix californiae
  alpha/beta-Hydrolases
accaaatccaccacaaagcattaaggctacttactctggtggtactttaactgttgttgtcaatgataacggtggttctcttactcttacttctaaactcagtgttccaagtggtagtggaccattcccagttattattggtatgaatagtggtactggttctcttggtggtaacttattcagtggctttattcaagttccattcaaccatgatcaatgtgctcaatactctatgaatggtcaaaagaatactaatgctccattctacagaatgtatccaaatctcaaacaagctggtgattacattgcctggtcttggggtgtttctcgtcttattgatggtcttgaaaaagttaaggatcaaattcatgctgatttatcacacattggtgttaccggttgttcttatgctggtaagatggctctcttcgctggtgccttcgatgaacgtattgctttaactatcccacaagaatctggtggtggtggtattaacgcctggagagtttctgatactattggtaacgttgaaaagattgataacaccaactactcttggttcatgcaagctttaaagaataactttggtagtaacagagctggtaaattaccatacgatcatcatgaagctattgctatgattgctccacgtgctttcttcactatgggtaatccagattacgaatggttaggtgataagtctggttacacttctgctatggctgcctatgaagtttggaaggctatgggtgttgaagacagattcggtttcaatattgtaggtggtcacatgcattgctctgctgctggttctcaaaacaatgatgtcagtaagttcattgacaagttccttcgtgg

SEQ ID NO: 14567 - DNA, 528 bp, Neocallimastix californiae
  alpha/beta-Hydrolases
ctctttcgatttccaatggtctggtggtaaacgtactgttcgtattgatgttccagacaactataataataacaatccataccgtttaatttttggtatgcattgtatgggtggttgggctggtggtgttcaacaagaaggttactatggtttaaaaccattagatactggaaaaacttctatttttgtagccccagaaggcaatggtaaccaagctccatggggtcaaggtgattatcaattatttgaccaacttcttgataaattaaagaatgaattctgtattgatgaatctcgtgtcttttctaccggtttcagttacggttctatgttctctaatggtctttcctggaatcatcaaaaggttcttcgtggtgttgctgtctatgaaactgctgaacgtaatatctggcttccaaaacatactggtgaacccatagcttggatgggtgttcttggtcttgatgatggtctctgtactccagaaatgggtcgtcatgctcgtgatatcattcttgaacacaattc

SEQ ID NO: 14568 - DNA, 705 bp, Neocallimastix californiae
  alpha/beta-Hydrolases
cactatttaccgtccagaaaatttaaaggaagctgttgatgctgagggtcgtttaccagttattttattcggtaatggtggttgtggtcgtatttccttctcctacggtaatttcttaactgaactcgcttcctatggttacgttgttgctgctgttggtccatgggttggtgaagataacactgattatctttccttatccttagatttttctgaagaaactattaatggattcaaggctgatgctaacagtttaattgatgttgctttaagttggcttgaaaaggaaaacaaggaaagaactagtattttctataagactttaaatactaataaggttagtgccatgggtcaatcctgtggtggtttacaagcattaattatcagtactaagaatgataagcgtattaagactactgttgccctaaacagtggagctaacagtccaggtgatttattagattcccttattgttaaggatgaacttcaaaaattaactcaaccaattatctatattattggtggcgaagaagatattgctcactataatgccttagatgatttcagtcttattaagaaagttccagttgctgttgcctgtaaggcagatgctggacacatgggaacctacagtgaaccaaacggtggaacttttggtaaaatgactttagcttggttagactacattttaaagaatgacaagag

SEQ ID NO: 14569 - DNA, 750 bp, Neocallimastix californiae
  alpha/beta-Hydrolases
gcaagatggtgttaaatatccaactagtgaaaaaatcacttatcactccaacactactggaacagatcgtcaaatgaatattattcttccagttgactatgatggaactaaaaaatatccagttgtatattatttacatggtatttttggtaatgaagactctatgttagatgaaactgctatcgctcttccagttaacttatataatgaaggaaaggctaaggaagcaatttttgttcttccaaatacttatgctccaccaccaggtaaggaagttgtaccagattttaatcaagattattttgatggttacgataacttcattaatgagttaattgatgatattatgccatacgttgaacaaaattattctgttcttactggtaaggaaaatactggtctttgtggtttctctatgggtggtcgtaatagtctttacattggatacaagagaccagatttattcggttatgttggagccttttcaccagctccaggtgttactccaggtgacgatttctctggtcatcatccaggtttattccaagaaagtgaattccgtactgatgttcctccatttgttactcttgtttcttgtggtacaaatgattctgttgttggtactttcccaaagagttatcatgaaattttaactaccaatggtcaagaacacatttggttcgaagttccaggtgctgaccatgatgataaggcaattgctgctggtttatacaactacctttcaactgc

SEQ ID NO: 14570 - DNA, 726 bp, Neocallimastix californiae
  alpha/beta-Hydrolases
ggaaggtgttgaatacccaaaggttgaaaacataacttactattctactactactgagagtaaacgtccattaattgttgttcttccaccaaactattctaaatccaagaagtatccagttctttatttattacatggtattatgacagatggttccttcatgttacaagaaggtttcggtaccattactattcctggtaatttaattcatgaacacaaagctaaggaattaattatggttttaccaaaccaatatgccccagctcctggtactgaagttgaaccagccttaaatgaaaaatactttgcaggttacaataatttcataaatgatttaattaacgatattatgccatacatgaaaaaaaattactctattgctactggtaaggaaaacactgccattgctggttactccttcggtggaagaaacagtctttacattgctttacaaagaccagatttatttggttttgttggtgctttctctccagctccaggtcttcttccagctgatgatatcttctctggtcatcacattggcttatatcaagaagaaaaggaaattcattacaccggtgaagctccatatcttactatgatttcttgtggtacaaatgatactgttgtaggtacattcccagaaagttatcataatgcctttgctaagaataatgaagatcatgtttggtaccaaattactggtgctgatcacattgataatgt

SEQ ID NO: 14571 - DNA, 756 bp, Neocallimastix californiae
  alpha/beta-Hydrolases
tagaggtattatgtatgctcaacctgaaaaagttacttatttctctaacactactcacactgaacgtcaaatgaatatcattttacctccagattattctaaagaaaaaaaataccctgttttatattatttacatgatttattaagtgatgaaaatggattattagaaaaaagtattggtactcttgaaatttatagtaatttagttaatttaggtaaggctaaggatatgattattgttcttccaaattgtattgttccagcagatggtgctaaaatagaaccaggaaattcagaagaatataatgctgcatatgataactttattaatgaattgcttcaagatgtaatgccattcatagaatcaaattattctgtagattctggtagagaaaataccgcaattgctggttttggtcaaggtggtcgtagttctctttacattggttacaaacatccagaattatttggataccttggtgctttctcacctactcaaggtcttttaccatacaataaagaacaaggtttaatgaaaccagaagaattacaagttgaagatgctgaacttcaacctatcgttactatgattactgttggtgcaaaagatactgaagctcaagaatcagcaaaactttaccatgaaactctcgcctctaatgaacaacctcatatttggtttactgttcctgatgctcttcatgatagtgatgcctgctcagctagttactataacttcatttctaccttatggaa

SEQ ID NO: 14572 - DNA, 777 bp, Neocallimastix californiae
  alpha/beta-Hydrolases
aagagaaggtgttgcctacggtgaagctgaaaagattacctatttctctactacagctcaaatggaccgtaaaatgaatgttatcttacctgcaggttacactgaagataagaagtaccctgttttatattatttacatggtctttctggtaatgaagattcattattagcaaaagaaagagccactattgaaatttatggtaatttagttagtgaaggtaaagctaaggaaatgattattgttcttccagattgttatgtcccattagatggtgttttcgatagaccacaattttcaccagaatatttgaaggcttatgataacttcctctatgaattaattgatgatgttatgccatatattgaatctcattattctgttgctctcggaagagaaaatactgctcttgctggtttctctcaaggtggccgtaacactatctatattggttacaaacatccagaattattcggataccttggtgctttttcacctgctcaaggtattttcccatgttatgatattatggctggtcatcaacctggtttaatgaaaccagaagaattacaagctgatgctgaagttcaaccaattgtttctatgattacagttggaactaaggactttgctgttcaaaagaatccaaaactttaccatgaagctttagctacaaatggacaacctcatatttggtttacagttccaggtgctcttcatgatgaccttgcctgtactaccggttattacaacttcctttccactttatggggagtttt

SEQ ID NO: 14573 - DNA, 480 bp, Neocallimastix californiae
  alpha/beta-Hydrolases
tgtaaaattcccaagtggtttctctggtaataaggctgttccacttcttattaattatcatccaattggtggtagtgcttctcaatgggaaggcggttctcaaactgctagagctgctcttagtgatggtgctattgttgctttcatggatggtgctcaaggtccaatgggccaagcttggaacgttggtccatgttgtactgatgctgatgatgttcaattcactcgtaatttcattaaggaaatcactagtaaggcctgtgttgatccaaaacgtatttacgctgctggtttctctatgggtggtggtatgtctaactatgctggttgtttcctttctgatgttattgctgcttcagctccatctgcttttgatcttgctaaggaaattgttgatgctggtaaatgtaagccatctcgtccattcccaatccttaacttccgtggtactcaagatccaattgttatgtacaatggtgg

SEQ ID NO: 14574 - DNA, 730 bp, Neocallimastix californiae
  alpha/beta-Hydrolases
aaatgataaatacaataagcccgcttgggtttacttaccagctggttatgatccagaagataagaacactaaatatccattagttattttaatgcacggtttcggtcaaaatgaagataactggggtcttaccgatcaaggtactggtggtaaaattaagggaatgatggatagaggcatggctaaagctaaggatgaagaaggttccgttgaaaagtttgtacttattgttccaactggtatggcctctaaggacttcagagataataacaactacggtaacactgaaccatggtacaagtttggaaatgaaattagaaacgatattattccatatatgagaagtcattacaatattaaggagggtcgtgaaaatgtagccatggctggtctttctatgggtggtatgcaaaccttaaaccttggtattggtgaatgtcttgatttaatcagttactttggtgccttctccttcccatttggtgctgatatatttgaaaaaactgaaaccaatttcccagacaagaatttaactattaagggactttatactatatgtggtgatgctgatgctggagctttcgctggttacggtccagctgtcgaggcctttgaaaaatgggatagaattgatgaaggtaaatttaagtctgaaatttacccaggaggtacacacgacttccctgtctggtacagaggttttgaacatctcattccattattatttaaa

SEQ ID NO: 14575 - DNA, 855 bp, Neocallimastix californiae
  alpha/beta-Hydrolases
accagctcctccaaaaagtattaaagctacatactctggtggtactttaacggttgttgttaatgataatggaggttcccttacccttacttcaaagatttctgttccaaacggaaatggaccattcccagttattattggtatgaatagtaatactggttctttaagtaccaatcaatttagtggatttattcaggttccatttatgcacgatcaatgcgctcaatattctatgaatggacaaaaaaatacaaattctccattctataaattatatccaaatcttaagcaagctggtgactatattgcttggtcatggggtgtctctcgtctcattgatggtctcgaacaagttaaaagtcaaattcatgctgatatggaacatattggtgttactggttgttcatatgctggtaaaatggctctcttcgctggtgcatttgatgaacgtattgctttaactattccacaagaatctggtggtggtggcattaactcatggagagtttctgatactattggtaatgttgaaaaaattgcaaataccaattattcatggttcatgcaagcattaaagaataatttcaatggtaaagctagtaaattaccctatgatcatcacgaattagttgccatgattgctcctcgtgccttctttaccttaggtaatccagactatgaatggttaggtgataaatcaggttatacttccgttatggctgctttagaagtatggaaagctatgggtgttgaagatcgattcggttttaattttgtaggtggtcacacgcattgttctgcagctggttctcaaaacaatgatgttaataaattcattgatagattccttcgtgg

SEQ ID NO: 14576 - DNA, 708 bp, Neocallimastix californiae
  alpha/beta-Hydrolases
tggaggtaacactttaaatgtttacttaccatatggttatgataagaataagcaatataatattttctatcttatgcatggtggtggtgaaaatgaaaatactatttttagtaatgatgttaatctacataatattcttgataatatgattatgaagggagagcttgaaccacttattgttgtcactccaaatttcaataaatgtgatgctcgtactttctataaggaattacgtgaaagtgttattccatttgttgaaggtaaatattctacttatgctaaatctacttccccagctgacattaaagcttctagaatgcacagagcctttggtggtttctctatgggttcagcatctacttgggctgttttaattaattgtttagatattgttgcctactacatgccacttagtggtgataactgggaagctaatggtggatacgctaaagctaaatctgttgctgacgctattgacaagtctggattacaaaagaatcaatactttatcttctgtgctactggttctgaagatattgcttacaacaacatgaacccacaaattgatgaaatgaagaagatgagtcaatttgtatacacttctgacttttccaagggtaacttctattatcttgttgctcaaggaaagactcactggtggggttatgtcagacattacatttatgatgctcttccatctttcttcca

SEQ ID NO: 14577 - DNA, 525 bp, Neocallimastix californiae
  alpha/beta-Hydrolases
atttgaatttaactggtccggtggtagacgtactgttcgtattgatattccagacaactatgataacaaaaacccatatcgtttaattttcggtatgcactgtatgggtggttgggctggtggtgtccaacaagaaggatactacggtttaaaaccattagatactggtaagactactatttttgttgctccagaaggtaacggtaaccaagctccatggggtcaaggtgattatacattatttgatgaacttcttgaaaaattaactaatgatctttgtattgatgtttctcgtgtcttctctactggtttcagttacggttctatgttcagtaatggactttcatggaatcaccaaaaggttcttcgtggtgtagccgtttatgaaactgctgaacgtaacatctggcttccaaagaatactggtgaaccaattgcctggatgggtgttcttggtttagatgatggactttgtactccagaaatgggacgtaatgcccgtgatattatcttaaagaacaattc

SEQ ID NO: 14578 - DNA, 486 bp, Neocallimastix californiae
  alpha/beta-Hydrolases
tattgttaaattcccaagtggttacaaaggtgataaaccagttccacttcttattaattatcacccaattatgggtagtgcttctcaatgggaaaatggttctcaaaccgctaaagctgcccttagtgatggtgctattgttgcctttatggatggtgctcaaggtaacatgggtcaagcttggaatgtaggtccatgttgtactgatgctgatgatatttctttcactcgtaacttcattaaagaaattaccaataaagcttgtgttgatccaaaacgtatttacgctgctggtttctctatgggtggtggtatgtctaactacgttggttgttatcttgctgatgttattgcagccgctgctccatctgcttttgatcttgctaaagaagttgttgatggcggtaaatgtaaaccatctcgtccattcccaattcttaacttccgtggtactcaagataatattgttatgtacaatggaggact

SEQ ID NO: 14579 - DNA, 696 bp, Neocallimastix californiae
  alpha/beta-Hydrolases
tttaaatgtttacttaccttatggttatgataagaataagcaatacaatattttctatcttatgcatggtggtggtgaaaatgaaaatactattttctcaagagatgttaaccttcaaccaattattgataatttaattatgaatggtgaacttgaaccattgattattgttactccaactttcaataaatgtgaagctcgtactttctacagagaattccgtgaatctgttattccatttgttgaaggtaaatattctacttatgctaaatctacttctgctaatgatattaaagcttctagaatgcatagagcctttggtggtttctctatgggttcagcttctacttgggctgttcttgttaattgtattgatattgttggttactttatgccacttagtggtgataattgggaagctgatggtggttatggtaaagctaaatctgtagctgatgctattaacagagctggttttaagaaggatgaattctatatctttgctgctactggttctgaagatattgcttatccaaatatgaacccacaaatggatgaaatgaagaaaatggatccatttgtttatacttctgatttctctaaaggtaacttttattatcttgttgctccaggtaaaactcactggtggggttatgttaaacattatatctatgatgctcttccatccttcttcca

SEQ ID NO: 14580 - DNA, 696 bp, Neocallimastix californiae
  alpha/beta-Hydrolases
attaaatgtttacttaccatacggttacactgacagtaagcaatacaacattttctatcttatgcatggtggtggtgaaaatgaaaacactattttcggtagtgatgtttatcttcaatacattcttgataatttaattatgaatggtgaacttgaaccattgattgttgttactccaacattcaatagatgtgaagctggtactttctacagagaattccgtgaatctgttgtaccatttgttgaaggtaaatactctacttatgctaaatctacttctgctgctgatcttaaagcctctagaatgcacagagcttatggtggtttctctatgggttccgtttctacttgggctgttcttatcaactgtttagattatgttggttacttcatgccacttagtggtgataattgggttggtaatggtggttatggtaaggctaaatctgttgctgatgctattgataagtttggttacagaactgatgaatatttcattttctgtgccactggttccgatgatattgcctatccaaacatgaacccacaaattgatgaaatgaagaagatgaaacaattcatttacacttctgacttttctcaaggtaacttctattaccttgttgctccaggaaaaactcactggtggggatatgttaagcattatatttatgatgctcttccatacttcttcca

SEQ ID NO: 14581 - DNA, 768 bp, Neocallimastix californiae
  alpha/beta-Hydrolases
agctgaaggagttacagtagaaaaaaaatcatattattctaatataactaagggttatcgaaaattaaatgttgttcttccaccaaactattccacagaaaagaagtatccagttttatatttacttcatggcatatatggagatgaagactctatgctcaacaatggtatgggtacacttaatgttccagctaatcttgcaaaggaaaataaagcaaaagaaatgattattgtacttcctaatgaagttgccttattaccaggaaccgatccaaacattacaaaaaatttttctttggagcatcttaaagtttatgataattttattaatgaattacttaataatattatgccatttatagaatatgaatattccgttgctaccggtagagacaatactgctattgccggtttctctatgggtggtcgtactgctctttacattggatacacaagaccagatttatttggttatgtcgccggtttttcaccagcatggggtcttactccgggaggtatggatatcttaccaggagtattcccaagagatgaagattttaagattcaaaacccatccgaatatactccatatgtcacattaattagtactggtactgcagatggcgtcgtggaagactatccagcctcttatcatgaaatcttagaaaaaaatcaacaaaatcatatctggattgaaatagaaggtgctgatcatgatgagagtgccgttattgttggtttatataatttcgttgctactctttttgg

SEQ ID NO: 14582 - DNA, 522 bp, Neocallimastix californiae
  alpha/beta-Hydrolases
tagatttattcttgtttgtgtaactggtgttgctagtagaaattggggtccaaatggtgctggtaatgatgttaatggtttcaatgcttttaaaggtgaacttagagatgatattattccatatatgagatctaaattcaatattaagagtggtcgtgataatgttgctcttgctggtctttctatgggtggtggtcaaactttcaatattggtattgctgaatgtcttgatcttattagtaactttgctggtttctctggtgctatgttctctggtgctgatgaattcaagagaaatgttgataataagagagaattcaatggtcttaagattcacaatctttacatgacttgtggggataaagatgatttagtttattcttccttcccaggatacgttagatcaatgaaaagttggagtagagttgaaaactttaaagattatacttatccaggtggtactcacgatttcccagtttggtacaaaggtttcaatgatttcattcatatgattttcccaga

SEQ ID NO: 14583 - DNA, 825 bp, Neocallimastix californiae
  alpha/beta-Hydrolases
ttctggtaatactttaactgttaccgttaatgataatggaggttcacttactcttacttcaaaaatttctgttccaagtggtaatggaccattcccaattattattggtatgaacagtaatactggttctctttctgctggtcaattcaatggttttattcaagttccattcaatcatgaccaatgtgctaagtattctatggatggtcgtaaggatactaatgctccattctacagaatgtatccaaatcttagacaagctggtgattatattgcttggtcttggggtgtttctcgtcttattgatggtcttgaacaagttaaaaatcaaattcatgctgatttagaacatattggtgttactggttgttcttacgctggtaaaatggcactctttgctggtgcttttgatgaacgtattgctttaactattccacaagaatctggtggtggtggtattaactcttggagagtttccgatactattggtaatgttgaaaagattgataacactaactactcttggttcatgcaagctttaaagaataactttggtaatggtaaagctactagattaccatatgatcatcatgaagctattgctatgattgctccacgtgctttcttcactatgggtaatccagattatgaatggttaggtgataaatctggttacacttcagctatggctgcatatgaagtttggaaagcaatgggtgttgaagatagatttggttttaactttattggtaatcatatgcattgttctgctgctagttctcaaactaatgatgttaacaaattcattgatagattccttcgtgg

SEQ ID NO: 14584 - DNA, 525 bp, Anaeromyces robustus; identical to SEQ ID NO: 14577
  alpha/beta-Hydrolases

SEQ ID NO: 14585 - DNA, 486 bp, Anaeromyces robustus; identical to SEQ ID NO: 14578
  alpha/beta-Hydrolases

SEQ ID NO: 14586 - DNA, 696 bp, Anaeromyces robustus; identical to SEQ ID NO: 14579
  alpha/beta-Hydrolases

SEQ ID NO: 14587 - DNA, 696 bp, Anaeromyces robustus; identical to SEQ ID NO: 14580
  alpha/beta-Hydrolases

SEQ ID NO: 14588 - DNA, 103 bp, Anaeromyces robustus
  alpha/beta-Hydrolases
caaatggtgtactcaatctggtggtcaccaatgggaacacaaggacccaggatcatggcaaacatgggttccacaagaaacttgggacttcatcactaaattc

SEQ ID NO: 14589 - DNA, 501 bp, Anaeromyces robustus
  alpha/beta-Hydrolases
tcttgttcacattgatcttccaaacaattatgataacaatcatccataccgtttagttttcggtatgcaatgtatgggaggttctggtgctaatgtcagaaatgaacaatactatggtttaaagccattagatactggtaaaactactattttcgttgctccagaaggtaacggtcaacaacttccatggggtcaagaagattatcaattattcgatgaacttcttgaaaaattaaagactgatctttgtattgatgaatctcgtgtcttctctactggtttcagttatggttctatgttctctaatggtctcgcttgggatcaccaaaaagtacttcgtggtgttgctgtttacgaaactgctgctgttaacatctggcttccaaagaatactggtttaccaattgcttggatgggtgttcttggtttcgatgatggtctttgtactccacaaatgggtcgtcaagctcgtgatgttatcttaaagaacaattctgatgg

SEQ ID NO: 14590 - DNA, 447 bp, Anaeromyces robustus
  alpha/beta-Hydrolases
cgtctatgccccatctaatctcgcagcaaagagtccattacttctttctttacacggtatggaccaagatccaaattaccaacaatccaatacccactgggaaactttagctgatactgaaggttttgttgttgtatatccaagaggaggaactggtatgagtacttgggatatccaaggtgataaggataccaaatgggtattacaaattattgatcaaatggctaaggattatgacattgaccgtaatcgtgtttacctttctggattctctatgggtggtatgttcacttaccatgctatgagtaagattggtgacaagattgctgcttttgctccatgttctggtccaaatgtatttggtgcctcaaaggctatgcgtccagttccaattttccatgttcacggtactaacgatgatgtattaaattacaaccaagttgaagg

SEQ ID NO: 14591 - DNA, 114 bp, Anaeromyces robustus
  alpha/beta-Hydrolases
ttactcatggggtccatgtgaccaaggtgtttatattaagcacttaaagcttgttggtcgtggtcacagtccatctaaagctgatatcggtgatatctggaactttgttaagga

SEQ ID NO: 14592 - DNA, 729 bp, Anaeromyces robustus
  alpha/beta-Hydrolases
tcaaagtcgtgctcaaaaatacaataaacacggatgggtttatcttccagctggttatgatgctgatgacaagaatactcaatatccattatttgttttacttcacggttttggacaaaatgaaaacacttggggtctttctaacaaaggacgtggtggtaaaattaagggtttcatggatagaggtatggctagtggtgatgttggtagatttattcttgtttgtgtaactggtgttgctagtagaaattggggtccaaatggtgctggtaatgatgttaatggtttcaatgcttttaaaggtgaacttagagatgatattattccatatatgagatctaaattcaatattaagagtggtcgtgataatgttgctcttgctggtctttctatgggtggtggtcaaactttcaatattggtattgctgaatgtcttgatcttattagtaactttgctggtttctctggtgctatgttctctggtgctgatgaattcaagagaaatgttgataataagagagaattcaatggtcttaagattcacaatctttacatgacttgtggggataaagatgatttagtttattcttccttcccaggatacgttagatcaatgaaaagttggagtagagttgaaaactttaaagattatacttatccaggtggtactcacgatttcccagtttggtacaaaggtttcaatgatttcattcatatgattttcccaga

SEQ ID NO: 14593 - DNA, 480 bp, Anaeromyces robustus
  alpha/beta-Hydrolases
tgttaaattccctaatggttacaagggtgataaaccagttccacttcttattaattatcacccaattatgggtagtgcttctcaatgggaaagtggttctcaaactgctaaagctgcccttaatgatggtgctattgttgcctttatggatggtgcacaaggtaacatgggtcaagcttggaatgtaggtccatgttgtactgatgctgatgatgtttctttcactcgtaacttcattaaagaaattaccaataaagcttgtgttgatccaaaacgtatttacgctgctggtttctctatgggtggtggtatgtctaattatgctggttgttatcttgctgatgttattgcagctgctgctccatctgcttttgatcttgctaaagaagttgttgatggcggtaaatgtaaaccatctcgtccattcccaattcttaacttccgtggtacagctgataatgttgtctcttataatggagg

SEQ ID NO: 14594 - DNA, 825 bp, Anaeromyces robustus; identical to SEQ ID NO: 14583
  alpha/beta-Hydrolases

SEQ ID NO: 14595 - DNA, 825 bp, Anaeromyces robustus; identical to SEQ ID NO: 14583
  alpha/beta-Hydrolases

SEQ ID NO: 14596 - DNA, 480 bp, Anaeromyces robustus
  alpha/beta-Hydrolases
tgttaaattccctaacggattcagtggtgataaaccagctccacttcttattaattatcacccaattatgggtagtgcttcacaatgggaaagtggttcacaaactgctaaagctgctcttaatgatggtgccatcgttgcctttatggatggtgctcaaggtccaatgggtcaagcatggaatgtaggtccatgttgtactgatgctgatgatgttagttttactcgtaactttattaaagaaattactagtaaagcttgtgttgatccaaaacgtatttatgctgctggtttctctatgggtggtggtatgtctaattatgctggttgtttccttgctgatgttattgctgctgctgctccatctgctttcgatcttgctaaagaaattgttgatggtggtaaatgtaaaccagctcgtgccttcccaattcttaacttccgtggtactcaagataatgttgttgcctataatggagg

SEQ ID NO: 14597 - DNA, 708 bp, Anaeromyces robustus
  alpha/beta-Hydrolases
tggtagaaactcacttaatgtttatttaccatatggatatgatgaaaaaaagcaatacaatattttctatcttatgcatggtggtagtgaaaatgaaaatactattttcaataatgaagttcaacttaacaatattcttgataatatgattatgaaaggtgaacttgaaccacttattgttgttactccaacctttaatagatgtgaatgtcgtacgttctacaaagaattccgtgagagtgttataccatttgttgaaggtaaatattctacttatgctaaatcaacttcagctgcagatattaaagcttcaagaatgcatagaggtttcggtggattctctatgggttctgcttctacttgggctgtatttattaattgtttagatatttgtgcttattacatgccacttagtggtgaaaattgggaagctgatggtgcctatatgaaagctaaaactgttgctgatgccgttgataaattaggtttaaagaagaatcaatacttcattttctgtgctacaggttcagaagatattgcatatccaaatatgaacccaatgatgaatgaaatgaagaagatgagtcaatttgtatatacttctgatttctctaaaggtaatttctattatcttgttgctaatggtaagacccactggtggggttatgttagacattatatttatgatgctcttccatctttcttcca

SEQ ID NO: 14598 - DNA, 102 bp, Anaeromyces robustus
  alpha/beta-Hydrolases
tcgttggtgtactcaatctggaggtcaccaatgggaacacaaagacccaggacaaatgcaaacttgggttccaaaagaaacttgggactttatcaacaaatt

SEQ ID NO: 14599 - DNA, 510 bp, Anaeromyces robustus
  alpha/beta-Hydrolases
taagaaccgtcttgttcacattgatattccagacaattataataatagtaaaccataccgtttagtattcggtatgcaatgtatgggtggttctggtgctaatgttagaaatgaacaatactatggattaaaaccattagatactggaaaaactaccattttcgttgctccagaaggtaatggtcaacaacttccatggggacaagaagattatcaattattcgatgatttacttgaaaaattaaagaatgatctttgtattgatgaatctcgtgtattctcaactggtttcagttatggttctatgttttctaatggtctttcatggaatcaccaaaaagttcttcgtggtgttgctgtatatgaaactgctgaacgtaacatttggcttccacaaaataccggtttaggtattggttggatgggtgttcttggtttcgatgataacctttgtactccagaaatgggtcgtaaagctcgtgatattatcttaaagaacaactctgaagg

SEQ ID NO: 14600 - DNA, 759 bp, Anaeromyces robustus
  alpha/beta-Hydrolases
agattgcccacaacctggtaaaattattaaagaatattataatggtattaatggtgctaattcattaaatgtttacttaccttacggttatgataagaataaacaatataatattttctatcttatgcatggtggtggtgaaaatgaaaatacaattttcagtgttgatgttcatcttcaaccaattattgatcatttaattatgaatggtgaacttgaacctttaattatagttactccaactttcaataaatgtgaagcacgtactttctataaagaattccgtgaatctgttataccatttgttgaaggtaaatattctacttatgctaaatctacttcaccagctgatattagagcttctagaatgcatagagcttatggtggtttctctatgggatcagcttcaacttgggctgttcttattaattgtttagatattgttggttatttcatgccacttagtggggataattgggaagctaatggtggatatggtaaagctaaatctgttgctgatgctattaatagagcaggtttaaagaaaaatgaatttttcattttctgtgctaccggatccgatgatattgcttatccaaacatgaacccacaaatggatgaaatgaaaaagatggaaccatttgtttatacttctgatttctctaaaggtaatttctattaccttgttgctccaggaaaaactcactggtggggatttgttaaacattacatctatgatgcacttccatctttcttcca

SEQ ID NO: 14601 - DNA, 480 bp, Anaeromyces robustus
  alpha/beta-Hydrolases
tgttaaattccctaacggttttaaaggtgataaaccagttccacttcttattaattatcacccaattatgggtagtgcttctcaatgggaaaatggttctcaaactgccagagctgcccttaatgatggtgctattgttgcctttatggatggtgctcaaggtccaatgggtcaagcttggaatgtaggtccatgttgtactgatgctgatgatgtttcttatactcgtaatttcattaaagaaattacaagtaaagcttgtgttgatccaaaacgtatttatgctgctggtttctctatgggtggtggtatgtctaattatgctggatgttaccttgctgatgttattgcagctgctgctccatctgcttttgatcttgctaaagaaattgttgatgctggtaaatgtaaaccagctcgtccattcccaattcttaatttccgtggtactcaagataatattgtaatgtataatggagg

SEQ ID NO: 14602 - DNA, 738 bp, Anaeromyces robustus
  alpha/beta-Hydrolases
acaacaaggagttaattatccaagtgctaaaaaggttacttatcattcaaaaactactaataatgatcgtaaaatgaatgttattctaccaattggatatactgaaagtaagaaatatccagttttatatttattacatggtattatgggtaatgaagattctatgttaagtacaaatatgggtagtattactattccaaccaatttattaagagaaggtaaagctaaagaaatgattattgttcttccaaatgaatatgctccagaaggtggtaaggaagttcctgctggtattaatcaagcttactttgaaggttatgataatttcattaatgatttaattggtagtattatgccatatatggaaaaaaattattctgttgctactggtagagaaaatactgctattgctggtttttctatgggaggtcgtaatagtctttatattggttataaaagatctgatttatttggttatattggagctttttcaccagctccaggtgttgttccaggtcttttcagaaatgaaaatcaattccgtactgatcaaccaccaattgttagtcttatttcttgtggtactgatgattctgtagttggtactaatcctaaaaattatcacaatgttttaactaaaaataatcaagatcatatttggtttgaagtaccaggtgctgatcatgatgctaaagctgtcactgctggttattataatttcattcaaacttgttttgg

SEQ ID NO: 14603 - DNA, 921 bp, Anaeromyces robustus
  alpha/beta-Hydrolases
tgactgggaatgtagacgtaatgaaattaaagctgaaattgaaaattatgaacttggtaaaaaaccagcacctccacaaaatgtaaaagcaacatattcaggaggtactttaactgttgttattaatgataataatggatcagctacacttacctctaaacttaatgttccaagtggtaatggtccatttccaattattattggtatgaatagtggtactggttctcttagtgctagtcaatttagtggttttattcaagtaccatttaatcatgatcaatgtgctaaatattcaatgaatggtcaaaaagatacaaatgcacaattttataaaatgtacccaaatttaaaacaagctggtgattatattgcttggtcatggggtgtttctcgtcttattgatggtcttgaacaagtaaaggatcaaattcacgctgatatatcacacattggtgttactggttgttcttatgccggtaaaatggctctctttgctggtgctttagatgaacgtgttgcattaaccattgctcaagaatccggaggtggtggtattaattcatggagagtttcagatactattggtaatgttgaaaaaattgacaatactaactattcatggttcatgcaagctttaaagaataattttggtaatggaaaagctacaaaattaccatatgatcatcacgaattagtagctatgatcgccccacgtgcattctttactttaggtaacccagattatgaatggttaggtgataaatcaggttatacttctgctatggctgcttatgaagtatggaaagctatgggtgttgaagatagatttggtttcaattttgttggaggacatacacattgtagtgctgctggttctcaagttaatgatgtcaataaatttattgacagattccttcgtgg

SEQ ID NO: 14604 - DNA, 489 bp, Anaeromyces robustus
  alpha/beta-Hydrolases
tcttgtaagattccctaatggttacaagggtgacaaaccagttccacttcttattaattatcacccaatttcaggtagtgctgctgcttgggaatatggttctcaaactgccagagctgcccttaatgatggtgctgttgttgcttatatggatggtgctgttggcccaggtggtcaagcttggaatgttggtccatgttgtactgatgctgatgatgtacaatacactcgtgatttcattaaagaaattacaagtaaagcttgtgttgatccaaaacgtatttatgctgctggtttctctatgggtggtggtatgtctaactatgctggttgtaaacttgctgatgttattgctgctgctgctccatccgcttttgatctttctaaagaagttgttcaaagtggtcaatgtactccagctcgtccattcccaattcttaacttccgtggtacaagtgatttcgtagttccatacagtggtggttattc

SEQ ID NO: 14605 - DNA, 378 bp, Anaeromyces robustus
  alpha/beta-Hydrolases
agaaggaattgaatacccaactcctcaaaaaattacttactattcaaaagttactgaatctgaacgtaaaatgaatgttattcttccagttggatatgatgaaaataaaaaatacccagtagtatacttcttacatggtcttatgtcagatgaagatggtatgcttggtgatgaatctactattgctattccaactaatttaattaaagaaggtaaagctaaagaaatgattatggttcttccagatatttatgctccagtaccaggtacagctgttgaaccaaattatgatccagaatattataaaggttatgataatttcattaatgaattaactgaagttattatgccatacatggaagaacattatccaattct

SEQ ID NO: 14606 - DNA, 759 bp, Anaeromyces robustus
  alpha/beta-Hydrolases
agaaggaattgaatacccaactcctcaaaaaattacttactattcaaaagttactgaatctgaacgtaaaatgaatgttattcttccagttggatatgatgaaaataaaaaatacccagtagtatacttcttacatggtcttatgtcagatgaagatggtatgcttggcgatgaatctactattgctattccaactaatttaattaaagaaggtaaagctaaagaaatgattatggttcttccagatatttatgctccagtaccaggtacagctgttgagccaaattatgatccagaatattataaaggttatgataatttcattaatgaattaactgaagttattatgccatacatggaagaacattatccaattcttactggtagagaaaatacagctatttgtggtttctctatgggagctcgtactagtctttacattggatacatgaaatcagatttgattggttacactggtgcatttgcaccagctccaggtattactccaggagaagattcattctctggtaaacatccaggattaatcactgaagatgaattccgtgcagaaattccaccaattgtttcacttattgattgtggtactaatgatagtgttgttggacaattcccaaaaagttatcatgaaattttaaccagaaatggtcaagaacatatttggttcgaagttccatatgctgatcatgactggaatgctatttctgctggtttatataatttccttcaaactacttttga

SEQ ID NO: 14607 - DNA, 765 bp, Anaeromyces robustus
  alpha/beta-Hydrolases
agaaaatattacttatggtgaacttcaaagaattacttattattctgaaaatactaaaagtgatagaccaatgaatattcttcttccaccaaattatgacccagacaataaaaaatatccagttttatatcttttacatggtattctctcagatcaaaattctttaattaaaccaaaatatagtacaccaaatattgctggttatttaatgaatgaaggtttagctaaagaaatgattattgtatatccatatacttatgctccaaaagatggtattgaagttgaaccaggattttctgaagaacatgctgctggttataataatttcattaatgaattactttacaatattatgccatatatggaaaaaaattatccaattcttactggtagagataatactgctattgctggtttttcaatgggtggtcgtaatagtttttatattggtttaaataaaccagaattatttggttatattggtgctttctctcctgctccaggtgttcttccagaagaaggtaaaactagtttattcccttctgaagatgatttcttagttaaagataaacaattaacaccatatgttactcttgtttgtactggtactgatgatgatgttgttgctgaatacccaattcattatcataatgttttcactaaaaataaccatccacatctctggtatgaagttccaactggtggtcatgatggtattactgttagtagtggtgtttacaactttttacaaactttatttggtat

SEQ ID NO: 14608 - DNA, 516 bp, Anaeromyces robustus
  alpha/beta-Hydrolases
gtcaggaggtaaacgtaccgttcgtatagatttaccagataattatgataataaaaaaccttatcgtttagtttttggtatgcaatgtgctggaggttgggccggtggtgttcaacaagaaggatattatggtttaaaacctttagatactggtaaaactacgatttttattgctccagaaggtaatggtcaacaattaccatggggtgaagccgattataaattatttgatgaacttttagataaattaaccaatgatctttgtattgatatttctcgtgtcttttcaactggttttagttatggtgcaatgtttagtaatggtctttcatggaatcatcaaaaagtacttcgaggtgttgccgtttatgaaactgctgaacgtaatatttatcttccaaaacatacaggtgatggtattggttggatgggagttcttggttttgatgataatatttgtacaccagaaatgggacgtcatgctcgtgatattatgcttgaacataattcagaagg

SEQ ID NO: 14609 - DNA, 96 bp, Anaeromyces robustus
  alpha/beta-Hydrolases
tcgttggtgtactcaatctggtggtcatctttgggatcataaagatccaggtcaaaatcaatcttgggttccaaaagctacttgggaatttattac

SEQ ID NO: 14610 - DNA, 757 bp, Anaeromyces robustus
  alpha/beta-Hydrolases
caaacaaaataatatccaatatccatcacctcaaaaaattacttacttctcttcaaatactaatagtgaacgtaaaatgaatattattcttccagttggttatgatgaatctaagaaatacccaattgtttatttcttacacggtatttttggtgatgaagattctatgctcgatgaaagtactattgctattccaactaatttacttaaagaaggtaaagctaaagaatttattatggttcttccaagtgaatatgctccaactccaggtaatgaagttgaaccaggtttctctcaaaaatactttgatggttatgataacttcattaatgaattagttgatgttattatgccatatatggaacaaaattatccaattcttactggtaaggataacactgctctttgtggtttctctatgggtggtcgtaacagtctttacattgcttacaagagatcagatttattcggttatgttggtgctttctctccagctccaggtgttactccaggtgatgatttctctggtcatcatccaggtttattcactgaagaacaattccgttctgatgatccaccatatgttacccttatttcttgtggtactaatgattccgttgtacatgaattcccaaaaagttaccatgaaattttaactagaaacaaccaaaaacacatatggtttgaagttccaggtgctgatcacaatgaagatgctatttctgctggtttatacaactttgtacaaactattttc

SEQ ID NO: 14611 - DNA, 507 bp, Anaeromyces robustus
  alpha/beta-Hydrolases
agaaggtgttgaatacccaagtattaatcaattaacttattattctactactactgaatctgaacgtccattaatcgttcttcttccaccaaattatactgaaactaagaaatatccagttctttatttattacatggtattatgggtactggtatgtttatgttacaagaaggttttggtactgttgctattccaggtaatttatatgctaaaaatatggctaaagaaatgattattgttcttccagatcaatatgctccagctccaggtactgaagttgaaccagatttaaatgaagaatattttgctggttataataattttattaatgatttaattaatgatattatgccattcttagaaaagaattattctattgctactggtagagaaaatactgctctttgtggttattcctttggtggtcgtaatagtctttacattggtttaaaaagaccagatttattcggttatattggtgctttctctccagctccaggtcttgt

SEQ ID NO: 14612 - DNA, 708 bp, Piromyces finnis
  alpha/beta-Hydrolases
cggtggtaacactttaaatgtttacttaccatacggatatgacaagaacaaacaatacaacatcttctatcttatgcatggtggtggtgaaaatgaaaacaccattttcagtgatgatgttaaacttcaaaacattcttgaccatcaaattatgaatggtgaacttgaaccattgattgttgttaccccaactttcaacaagtgtgaagctcgtactttctacaaggaattccgtgaatctgtcatcccattcgttgaaggaaaatactctacttacgctaaatctacttctgctagtgatatcaaggcttctagaatgcacagagcttacggtggtttctctatgggttctgcttctacttgggctgttcttgttaactgcttagatatttgtgcttactacatgccacttagtggtgataactgggaagctaacggtggatatggtaaggccaagtctattgccgatgctgttaacagattcggtttaaagaagaatgaattctttatcttctgtgctactggttctgaagatatcgcttatccaaacatgaatccacaaatggatgaaatgaagaagatggatccatttgtttacacttctgacttctctaagggtaacttctattacttagttgctccaggtaagactcactggtggggatacgttaagcactacatctacgatgctcttccatccttcttcca

SEQ ID NO: 14613 - DNA, 750 bp, Piromyces finnis
  alpha/beta-Hydrolases
accaggtgttcaatacccaactgccaaaaagatttactacttttcaaaaattacacaatcctatcgtccattaaatgttattcttccagtaggatatactgaaagtaaacaatatccagttttatacttattacacggtattatgtgtaatgaagattctatgttagaagctgaaatgggtagtcttactattccaacaaacttattcaatgatggtagagctaaagaaatgattattgttcttccatatgaatatgctccagaagctggtaaggaagttgaagccgcttttaatcaagcctactttgatggttatgataactttatcaatgaattaactgatgtcattatgccatacgtaaaggctaattactctattaaaactggtagagaaaatactgctatttgtggtttctctatgggtggtcgtaacagtctttacattggttttaagagatctgacttatttggttatgttggtgctttctctccagctccaggtgttaccccaggtactgactcttctggttatcacaaaggtttatttactgaagacagtttccgtgctgaaatttcaccaatcgttgctcttataaactgtggtactagtgattcagttgttggacaattcccaaagagttaccatgaaattttaactagaaacaaccaagaacacatttggtttgaagttcaaggtgctgatcacaatggtgtagccgtttcagctggattctacaacttcatcttagc

SEQ ID NO: 14614 - DNA, 537 bp, Piromyces finnis
  alpha/beta-Hydrolases
aaagactggttcctttgaattcaaatggggtaacaacaagcgtactgtccgtattgatatcccagataactatgataagagcaagccataccgtttagtcttcggtatgcactgtatgggcggttgggccggaggtgtccaacaagaaggttactatggtttaaagccattagatactggtaagactaccattttcgttgctccagaaggtaacggtcaacaactcccatggggtgaagctgattactacatgttcgatgaacttcttgccaagttaaagggtgatctctgtattgatgaatcccgtgtcttctctactggtttcagttacggttctatgttctctaacggtctttcctggaaccaccaaaaggttctccgtggtgttgccgtttacgaaactgctgaacgtaacatctggcttccaaagcacactggtgaaccaattggttggatgggtgttcttggtttcgatgatggtctctgtactccagaaatgggtcgtcacgctcgtgatatcatcttagaacacaactc

SEQ ID NO: 14615 - DNA, 534 bp, Piromyces finnis
  alpha/beta-Hydrolases
aactggatcatttgaattcagttggtctggtggtagacgtactgttcgtattgatattccagataactataataacaacaacccataccgtttaatattcggtatgcactgtatgggtggatgggccggaggtgtccaacaagaaggttactatggtttaaagccattagatactggtaagactaccattttcgttgctccagaaggtaacggtcaacaactcccatggggtgaagctgattactacatgttcgatgaacttcttgccaagttaaagggtgatctctgtattgatgaatcccgtgtcttctctactggtttcagttacggttctatgttctctaacggtctttcctggaaccaccaaaaggttctccgtggtgttgccgtttacgaaactgctgaacgtaacatctggcttccaaagcacactggtgaaccaattggttggatgggtgttcttggtttcgatgatggtctctgtactccagaaatgggtcgtcacgctcgtgatatcatcttagaacacaactc

SEQ ID NO: 14616 - DNA, 537 bp, Piromyces finnis; identical to SEQ ID NO: 14614
  alpha/beta-Hydrolases

SEQ ID NO: 14617 - DNA, 486 bp, Piromyces finnis
  alpha/beta-Hydrolases
tattgttaaattcccaaacggctacaagggtgataaggccgtcccacttcttatcaattaccacccaattatgggtagtgcctcccaatgggaaggtggttctcaaactgccaaggctgcccttaacgatggtgccattgttgctttcatggatggtgctcaaggtccaatgggtcaagcttggaacgtcggtccatgttgtactgatgctgatgatgttacctacactcgtaacttcattaaggaaattacccaaaaggcttgtgttgatccaaagcgtatctacgctgctggtttctccatgggtggtggtatgtctaactatgctggttgttacctctctgatgttattgctgctgctgctccatctgctttcgatcttgccaaggaaattgttgactctggtaagtgtaagccatctcgtccattcccaatccttaacttccgtggtacttctgataacgttgttatgtacaatggtggtct

SEQ ID NO: 14618 - DNA, 78 bp, Piromyces finnis
  alpha/beta-Hydrolases
tgaaatgtacgaaaactgtaacggtggtgttaaggtcggtctttgcaccattaacggtggtggtcacagtgaaggtga

SEQ ID NO: 14619 - DNA, 486 bp, Piromyces finnis; identical to SEQ ID NO: 14617
  alpha/beta-Hydrolases

SEQ ID NO: 14620 - DNA, 486 bp, Piromyces finnis; identical to SEQ ID NO: 14617
  alpha/beta-Hydrolases

SEQ ID NO: 14621 - DNA, 78 bp, Piromyces finnis; identical to SEQ ID NO: 14618
  alpha/beta-Hydrolases

SEQ ID NO: 14622 - DNA, 78 bp, Piromyces finnis; identical to SEQ ID NO: 14618
  alpha/beta-Hydrolases

SEQ ID NO: 14623 - DNA, 486 bp, Piromyces finnis; identical to SEQ ID NO: 14617
  alpha/beta-Hydrolases

SEQ ID NO: 14624 - DNA, 825 bp, Piromyces finnis
  alpha/beta-Hydrolases
ctctggtggtaccttaactgttactgttaatgacaatggtggttctcttactcttacctctaaaatttctgttccaagtggtaatggacctttcccaattatcattggtatgaacagtaacactggttctcttagtgctagtcaatttaatggttttattcaagttccatttaaccatgatcaatgtgctcaatactctatgagtggtcaaaagaatactaactctccattctacaaattatatccaaaccttaaacaagctggtgattacattgcttggtcttggggtatttctcgtcttatcgatggtcttgaacaagttaaaaatcaaattcatgctgatatggaacatattggtgtcactggttgttcttacgccggtaaaatggctctctttggtggtgctttcgatgaacgtattgctttaactattccacaagaatctggtggtggtggtattaactcctggagagtttctgataccattggtaatgttgaaaagattgataatactaattactcttggtttatgcaagctttaaagaacaactttggcagtggaaaatctactagattaccatacgatcaccatgaattaattgctatggtcgctccacgtgccttctttaccatgggtaacccagattatgaatggttaggtgataaatctggttacacctctgctatggctgctttagaagtatggaaggctatgggtgttgaagacagatttggtttcaactttgttggtaatcacatgcactgttctgctgctaattctcaagttagtgatgttaacaagttcattgatagattccttcgtgg

SEQ ID NO: 14625 - DNA, 759 bp, Piromyces finnis
  alpha/beta-Hydrolases
tgttaccaaagaaaaggtttactactactcttccttctctcaatcccaacgcccattaaatgttattttaccaccaaattattcaaccgataaaaaatatccagtactttacttacttcatggtgtagctgctaatgaagatatcatggtagaagaatataatggtgctttaaatattccacctaaccttgctaaacaaggtaaggctaaggaaatgattattgtttctccacgtgttaatatttatccaccaggtgttgatgaagttgaattcgctttttccacagaatatctttctggttttgataattttattaatgatttaatagatagtattatgccattcattgaaactcattattcagttcttacaggtagaaacaatacagctattgctggcttttctatgggtggtcgtacagcactttatattggttatagtaaacctgaattatttggttatgtttgtggtctttcacccgcttttggattaactcctattgaaggatctagtgtatatcatagtcttttcccatccgaagaagatgtcaaaattagaaatgttaataaaacaccttatgtcactttaattagttggggaaatattgatactgttgttaatccctacccatttatttatcataaagttcttacgaataataatcaacctcatctttatatggaagttattggtgctaatcatgatgaaatagctatcactcatggtttatataattttgttatgacgcttttcggtca

SEQ ID NO: 14626 - DNA, 771 bp, Piromyces finnis
  alpha/beta-Hydrolases
aattaaaaaaggtgtcaactatccaacagttgatagtttaacttattattccactacaaccgaaactaaccgtactttaactgttcttgttccaccaaattattctccaaagaaaaagtacccagttctctatttgttacatggtattatgactgatggagcttggatgattcaagatggatttggtactattgccattccaggaaatttagctcatcaaaaaaaagctaaagaaatgttcattgttcttccagatcaatatgctccatcaccaggtaccgaagttgaaccagccttaaatcaagaattctttaatggttatgataactttattaatgatttagtcaatgatattatgccatttatgaaaaaacaatattctattaaaactgatagaaaaaatactgctatttctggttattcctttggtggacgtaacagtctttacattggtatcactagatctgatttatttggttatgttggttctttttcaccagctccaggtctcgttccaggggatgatattttcactggacatttcgatggtttataccaagaaaaggaattaaaatttaagcatcaaccttacctcaccatgctttcttgcggtacaaatgatactgttgttttcgatttcccaaaacaatatcatgaaattcttaaaactaataaacaagaacatatctggtatgaaattactggtcatgatcatatggataatgaatctttttcttctccataccataatttccttacttccatttttga

SEQ ID NO: 14627 - DNA, 237 bp, Piromyces finnis
  alpha/beta-Hydrolases
aggtgttaccaaagaaaaggtttactactactcttccttctctcaatcccaacgcccattaaatgttattttaccaccaaattattcaaccgataaaaaatatccagtactttacttacttcatggtgtagctgctaatgaagatatcatggtagaagaatataatggtgctttaaatattccacctaaccttgctaaacaaggtaaggctaaggaaatgattattgtttctccacg

SEQ ID NO: 14628 - DNA, 756 bp, Neocallimastix californiae
  alpha/beta-Hydrolases
gattgttatggttccgggttgtgaacagataagtgatccattaaacattttcatcttcttcccatccgctgatgaaggtgaaatagattatgagagctacgttgaaaatatggaagaatctcttctcttcaccttaaaccttccaggttatggcgtaagaaaggatgaacctcttattactgattgggatttattagtgaagaatgtgacgaaggcaattattcaaaccgctgcctcggataagtttaaacaatgtaataccattcactttgttggtaatggttttggtgccatattagcttggaagacacttcttcaaattcaagcctatgaagatgaaaataaggaagtcccaccaatttctactttaattatttctagagccatggctccttccgttccacgtccaatacaattagccgaacaagttctctctgaacttccattagaaggtattgctacgttccttggcatgacagaaagtaaggttgattttgaaggtgaaaaatcctatctccttccaatcattcaaaatgaataccgtatgattgatagtgttaccaatgaaagtaatataaagattcgttccaagttattaatgttctccggtaaacaagataaaattattgatgaaaataatgccgcattatggaagaaggaagtcagtgatgaatacagtgaatttactcaacatatcagaatgagaggtaatcattggttcatgatgaagaatactgctaaatatttaaagaatat

SEQ ID NO: 14629 - DNA, 822 bp, Neocallimastix californiae
  alpha/beta-Hydrolases
tgattttgataatttaaatgattatggtgattggattgttcgtttagatactaataaggatactactaattctttcttccttatcccagctgctggtagttccattaatatgtataatagttggagtaagtatatgaataagtctgctttattcgctattagttatccaggtcacttggcccgtatagatgaaactccaattgatgactttaaagtattggttaagtctattggtgaagaaattttaaataatattaagaatggtaaaatttcaaaggataaaccaatttacttctttggtcattccttaggtgccttagtttcctatgaaacagttttatatcttcaaaatgaaagaaagaagggtaatccaaatgctccagttgttactgctttagttgtcagtgcttctccatctccagttttcccaagaccaattactattaaacatgacgaaaatggtaatccagttcattttactgatttagctccagaggaattaccagcatttttaactaatcttggtggtgctaataaggatagtatgagcaataataaacaattccaaaaattaattccatccattgttgccgatttcaaattaactgatgaatacagacgttttactgataaggatcatcaattagaatgtgctctttatgatattggtggtattagtgatccaattatttctgttgcatcaagatctcgttgggatcttgaaaatgctgaaggttatccaatagttcgtattgaatttgaaggtgaccactggttcattcaagaaaatgtagaagttgttcttgaacgtttaaagaagga

SEQ ID NO: 14630 - DNA, 690 bp, Neocallimastix californiae
  alpha/beta-Hydrolases
tttcatcttcttcccatctgctgaagaaggtgaaattgattacagtagttatgtggaggagatggaggattctcttctcttcaccatcaaccttccaggttatggtgaaagaaagggggaagctgtcattaccgactgggatttattagttaagaatgtcactaaggttatccttcaaaccgccgctgattctgaaaaattcaaacaatgtaatacaattcactttgttggtaacggttttggtgcactattagcttggaagactcttcttcaaattcaaatctatgaagatgaagataaggatgttccaattatttctactttaattatttctcgagtcgtggctccaactgctgaacgtccaattcaattagcaggtgaggttatttctaaacttccaccagagggtattcgtctcttccttgaaatgattggaagtaaggtcgatttcgaaggtgaaaaggcttacctcttaccaattattcataatgaatatgctatgatggattctgtcactaatgaaaatgatatgaagattcgttccaaattattagtattatctggtaaacaagataagattattaatgaaaataacacttccttatggaagaaggaagttagtgatgaatttagtgaatttactcaacatatcaagatgagaggtgatcattggttcatgatgaaagatac

SEQ ID NO: 14631 - DNA, 813 bp, Anaeromyces robustus
  alpha/beta-Hydrolases
tgatataaataattatggtgattggcttattcgtttagatatgaataaatctactaataatacctttatacttttcccagctgctggtagttctattaatatgtatagtaattggaataaatatttaactaattctactttacttgctgtaagtttaccaggtcatttaattcgtttagaagaaaaaccaattgataatatggaagatttagtggataatatttataaggaaattataaagaatgttaaaaatggtaatattccaaaggatcaaccattatatttatttggtcattctttaggtgctttagttggttatgaagtagctatgactcttcaaaatgaaagaaagaaaggtaatccagatattccaaatattactgctttaatttctagtggttctccagctccaattttcccaagaccagttgttattcgatatgaaaatgataaaccaattcatttcactgatttagttccagaacaatacccagaagaattaagtagacttggtggtgctaatagtgaaagtttacaaagtaaacaattccaaaaattaattccatctattgcagcagatttcatacttactgataattataaacgttttagtgaaaaagatcatcaattagaagttccaatttatgatattggtgctaattctgattatgttgctccaaaggatagtagaactaattgggatattgaaattgctaatggatacccattgaaacgtatgaatttcgaaggtggtcattggttcattcaagataatcttgaagttgttatggattatttaaagaaagaacttaa

SEQ ID NO: 14632 - DNA, 720 bp, Anaeromyces robustus
  alpha/beta-Hydrolases
agatccattaaatgtatttatattcttcccatctgctgatgaaggtgaaattgattacagtgaatatgtagaaaaaatggaagattctttacttttcactgttaaccttccaggttatggtgttagaaaggatgaaccatttattaatgattgggatcttttaattaaaaatattactaaagcaattattcaaacagatatttcaggtaaatttaaagaatgtaaaactattcactttgttggtaatagttttggtggtattgttgcatggaagactcttcttcaaatacaagcttatgaagatgaagataaagaagtaccaattatttctactttaattatttcaagagctattgctccaacagctaaacgtccaattgaattaggtggtgaagttttatctaatttaccaaatgaaggtattgctactttccttaaaggtattgaaagtaaagtagatttcagtgatgataaggcttatcttttaccaattattcataatgaatatttaatgaatgatgctgttactaatgaaagtaatatgaaaatacgttcaaaattattaatgttctctggtaaacaagataaaattattgatgataataatacatcattatggaaaaaggaagttagtgatgaatttagtgaatttacacaacatattaaaatgagaggtaatcattggttcgtaatgaaggatacctctaaatatttaaagaa

SEQ ID NO: 14633 - DNA, 621 bp, Piromyces finnis
  alpha/beta-Hydrolases
ttccttactcttcactgttaatcttccaggttacggtgttagaaaggatgagccacttgttactgattgggatttattagttaagaatgttactaaagctattattaaatctgatgaatctgaaaaattcaaggattgcaatgccattcactttattggtaatggatttggtgccttattagcttggaagacacttcttcaaattcaaatctatgaagatgaagataaggatgttccaattatttccaccttgattatttccagagccttagctccatcggttaaacgaccaattgaatttaacggtgaagttatggctaaatattcaccagaacaaattgcttcttaccttgaaaagactgaatgtcaagttgaatttactggtgataatgaataccttttaccagtaatcaagaatgaatatgctatgatcgattctattactaatgaaaatgatatgaagattcgttccaaattattaatgttctctggtaaacaagacaagattattgatgataataatacttccttatggaaaaaggaagttagtgatgaattcagtgaatttacccaacatattaagatgagaggtaatcactggtttatgattaaggattcttc

SEQ ID NO: 14634 - DNA, 807 bp, Piromyces finnis
  alpha/beta-Hydrolases
gaaagattatggtgaatggcttattcgtttagatactaataataatattactaactcattcttccttttcccagctgctggtagttctatcagtatgtatggtaattggaacagttacatgaaaaactcagccttatttggtgttagttatccaggtcatttagtacgtttagatgaaactccaattgatgacttaaagactttagttagtgctattgctaaagaaattatggaaaatattaagaatggtaatattccaaaggatcaaccactttactgttttggtcactccttaggtgctcttgtttcatatgaagttgtaatgcttcttcaaaatgaaagaaagaatggtaatccaaatgccccagtctttgctggtcttattgtaagtgcatctccagctccaatttatccaagaccaattcctcttcgtaaggttaatggtaaaccaattcactttactgatttatcaccagaacaattcccagaagaattagctattcttggtggagctaacaaagaaagtttacaaagtaaacaattccagaagttaataccatctattgcagctgatttcaaaattactgataattacaaacgtattactgataaggatcatcaattagaatgtccattatatgatattggtggtgtttctgatccaatggttaacccagattctagaaagaattgggaacttgaagtaactgaagaaactccattagttcgtattacttttgaaggtggtcattggtttattcaagaaaatatggaatctgttcttgaacgtttaaagaaggaacttaa

SEQ ID NO: 14635 - DNA, 756 bp, Neocallimastix californiae
  Aminotran_1_2
tatagctaatgtcgcattattcactactttagtaacaagatcagattatatattttatgattcatcaagttctaaacatgtattagatgctatatcattttcaaaagctaaaactttatcttattcacatgttaatgctattgaaaatattgaaaatcaagttaaacttgtacatgaaaaattccccaaaagtaaaaaagttattgtttcatcaagtatttttatgaatgaaggggatatatgtcaattaaaagatattcatagaattgctcaaaattatcaatgtatagttgttattgatgatacatttggttgtggtttctttgatggctcatccaataatattcttgaattttttaaatttaaaggtcaaatagattttattacaggttctttctctggaattatggaatctaatggtggttttattgtttacggagaaaatcaaaaatcatttatgaattctttaaaaataaattatgaaagagatgctattcttccaaataccgccggcgctctcctcgctagttatcaatgtttggagactcctttaaatacatcatcctctggtaagattaatcgtcgtcttcaactctttaaaaatattcttcattggaaaaatggattaaagcgtattggattagatataccaaatcattccaaatcaacagtcattcctatttttatgccaacaaatgaatctggaatcgctgttcaaaaggcattacaaacccaaggattatatgtttcctatga

SEQ ID NO: 14636 - DNA, 1032 bp, Neocallimastix californiae
  Aminotran_1_2
aaaaattaatttctgttctacttcttatcttggtttaaatcaagatccaagaatgaaacaagctgcttatgaagctattgaacaatatggtttaagtcctcttggtagtgcaccatttggtggtttaacaaatcttcatgaaaaattaggttaccgtttaggtaaaatatatggtttaccatatggtattactacttctggtgctacccttgctaatatgactattattccattaattgttggtgctaaggatttcgttttttcagatgaattaaatcacactaccatcattgatggtattgatttatctaaagcaaaaatgattaaatataagcacaatgatatggaagatttagaaaaaaatgttaaactaattcatgaaaaattcccaaatagtgtaaaattaattattttcgatggtgtatttagtatggaaggtgatgtctgtgatttaccaaacattgttagaattgctaagaaatataattgtaaaacaatgattgatgaatgtcatgctcttggtattattggtccacacggttatggtacattagattattttaatatgccaggatctgttgattttgtaacaggtacattagttaaatctctttgttctcatggtggttatatttgctgtagaagagattatcaaaataagttagaaaattcaagcggtattattttttctacaaataatacaccagcttatgctgctacttcattaaaggctctcgatttaattgaagaagaaggtccaaatagtgttcgtgctagacttcaacgtaatgtcaagcattggaaagaaggtgttcgtaacctcggttttgaaattattgaaggtgtcagttgtgtttgtccaattatgatttatgatgaaattaatggtttaaagtttcaaaaacgtttatatgaagaaggtttgaatttctcagctgttgctttcccagctgttccaaagaatatggctagattaagaactactgttttaggttcactcactgatgaagatattgatgaagctttaagtat

SEQ ID NO: 14637 - DNA, 792 bp, Neocallimastix californiae
  Aminotran_1_2
aaattcttttattattccattaatagtcggaaaaaatgatgcaatatttattgatgaatgtgctaaaacatcaattaatgacagtgctgaattatcaaattcaaaaatttattattataagcataataatgcttctggtcttgaagcttgtcttttgaaggccagtcaggaattaccaaatagtaagaaacttattattatagaaggtgtatataatattactggtgaaatttcaaatttagttgagtttataaatgtctcaaaaaaatttggaggcattgtgttagttgatgaaagtcatgctcttggtgtacttggaaaagagggtaagggttcattagaatatgcaaatattcatgaaggtgttgatgtaattactggttcattagaatattcactttgttcaaatggatcatacattcttttaaataatgaattaagtaaacaatttaatgatttaatatttataaatgatacaattactccattaagtgctgctatttcaagtacaacattagatattttaagacaggattcgaagacagttgatcaattaaaaaataatgtatcatggtggaggagtcattgccaacaaaatggtatagaattaattgatagtaattcagctatttctgcaattagaattgatgataagggtattttattaaatcttcaaaggagattatatgatgaaggattaaatgttatggtaagtacaaggccatatggtttattaaaattcattctttctgcctcattaactgaagatcttttagaagaagctatggatat

SEQ ID NO: 14638 - DNA, 951 bp, Neocallimastix californiae
  Aminotran_1_2
attcataaatttcaattcaacatcttatctttccctaaataaagaattaaaagttaaacttgtagctgaaagagtgataaaggaatatggtataggatcctatggtatttttacaccatatcatgttgaattatatcaacatttaaaggaaatttatggtgaagattatgatcatattcaaacctatcagggagatatacgtgatgtcttcttctcaaaattatttgattccaacgatttcattttctatgatgaacaattaaacagctcattcagacaagtcttgagagcattacatttcaagaagaatcaactcgttgaatttaatcataatgatgcatttgatctttctgaaaaattagaagctattgatttaatttcacctgatgctcataaatatattatcacggaaggtgtttttgaattacaaggggatttatgtcatcttcaagatattttcaatatttcaaaaaaatatgattgttatgttattttagatgaatccaatgccttaggtgttattggtaaggaaggattgggttcctacaattatcatcaatgtcaggaaaaggcagatattgtattttgctctatggataaggtgctttgtgccagtggtcaattttatgtatttaaccaaagaatttcaactctcctagcaagacgtctcactgaccttttcaatgaaacaatttatccaccagtaagtacattagctgctgctgtcgctaaaaccgtattggatattattgtcgaagattctgttgatttcaaaaatgttggagaggacaccactggtgttcatgctcaattaatggataaaattaaatattggaagaaaaaatgtcaaagtattggcttaaaatttattgaaagtccatctccaatgacttgtatgattttagatgaaattgatactgaatcgttggctcaactcttatttaaaaataa

SEQ ID NO: 14639 - DNA, 771 bp, Anaeromyces robustus
  Aminotran_1_2
tgttttttctggagccaatatttgtaatgttgcattatttactacattggcaacaaaaaatgattatattttttatgattcatcaagttcaaaacatgtattagatgcaatttcattttcaaaagccaaaatattatcttattcacatgtaaacgctatagaaaatttagaaaaacaagttaaaatcgttcatgaaaaatttccaaatagtaaaaagattatcgtttcttcaagtgtatttattaatgaaggagatatttgtcaattaaatgatattaataaaattgctcaatcttatcaatgtattgtagttattgatgatacatttggatgtggttattttgatggttctgctaataatattcttgaattttataaattaaaaggtcaaattgattttatttgtgggtctttttctggtattatggaatccaatgggggattcattgtttatggtgaaaatcaaaaatcatttatggatttaataagtaaaaattatgaaagagatgctatcttaccaaatatagctagtgctattttagctagttatgaatgtttagaagtaccattaaattcatcaattggtaaaataaatagacgtcttcaactttttaaaaatatgcttcaatggaaaaatggtttaaaaaaaattggtttagatattccaagtcattctaaatcagctactcttccaatttttatgccatccgatgatattggtatggcagtacaaaaggcactacaagaagaaggtttatacgtttcttatga

SEQ ID NO: 14640 - DNA, 723 bp, Anaeromyces robustus
  Aminotran_1_2
atcaataaaagatggagcagaattatcaaatgcaaatgtctattattataaacataatgatatttcaagtcttgaagctagtcttgtgaaggctaatcaggaattaccaaatggtaaaaaacttataacagttgaaggggtatatgaaataacaggggaagttgttaatttaagtgaatttattacagtagctaaaaaatatggtggtttagttttattagatgaaagtcatgcacttggtgttcttggtgctaaaggtaaaggttcaatggaaaatgctaatattcatgatggtgtagatattattactggttcattagaatattcactttgttcaaatggttcatatttccttttgaatcaaaatttaagtcaacaatttagtgatttaattttcattaatgatattattactccattaagtgccgctatttctagtactactttagaaattttaagacaagatgcaaaaatgattcaacaattaaaagataatatttcatggtggagaagtcattgtcaacaaaatggtattgaattaattgatagtaattcagctattgctgctataagaattgatgatgactctgttttattaaatcttcaaaaaagattatatgaagaaggattaaatgttatggttagtaacaatccatatggtttattaaaatttattttttctgcttcattaactgaagatcttttagaagaagctatggatat

SEQ ID NO: 14641 - DNA, 801 bp, Piromyces finnis
  Aminotran_1_2
tggagatggaaattcatttgttattccattaatggttggtaaaggggatgctatttttgttgatgttgaagcaaagacttcaattaaagatggttcagagttatcaaatgctacagtctattactatagccataacgatccaattagtcttgaatcatgtcttttaaaggcaaatcaagaagtaccaaatggtaaaaagcttgttgttattgaaggtgtttataaaatatctggtgatgttgctaaattaaatgaatttattccaattgccaagaaatatgacgctactattttagtagatgaaagccatgcacttggtgtacttggtgctagaggaagaggttcattagaacaatttaatgttcgtgagggtgttgatattattactggttcattagaatattctctttgttctaatggatcatattttcttttaaataaacaattaactcaacaatttagtggctttatctccattaatgatacaattactccattaagtgctgccattgctagtactacattagatattttaagacaagatactaagatgattgaacaattaaaaagtaatatttcatggtggagaactaattgtcaacaaaacggtattgaattaattgacagcacatcatcaattactgctattaaaattgatgacgaaaatgttttattaaatcttcaaaaaagattatttgaagaaggattaaatgtaatggttagtacaagtccatatggtttattaaagttcatactctctgcttctttaactgaagatcttttagaaaaggctatgaatat

SEQ ID NO: 14642 - DNA, 678 bp, Piromyces finnis
  Aminotran_1_2
tagttctcaagattttattttcattgacgaacaattgaacacttcttttaaacaaacaataaaatcattattcttagaaaagggtcatattattgaatatactcataatactccacttgaccttaaatctcaattaaaagcaatccaattaaaatttccaacagtaaataaatttataataaccgaaggtgtttttgaaaatataggggatgtttgttatcttaatgatattatggatatatcaaaagaatttggatgtactcttgttttagatgaatcaaatgctttaggggttatcggtcaaaaaggatttggttcatatgactatcaccaatgtcaacaaaaagcagatattattttttgctctatggataaaacactctgttctagcggtcaattttatgtatttaataataaaagtattagtatattattaaaaaataatactagtctctttgatgaatccatatattacccaataaatgcattatcagctgctgttgctaaaacagtcttaaatataatttttgaaaatactacagattttaaaaatataacatcttccatagatgttcacactcaactagttgataatattaattattggaaacaaaaatgtcaaagtattggcttaaaattaattgacagtccttctgcaattacttcaattattattga

SEQ ID NO: 14643 - DNA, 993 bp, Piromyces finnis
  Aminotran_1_2
aattgacaaagttaaaaaagcagctatagaagctattgaaaaatatggtttaaattcagatatacaatgtccattaaaaatacaattggagcaaaaattatcaaaagattatggatatcaatatgctgctacattttctggcgccaatgttgcaaatatatcattgtttaccacattagtaacaagaatggattatatattttatgattcttcaagttcaaaaaatgtaatagatgctgttttattttcaaaagcaaaaacattatcatattcacacgctaatgctatagagaatttagaaaaacaagttaaattagttcatgaaaaattcccaaaaagtaaaaaagtcattgcttcatcaagtatttttgtaaacgaaggtgatatatgtcaattaaaagaaataaatagaatagctcaaacttatcaatgtatagttgtaatagatgatacatttggttgtggtttctttgatggttcatcaaataatatacttgaattttataaattaaaaggtcaagttgattttataacaggttcattttcaggaatcatggaatcaaatggtggatttattgcatatggtgaaaatcaaaaggaatttatggatcgtattattaaaagaaatgaaaaagaagttatcttaccaaatactgccaatgctttattagctagctatagtagtttagaagaaccaatgaatttatcttctggtagaatcactagacgccatcaactttttaaaaatattcttcaatggaagaatggtttaaaaggtataggtttagacgttccaagtcattcaaaatcagcaaccattccaattttcatgccaactgatgatgcaggaatcgcttttcataaagcattacaggaacaaggtttatatgtatcatatgaatctagcgaaagagatgctatacataaatataaaatattaaccactgttcaagcaaataaaaccaaagatgaaatagatagtgcattaaaaat

SEQ ID NO: 14644 - DNA, 1035 bp, Piromyces finnis
  Aminotran_1_2
aaaaattaatttcagttctacttcttaccttggtttaaatcaagacccaagaatgaaagaagctgcttataaagctattgaacaatatggtttaagtccacttggtagtgcaccatttggtggtttaaccaatcttcatgaaaaattaggataccgtttaggtaaaatttatggattaccatatggtatcactacttcaggagctactcttgctaatatgactatcattcctttaattgttggtgcaaaggatttcgttttttctgatgaattaaatcatactactattattgatggtattgatttatcaaaggctaaaatgattaaatataagcataatgatatggaagatttagaaaaaaatgttaaattaattcatgaaaaattcccagatagagtaaaattaattatttttgatggtgttttcagtatggaaggtgatgtatgtgatttaccaaatattgttagaattgcaaagcaatacaattgtaaaactatgatggatgaatgtcatgctcttggtattattggtcctcatggttatggtactttagattacttcaatatgccaggatcagtcgattttgttactggtactttagtaaagtctctttgtgcccatggtggttatatttgttgtagaagagattatcaaaataagttagaaaattctagtggtattattttctctacaaataatactccagcatatgctgctacttcattaaaggcccttgatttaattgaagaagaaggtccaaatagtgttcgtgctagacttcaacgtaatattaaacattggaaggatggtattcgtaatcttggttttaagattattgaaggtgtcagttgtgtttgtccaattatgatttatgatgaaattaatggtcttaaattccaaagacgtttatatgaagaaggtttaaacttctcagctgttgcttttccagctgttccaaaaaatcaagctagattaagaactactattttagcttcacttactgatgacgatattgatgaagctttaagtattat

SEQ ID NO: 14645 - DNA, 36 bp, Anaeromyces robustus
  AMP_BINDING
atttttcacttctggtactacaggtaagccaaaagg

SEQ ID NO: 14646 - DNA, 36 bp, Anaeromyces robustus
  AMP_BINDING
attatttacttctggtactacaggtaaaccaaaagg

SEQ ID NO: 14647 - DNA, 1347 bp, Neocallimastix californiae
  AMP-binding
atggttaacagttacttacaatgaatttggatcacttataaaagcttgtgcctatgttttaaaaaagaaatatgatctttatccaaacagtagaattggtattattggtacttataccccaatgaatcaattattaatctatgcgttatggtatttacgttgtgctgtggttcaaattccaattaaattaggaaatgatgttaaacaattttggtgtagattattaaacttaaaaatgattttctatgatgttaattttattccttttgataataaagaagatattgaaatgatggaagaaaatgatgaatggatttggaaatggcagtatcctttaaccgagaatgaaatgaatttagaagctggtttagaaggtatccttgccattaatctttatggtgaagaattccgtaatgaaattcttgaagctaaaaataaaggtttatcctttgaacgtcaagggttagctacggatattatttatattattggtacttcctctacttcacaagccattattaaaaatggtcactgcactgaaatgaaatttgttcctataactacgacaagtggtggtgaatgttataataattatatttatcgtggaatgaaaaataagccaactttcatgattaatattcctgttagtcatttattgggtttttatggttgtgttttccatactattcaatatggtggtccagtggcttatcatactcaaaatttaagagatattggtttcattccagaaattatcttagatgatatgatagaggttaaaatggaccgtactattttatttccatttcattttaacgaatttaaaaaattatttgatgatcatcatcctcattgtgaaaaatggaagaaatttatttcttcaagaaatccatactgttttagaaatggtggagctcctctcagtaattcaatagatgattggttcaatgatacttttggtattagaacttgtcaagattatggttcctctgaaactggtgcaatcttaacttcagatttcaattctaaaccattaccaggagaagaaacctatctttctaaattcccacattgtgaactttatttaaaacctcttgatgacaatgatcctagtgttggtgagttattcgttcattctcctactcttaccactggttatatttccaaagcaaagcctggtgaattttatgaatcggatatgcctggtatgcgtacggatattgatgcagataaacttttcgtttactttgaaggtaaaaagttccttaagactaacgatattgtgattcgtagtccaaaatctggtaaatataagtatgtttctcgttcggatgatgttcttgtctt

SEQ ID NO: 14648 - DNA, 1347 bp, Neocallimastix californiae
  AMP-binding
atggttaacagtaagctatcgtgaatttggggctcttgtaaaggcttgtgcttatgttttaaagaaaaaatatgatctctatccaaatagtagagttggtattatcgcaaattttaccccacttaatcatttattagtttatgctctatggtataatcgttgcgcagtagtccaaattcccgttaaattaggaaatgatgttaaacaattttggacaagaatcttaaatttaaaaatgatattttatgatgttaattttaaacctttcgatgatgaagaaaatataaaaatgatggaagaaaatgatgaatggatttggaaatggcaacatcctttaaccgaaaatgaaatgaacttagattctggaaaagatggaattttatctgttaatctttatggagaaagtttcagaaatgaaattttaaaagcaaaaaatcaaggaaaatcatttgaacgtaaatgttatgaaactgatattatatatattattggtacctcttcttctactcaagctattattaaaaatggtcaatgctcaaaaatgaagtttgttccaatgactactatgcaatcaggtgaatgctataattattgtgttcaacaaggtttaaaatataaaccaacctttatgattaatgctccagcaagtcatgatttaggatataaaaagtgtgtccttcataatattcaaatgggtggcgctgttgtttatcatactcagcagttaagagatattggtttcattccagaaatcattttagatgatatggttgaaactaatgtagatcatactcttctatttccatttcatatagctgaaattaaaaagttatttgatagtcatcatcctcattgtgaaaaatggaaaaaatttctttgctcaagaagtaaatactttttaaatactggtggtgctcctatgagtgataaaattgataattggttctttgaaacatttggttttcgaactactcaaatatatggttcatctgaatcaggtccagttatgatctcagatttctcagttccagctcttccaggagaagaaacataccttaccaaatatcctcatattgatatttattttaaacccattgataataacgatccaaacattggtgaattgtatgttcatagtccaaccttgactactggttacattagaaaagctgaaaaggatgaattttatgaatctaatgtgcctggtatgcgcactgatatcgaagctgatgatcttttcatttatattaacggtgaaaagttttataaaacaaatgatatttggaatcgtagtccaaaatcaggaaaatataaatatatttcaagattagatgatattatcgtttt

SEQ ID NO: 14649 - DNA, 1350 bp, Neocallimastix californiae
  AMP-binding
ttccccatggacttgtgtttcctataaacaattttttagattagtgaaagcttgtgcttatgtccttaaaaaaagatttgatttaccacctcaatctagagtaggtgtggtcgccaatactttacccttaaatattttaattatttatgctctctggtatattcgttgtacacctgtagctgttcctcctaaactcggtaatgatgttaaacaattttgggctagaatgctcgatattagtatgtttatttatgatattaatgttaatatttttgatgaagaaaaacaaaatcaattaaatgaaagtggtgaatggatatgggaatgggaatatcctttacgtgaagacgaatataatttaagtgctggcttcaaaggaattcctatgttttgtatgaataattcagaatttcttgaagaaatttatcaatgtagtcttgaaggtaaaacgtatgcacgtcccggtttaaaagatgatgtggtcatggttattggtacttcttcttccactcaagctatcattaaaaatggacactgctccaaaatgaagtttattcctgttcgattaattcaatgtggtagtctttttcaaaacatattattgactcgaaagataagccttaaatacagtgttcttgccagcattccctcctatcatatgatgggtttcacctggattggcgttcatcatatgaatactggaggcgccttaattttccatactcaaaaattacatgatattggatttgtaccagaagtattattagatgatatagtggagactaaacctggagtcattcctctcttcccatttaattatgcagaaattaaaagactttttgatgaacatcatccaagatgtgaggtttgggagaaagccatccaggcctgtcccaagaattgttttagaacaggtggtgcccccatcggctatgatttgcttcattggtttaatcaaacatttaagattttaattaataatgaatacggttcctcggaaactggtattatgatgtataaacaatttgataaagatctcgtcccaggagaagaaggttacctcactagagtcccatggcaatatttccattttaaacttattgatgaaaataatccaaatgaaggtgagctctttatctacaatccattcgcaatcaccggttatattggaagggcaaagaaaggtgaattctatgaatcagctgtaccaggaatgcgttgtgattatgaacacgataatctttatgaaacaattgatggaattgaatactatcgaaccaatgatatttggactcgtagtaccatttctggtgattacaaatatgtttccagagtagatgatattttaac

SEQ ID NO: 14650 - DNA, 1332 bp, Neocallimastix californiae
  AMP-binding
tccatggctttctgtctcattttctgaatttgaagctttagcaaaagctatggcttatgttattaataagcgttatcatttagaaccacaaagtcgtgttgctattattgctaattctcttccaaaaaaccaacttttaactattgctctttggtatttacgtgtaattactgttgaaattactccaaagattggtaatgatgttaagcaatgttggatgagaatgttagatatgtctatgggtttctatgattgtgttttcaaaccattctatcaagatcaccaggaggaagaagaatggacttggccatggatttacccaattactccagatgaaaatttagtttctggaaaggaaggtattcgcatggttaatatggacggagaagcttttatgcaagaagttttagatgctaaggagcaaggtttattctatgagcgtgttggtgataatgatgatctcattaccattggtggtacctcctcttctgctcaagctatcattaaaaatggtcaatcttcagaaatgaaatttgtcggtcttcaccatcgtaaagctggtcatacctttaatagttatttatataaaaaccttccattggaaactaacttcttattagtttctccattccatcatttattgggtatttgccaaggtttattacatcctatctataatggtggtccattagtatatcgtactcaaagtttagatgatattggtgtcattgcagaaatgcttttagatgatattatggaaaaaggtgtcaatgagacacttatcttctctttccaatatgctgagtggaagaaattaaaggaatcaggacatccaaaatggcctatttgggaaaaggcaattcgttctaaacctattggttgtttccagactggtggtgctccacctattccagaagttaccaagtggttggctcgtgagcttcaactattcccagccgaacaatacggttcttctgaatctggtgtaatgatgtattgtactggtgaaccaccacttcgtggtgaagagggctatcttaagagaattccatgggttgatgtttaccttaatcctttaagtgaagatgatccaaatgttggtgaagccttcatctattctgaacagaatttcactggttatattagaagagtagaaaagggggaaactgctaaaaactctcctgctccgggtcttcatgtagatattaaggccgatgaagtctttgtcgaaattgatggtaagaaattctataaaactaatgatattttcagacgtagtcctatcaccggtaattataaatatgtttctcgtatggatgatgtcattacctt

SEQ ID NO: 14651 - DNA, 1350 bp, Neocallimastix californiae
  AMP-binding
aaactggaaaactattccattttatcaattatttgatcttgtaaaagctacagcttacgttcttaaaaaaagatatgattttgcaccaggaacaagagttggtattattgctaatacattaccatttacacaattaatgatttatgcattatggaatttacgttgtgttgttgttacttttccaccaagacttggtaatgatgttaaacaatactgggttaagcattgtgatattaaaatgatattttatgatgtcaattttagactttatgatgattatgagaaaaatgaaaaattaaataaacaaggtcaatggatttggaaatggattcatccattaactgaagaagatgaaggtttatgtgctggtaaagaaggtgtcaaaatgtgtttcatttatagtgatgaattatgtaaagaaatttatcaagcaaaagctgaaggaaaagcatatcaaagaaagggtgaccctgatgatgttcttcttgtaatgggtacttcctcttcatcacaagctattattaagaatggtcaatgtactaaaatgaaattcgttccatggcaatttaaacaatgtgttgataaatataaacaattccttactccacaaaatagactttatactgatttattcgtaaatattccattccatcaatcctttggtgcaatttgtgcacttagttactgtgttactggagctagtggtttaatctttaaaacacaacaattaagtgatattggttttgttcctgaaatgattttagatgatatggctgaaactaaagctcaaagtgtttgtcacttcccattccaatatgctgaatataaaaagttatttgacgaaaaccatccaagaaagaagatttgggctgattattttagagaagatcatgaacataaagtttttaagactggtggtgctccattaaatccagttgttgctaaatggtataaagatacatttgatattttaattatgaatggtttaggttccactgaaggtggtcacgttttacatgatattatggagggtgaaatattaccaggtgaagaaggatattatatgagagttccatgggttgatttctactttaaaccattaaatgatgatgatccaacgattggtgaactttatacccattcttctgctaatgttacaggttactttggaagagctaagccaggagaattttatgattcaccagtcccgggcatgcgttgtgatgttggtaaggaagatctttttgttgatattgatggtgttccatactttaaaactaatgatgttcttaaacgttcaccaaaatctggttattataaatatgttactagaattgatagtattattac

SEQ ID NO: 14652 - DNA, 1332 bp, Neocallimastix californiae
  AMP-binding
atatttatcggtaacttatagtgaattttctaatttagcaaaatcttatgcttacgtcttaaaacataaatataatattccttcacattcaagaattggaattattggagaagccagtccaattcatcatttattgttaacatatacagtatggtatttaagaggaactatagttgatatttcaacaggtgtaggtgaagaagtagttcaagcatggatgaccaccacagatgttatacttacactttatgattcaggtcttccaccttttccatcgatacaatctataaatataaatgaagaattggaatggacatggacatggacatccaaaattggaaatgaagatgaaattaataaaacaaagtcaatgacaatggtcaatatagaaaatgatatattaaatactgaagtattgtcagcgtataaatcaggaaatttctttgaagaagaactttctccagacgattatgtttcaattataggaacttcttcatcaacacaagctgttgttaaagatggtgtttatacaaaaatgaaatttgttgctgcaaaaagtccagtactacttaatacagaatatttcagaaaaatagctacatataaaaataaaccaacagcactattcaatttagggtacggatcggctattggacaacgtcattcctttatgtatgctatcatgtgtggaggtccaatagttttcggaacgaaaaataaagaaaatataggattaattccagaagtggttttagatgatattgatacaattaaaccagatatatgttttatttttccatacatgttttcaatttggaaaaattttgcagatgataatcatccaaactggccaagatggaaaagcgctttagaatcaaggccaaaatggtgtttctcaacaggaggggcaccagtagatccagaaattttacattggcttcgtaaagatttaaatatacaacttaataatatatatggtacttctgaagctggattagtatttactcgtaatgaatatacagtagatgttgaaggagaagaaggctatgtatccgaattaccaggagtagaatattatctcgatccaatagatggtaacgagaatgaaggtgagctgtacgttcattctccattagttttttcaggatatgttgataaggccaaagaaggtgatccaaattcatgttatggcatcgttgttaataaatggcgggaagaaaatttcagaacatttaatggaaaagaatattataaaacgaatgatatatggaggagatgtcctaaaacaggtaattattgttatgtttcaagagtggacgatactcttgtttt

SEQ ID NO: 14653 - DNA, 1332 bp, Neocallimastix californiae
  AMP-binding
ttatttatctgtaacctacagtgaatttgcgaatttagcaaaatcttatgcgtatgttataaaacaaaaatataatgttccttctcattcaagaattggtattattggagaagccaatcctattcatcatttattattaacatatgcggtatggtatttaagaggaactatagtagatatttcaaccggtgtcggtgaagaagtagttcaggcatggatgaccaccacagatgttacacttacattttatgattcaggtcttccttcttttccatctttacaatctataaatccaatggacaaatcagactgggtgtggtcatggtcatcaaaaatcggaaatgaaaatgataaaaacgaaataaaaacaatgacaatggttaatttagaaagtgatatattaaatgctgaagtactatcagcatataaatctgaaaacttttttgaagaagcactttcaccagatgattatgtttcaattattggaacatcatcttcaacgcaagctattgttaaagatggggtttatacaacaatgaaatttgttgctgctaaaagtcctgtaatacttaatcttgaatatttcagaaagatagctacctataaaaataaaccaagagtactatttaatttaggttttggttcagctattggacaacgtcattcctttatgtatgctatcatgtgtggtggtcctataatttttggtacaaaaaataaaaaaaatattggattaattccagaggtagttttagatgatattgatactgttaagcctgatatttgctttatttttccatatatgttttcaatatggaaatcttttaaagataataaacatcctgactggccaagatggagaaatgctttaagatcaagaccaaaatggtgcttttcaacgggtggtgcaccagtagatccagaaattttgcgatggcttcgtaaagatttatatatacaacttaataacatttatggaacttctgaagctggattagtatttactcgtaatgaatatactgtggatgttgaaggagaagaatcttatgtttcagcattaccgggagtagaatactatctcgaccctgtaaatgaaaatgaaaatgaaggagaactatatgttcattctccattagttttttcaggatatgttgataaggctaaagaaggggatccaaattcttattatggtattgttgttaataaatggcacgatgaaaatttcaaaacaattaacggtaaagaatattataaaactaacgatttatggaaaagatgccccaaaacaggtaattattgttatatttcaagagtagatgatactcttgtttt

SEQ ID NO: 14654 - DNA, 738 bp, Anaeromyces robustus
  AMP-binding
aaatcttcatcctaaagttatggttgttgccccactttatcattctttgggttcagcatggtcaattgctcaaattatgaatactggtagtcctttaattttccgtacccaaaaaaaatatgatattggatttgtagctgaaaatatattagatgatattatagaaactagacctgatgttattccacttttcccaattaattttgttgaatttaaaagactttttgatgaaaaccatccaaaatgtgaaatatgggcaaagggtattagttctttatcaagaagatgtttcctttctgctggtgctccaccaaattatgaagttatgtgttggtttgaaaataaatttaaaatacctgttaataatgtatgtggtgccactgaagctggtcttttcttgtataaagatattgataaacctcaagttccaggagaaaccaattatgttagtcgttgtccatggattcatttccatatggaacatatgtcagatgatcctaatgaaggtgaattatatatttataatcctttcggtatatacggttatgctactaaagctaaaaagggtgaattctatgaatccactttgccaaaaatacgtattgatttagaacatgatgacttatataaaacaattaatggacttgaatattacaaaactaatgatatttggagacgtagtactgtatcaggtgattatgtttatgttgctagagctgatgatgtcattaattttag

SEQ ID NO: 14655 - DNA, 1344 bp, Anaeromyces robustus
  AMP-binding
tccttggttaactgtatctttcaaagaatttcattctcttattaaagcattagcttatgttttaaaaaaaagatatgattttagagttggtgatagagttggtattactgctaatactttacctatgactcaactttatctttatgctttattctttttacgttgtgttgttgtattaattccaccaaaacttggtaatgatgttaaacaatattgggtaagacataatgatattcgtatgatattttatgattttagtttaagaatatctgataatgatgaagaaaatcaaaagttaaatgaccaaggtgaatggacttggccatggacttatcctttaactgaagaagatgctggtttaagtgctggtgaagaaggaattccaatgtgtttcatgtataataaagatttatgtaatgaaatttatcaaactaaattagatggtaaagaatactatagaaaaggagaccgtaatgatgttttaatgattctcggtacttcttctacttctcaagctattattaaaaatggtcaatgttcaaaaatgaaatttgttacataccaagtaactcgtgttggtacaatttatcaaaaagtacttatgccaaatgtcaaacattatactaatttctatcttaattgtccattccatcatggtatgggtgctaataatgccgtaggttttagtatagttaatggtggtcctcttgtatatcatactcaaaaattatatgatgttggttttattccagaaattatgttagatgatatgactgaagtaaatgctgtaaatacacttcaattcccattccattatgaaggatataaaaagttatttgatgaaaatcatccaaaatgtccaatttgggctaaatatttaagtaaacatgataaacatagaatattcaaatttggtggagctttattaaacccagttgttaaggaatggtataaagaaaaattcggtatccacattgttaatgattttggttcttctgaaggtggtaatactcttgttgaagatattgaaaatgtattaccaggtgaagaaggttacttcaaaagaattccatgggtagatttttgtttaaaaccattaaatgaaaatgaaccaaatatcggtgaactttatactcattcaaacattatgactcttggttatgttggcagagctaaaccaggtgaattttatgattcaccaattcctggtatgacttgtgatatagatgctgatactcttttcacttatattgatggtgttaaatattataaaactaatgatgttttcatgcgttctcctgtttctggaaaatacaaatttgttacaagaatggatggtatact

SEQ ID NO: 14656 - DNA, 1353 bp, Anaeromyces robustus
  AMP-binding
accatgggttactgtatcatttaaagaatttcatgctcttattaaagcaatggcctacgttataaaaagaagatttgattttgctccaggtactagagttggtgttattgctaattctttaccaataactcatttattagtttatactttatggactcttcgttgtattgttgtatttataccaccaaaaattggtaatgatgttaaacaatattgggtaagacatattgatataaaaatgattttttatgatattaattttagaccatttgatgatgataatataaataaagaattaaatgaacaatgtcaatggatatggaaatggacttatcctttaactgaagaagatgaagggattagtgctggtaaagaaggaattaatatgttttacttttatgatgaagattttcgtaatgaaatatataatattaaattagaaggaaaaggttattatagaaaaggttgttcagaagatgttcttacagttgtaggtacttcatcttcttctcaagctattattaaaaatggacaatgttcaaaaatgaaatttgttccatggcaaatggttcatcttggtaatttctcacaaaaatctcttacaatacaatatgaatatttttcacctttcttccttgatattccatatcatcattctatgggtattacatgtgctctttcttataatattaattgtggtggaccaattgtttatcatactcaacaattatatgaagttggttttattccagaaatggtattgactgatattgttgaaacaaaatctaaagttattcaacttttcccattccatttcgttgcatttaaaaaattatttgatgataaacatccaaaatgtgaatattggtcaaaatatttaggtaatggggataaaagtaaattatttagaagtggaggtgctccattaaatcctatggttaaaaaatggttcaaagatacttttgatattcaaattattacaggttgtggttcatctgaaggtggttatattttacatgaaattgttgatgatgaagtattaccaggtgaagaatcttatatttggagaagagtaccatgggtcgatttcttaattcttccattaaatgaaaatgaaccaaatattggtgaactttatacacgtaatgaagctaatgttcctggttatattggtagaccaaaaccaggagaattttatgattcaccagttccaggtatgcgtattgatattaatgcagatgaactttatgttgaaattgatggtgaaaaatatttcaaaacaaatgatgttgtaagacgttcaccactttctggtaaatataaatatgtttcaagaattgatagtattcttac

SEQ ID NO: 14657 - DNA, 1230 bp, Anaeromyces robustus
  AMP-binding
tagtaaagtagctaaagaaatacctaacaaatgtgctattgtatgtaacaataatgaaattacatttaagaaattagacgaaatgagtaattctttagcacattatttaagaaaagaaaatattggtagaggagatattgttccaatcattagtgaacgttctcattactttgtaattgctacattagctataatgaaatctggtgcagcatttttaccaatagatccagacttcccaaaagaacgtattgaatatatgattaatgaagttaacgctaaatttattctaaaatatattacaaatattgaaacagaacgtaaaattaaatttgacaatgttattgaatatgaattacaaaaacataattataaagataatgttttcgaaattactaatattaataacagtgatgatttatgttatgtattatttacttctggtactacaggtaaaccaaaaggaactatgatgacacataacaatttaattaattattctctttacagtcaaacatataatggaaaagaaatatatacaaatgattttaataatgctttatctgcagctaaatttacttttgatatgtcactttgtgaaatattatatcctttaattaaaggaaaatgtgtattcatatgtgacgataatgaatataataatcctcaattaataggagaaaaaatattaaaatataatatagattatatatttagtacaccttcaagaattgaaaactatatgaaaaataaaacatacatgaaagctttaaagaatttaaagtgcattttaattggtggagagggttgtaatattaaaacagttgaaaatataattaaaaatacaaatgcaaatatatataatctttatggtccaactgaaacaaccattatgtgtactgtatcagaactctcaaatttgtataaacaaaacaaattaaatgttattactattggtaagccattatgtaattgtaaattgtacatcttagatgaatatttaaaaccagttccgattggagttgaaggtgaaatatatattggaggatatggtgttggtaaaggatatcttaatcgtgaacaattaactagagaaaaattcgttgattgtccatttaatatcaaaaatggtttaccaaatcaaatgtatagtactggtgatttaggaaaatggacagaaaaaggtgaaataatttgttctggacgtgctgatttccaagtaaaaattcgtgg

SEQ ID NO: 14658 - DNA, 843 bp, Anaeromyces robustus
  AMP-binding
taacagtgatgatttatgttatgtatttttcacttctggtactacaggtaagccaaaaggaactatgatgactcataataatatgacaaacttttgtttatatagtcaacattttaatggcaatgaaaatatttatgattacggatttgaaaatgctttagcattctcaaaatttacttttgatatgtcattaattgaaatttattatcctttatataaaagatgtagagtagtactttgtaatgatgaagaatttaataattcagaaatgcttagtgatttaattattaaatataatgtaaattatatttgtagcgtgcaatctcgaataaagaactatatcaaggatgaaggatttaaaaaggcattaaaaaatgttaaatggattggtttagggggagaaaaattaaattctgacattattcaagatattaagaactgtagtaaagcgacattaataaattattatggaccaactgaaactacagtatgttgtacacttaaaaagtttgagaataatgaattaaataattttgaaaataataatacttccataaccatcggtaaaccactatgtaattgtaagatatatatattagacaaatatttaaaaccagttccgattggagttgaaggtgaaattttcattggaggaaactgtgttggtaaaggttatttgaaccgtgaagatttaaccaaggaaaaatttgttaattgtccatactacaactctattaatggatcatcaaataaaatgtatcgcacaggagatttaggtaaatggacaaaagaaggtgaaattatttgtttaggaagagctgatttccaagtaaaaattaatgg

SEQ ID NO: 14659 - DNA, 126 bp, Anaeromyces robustus; identical to SEQ ID NO: 14262
  AMP-binding

SEQ ID NO: 14660 - DNA, 444 bp, Piromyces finnis
  AMP-binding
taaaactggtggtgcaccaatgagcgatgaaattgataattggttattcgaaacttttggtattagatccttccaagattatggttcttctgaagctggttcaattatgaattcggatttctctaaaccagcccttccaggagaagaaacttatctttcgaagagaccatgggctgatatctatttaaaaccaattgatgatgatccaaatattggtgaattgcatgttcgtagtccaacaaatactactggttatattagaaaggcagaaataggtgaattttatgaatcgagtatgccaagtatgcgtactgatattggagcagaatccttatttacatatattaatggtgaaaagtttttaaaaataaatgatatatggagacgtagtccaaaatctggaaaatataagtatatttctagaattgatgacgttattgtatt

SEQ ID NO: 14661 - DNA, 1329 bp, Piromyces finnis
  AMP-binding
atggcttacagtttcttttaatgaatttgaaaaattagcaaaggccatggcatatgttattaataaacgttatcatttagaacctcagagtcgtgttgctattattgccaattctttaccaaagaatcacttattatctatagcattatggtatttacgtgtagttactgttgaaattacaccaaaaatcggtaatgatgttaagcaatgttggatgagaatgttaaatatgtcaatgggtttctatgattgtgtatttaaaccattttatcaagaccataagaatgaagaagaatgggtatggccttggatatatccacctacttcaaatgaaaatttagttgctggaaatgaaggtgttttaatggttgatatggacagtgaaagtttcattcaagaagtaattgaagctagagaccaaggtttaacatttgaacgtgaaggtgattgggatgatttacttactattggtggtacttcctcttctgcacaagctattattaaaaatggccaatgttcagaaatgaagtttgttggggttcatcatagaaaagctggtagttgctatgaaaaatacctccacaaacatcttccagaagaaactaactttttattagtttctccattccatcatttacttggtatttgtcaaggtatgttacacccaatttatgatggtggaccacttatttatcgtactcaaagtgttgatgatgttggtgttatatctgaaatgcttttggatgacattgctgaaattgatgttactgaaactcttattttttcattccagtttgctgaatggaaaaagttaaaggaagctggtcatccaaaatggccaatttgggaaaaggctataagatcaagaccaattggttgtttccaaactggtggtgctccacctattccggaagttacaaaatggttagctcgtgaacttcaactctttccagcggaaagttatggttcttctgaaggtggtgttatgatgtacacagaaggtttaccaccacttcgtggagaagaaggctatcttaaaagaattccatatgttgatatttaccttaaacctttaaatgaagatgatccaaatattggtgaagcttatattcattctgcccagaatttcactggttatgttagaagaatagaaagtggtgaaacttgtgaaaattctccatgcccaggtcttcgtgtagatattaaggctgatgaatgttttgttgaaatcgatggcaaaaaattctttaagacgaatgatatctttagacgtagtccaatcactggtgattataaatttgtttcccgtgttgatgatattatcgcttt

SEQ ID NO: 14662 - DNA, 222 bp, Anaeromyces robustus
  AMP-binding_C
aatagaaaatactattaaaaaaattaaaggaattaaatattcaattgtaattgataagataaaggaaaacaatgataagtatttaatgtgttattatattacagatgaaaacattaatagtggagatataagaaattatttaaaaaataaacttccaatatatatgattcctagttacttcaaaaaaattgataatataccagttacttctaatggtaaact

SEQ ID NO: 14663 - DNA, 222 bp, Anaeromyces robustus
  AMP-binding_C
aatagaaaatacaatgaaagaaataaatggaattgattatgctatagttattgataataataaagaaaatggtaataaatacttaaccggttattatattagtaaaaataacattacaggtaaagatattagaaagagtttaaaattaaaacttccaagtttcatgattccaaattatttcattcgtatatataatttaccaattacatctagtggaaaatt

SEQ ID NO: 14664 - DNA, 912 bp, Neocallimastix californiae
  Arabinanase/levansucrase/invertase
tacctcaaaccacaacccaatcatcactcaaaagtatagtgctgatccaggtgttatggtttacaacggtagagtttatgtttatgctactaatgatggtgatgctggtaccagatacaattcagaaaacacttacggacaaattaacactattaatgttatgtcttctgctgatttagttaactggatggatcacggttcaattccagctgctggtggtggtggtgctgctagatgggcatctaactcatgggctccatgtgctgcttggaaaaagattaatggtaaggataagttcttcctttactttgccaataacgctagtggtattggtgttttaactgccgattctccaactggtccattcaaggatccaattggtagagctcttatctcacgtcaaactccaaatagtaatgttgaatggcttttcgatccagctgttatcgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattctggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaaccaccacactattattgaattcaagaataagtactacatcttctaccacgctgaatggcttaacaagcaaattttaggtggtcaaaagggttaccgtactactcatgttgatgaattaccagttaa

SEQ ID NO: 14665 - DNA, 312 bp, Neocallimastix californiae
  Arabinanase/levansucrase/invertase
tgaagattctggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaaccaccacactattattgaattcaagaataagtactacatcttctaccacgctgaatggcttaacaagcaaattttaggtggtcaaaagggttaccgtactactcatgttgatgaattaccagttaa

SEQ ID NO: 14666 - DNA, 846 bp, Neocallimastix californiae
  Arabinanase/levansucrase/invertase
taatccaattatatgggctgatgtacctgatccagatattattagagtagatgatacatattatatggttagtactactatgtacttcactccaggtgctccaattatgaaatcaaaggatcttgtatcatgggaaattgttacttacacctatgatattttagccaatggtgatgttcaaactctttctagaggtcaacatgattattctcatggttcatgggctgcaagtttacgttataataaaggaattttctatgtattctttggtagttatggtacaaataaatcttatatatttaaaactaaggatattgaaagtggaaaatgggaacgttttgaaattaacggaatgtaccatgatgcttccattcttttcgatgatgatggtagaaattacctcgtttatggaggtggtggtgaaattaagattaaggaatttaatgcggaaatgaccaattttaaatggggaggtcttgataaaactttatttagaactaatctttctggtctcgctggtgaaggatctcatgttatgaaaattaatggatattactatgtatttattattgcttggccaagtggtaaaggtcgtattgaaatttgttaccgtagtaaagacctcactggttactatgaaaacaaaacagttttagattcaggattaggttcctatggtagtggtgttgcccaaggtggtattgtagatacccctgatggtaaaaaatggtttggattattattccaagatcatggtgctgtcggtagaattccagttcttgttccagttaattggcaaaatggatggccaatgatgggtgttaacggtaaagctccacttacttt

SEQ ID NO: 14667 - DNA, 993 bp, Neocallimastix californiae
  Arabinanase/levansucrase/invertase
tttcagtacttttgctagtgctgctgatagcagtgcttttaatggcataaatcttgctaaaagttataaggatattaaaaatcataatccaattaatactattaagtacagtgctgatccaggtgtcatggtttatgatggtagagtttatgtttatggtaccaatgatggttatgctggagaattaggaagaaacccacaggataatacttatggtcaaattaatactattaatgttatgtcttctgatgatttagttaattggatcgatcatggtactatcccagctgctggtagaaatggtgctgctaagtgggccggtaactcatgggcaccatgtgctacacacaagaaaatcaacggtaaggaaaagttcttcctttactttgcaaacagtggtaatggtattggtgttttaactagtgattctccaactggtccatttgttgatccaattggtcatgctcttatttctcgtagtactccaaattgttccaatattgtttggttattcgatccagctgtatttgttgatgatgatggtactggttatctttacttcggtggtggtgttccagataatcaatcttctaatccaaagactgttcgtgctgttaagttaggtaatgatatgactagtcttgctggtaatccagttactattgatgctccatgggtatttgaagattctggtattaacaaatccggtgatacttacttctactcatattgtactaactggaatggtggtccatacggtaatgctaagattgcttacatgactagtaagaatccattaggtccatttactatgcaaggaactgttttaaataacccaggtgatttctttggaactactggtaacaaccatcacactatcattgaatttaaggaccaatggtacatcttctatcacgctgaatggcttaacaaacaagaatttggaagtcaaaagggataccgtacttcacatgttgatgttttaccattttc

SEQ ID NO: 14668 - DNA, 906 bp, Neocallimastix californiae
  Arabinanase/levansucrase/invertase
aaatcataacccaactattactcatagatatagtgctgatcctggtgttatggtttacaatggtagagtttatgtatatgccaccaatgatggtgatgccgctactagatataattcagaaaacacttacgctcaaattaataccattaatgttatgtcatcagctgatttagttaattggatggatcatggttcaattaatgctactggtggtggtggtgctgctaaatgggctaaaaactcttgggccccagctgccgcctggaagaaaattaatggtaaggataagttcttcctttactttgctgataatgctagtggtattggtgttttaactgctgattctccaactggtccattcagggatccaattggtagagctcttatttctcgtcaaactccaaacagtaacgttgaatggcttttcgatccagctgttttcgttgatagtgatggtactggttatctttactatggtggtggtgttccaaaaggtagagaagctaacccaaataccattcgtgttgctaaattaggtggtgatatgactagtatttctggtactccagctaatattgatgctccatgggtatttgaagattctggtattaataagattggtaacacttatgtttactcctactgtactaactggaatggtggtccatacggtaatgctagaattgcttacatgaccagtaacaatccaatgggaaaattcactttccaaggtacctgtttcaacaatccaggtgatttcttccaaactactggtaataatcaccacaccattattgaatttaagaacaaatactacatcttctaccatgctgaatggcttaacaaacaaatcttaggtggtcaaaagggttaccgtactactcatgttgatgaattacctgtcaa

SEQ ID NO: 14669 - DNA, 351 bp, Neocallimastix californiae
  Arabinanase/levansucrase/invertase
tcatgatccatctatcgttaaaagtggtaacaaatattatatttttggatctcacatggacgctgcatatactaccgatttatggaaatttacaaaattgtatacaggtgttgatgaaaataataaaatgtttacaaatttattctcaaaatccaactatgatgcatttaaatttgtaggaaagaatagtgatggaggttattctgtatgggcagcagatgttatgtataataagaaaatgaaaaaatgggttcaatatttctgtacttcttctacttatattaaatcaagtctttgttatggtatagctgataaggttgaaggaccatatacttataaaagttgttttct

SEQ ID NO: 14670 - DNA, 603 bp, Neocallimastix californiae
  Arabinanase/levansucrase/invertase
tccaaatgctattgatccaaatgcattctatgattttaatggtagactatggcttgcttatggttcttggtcaggtggtatttacattttagaattagatgaaagcactggtcttccaaagcataatatttcaaatggtaataatgttgataaatattacggtaagaaacttgcaggtggaggtcatcaatctattgaaggtccatacattttaccatacaaagctgctggatactattatttgtttgtatcatatggtactcttacttcaaatggtggttaccaaattcgtttgttccgttcaaagaatccagatggtccatatactgatgttgctggtaaagaatttatgagtggtactaattcaaactttggtgttaagattatgggtaattatggtattccaggaagagaaaaggcttatatggcaccaggtcacaactctgtattaattgacgatgatggtaaaattttactttgctaccatactcgttttaatgatggtcaagaataccacgaaccacgtgttcaccaaatgttccttaataaggaaggttggttaaccgctgctccatatgcttacactggagaaacaatttccaa

SEQ ID NO: 14671 - DNA, 669 bp, Neocallimastix californiae
  Arabinanase/levansucrase/invertase
taatccaattattaaggatatgtacactgctgatccagctccaatggtttatggtgataccctttacctttacactactcatgatgaagatgtacttaagaacaacttctacactatggaaaactggtatgtcttttctactaaggatatggttaactggactaaccatggtcaaatcttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaggaaattggacatccaattgtttatgaagatgactggaatgactttgacccaactgttttcattgatgatgatggtaaggcttacttatacttcggtaatccagaacttagatatgttgtcttaaacgatgatatgatttcttatgatgaagaaattggagttgttaaggttccaatgactgaagaatccttcggtaagggtagtcacgataccggtacatcctatgctgaaggtccatacttctacaagagaaacggtctttactacatggtctatgctgccttcagagaaggttctcacactgaatctcttgcttattctacttctgaaaa

SEQ ID NO: 14672 - DNA, 876 bp, Neocallimastix californiae
  Arabinanase/levansucrase/invertase
taatccaattattaaggatatgtacactgctgatccagctccaatggtttatggtgataccctttacctttacactactcatgatgaagatgtacttaagaacaacttctacactatggaaaactggtatgtcttctctactaaggatatggttaactggactaaccatggtcaaatcttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaagaaattggacatccaattgtttatgaagatgactggaatgattttgacccaactgttttcattgatgatgatggtaaggcttacttatatttcggtaatccagaacttagatatgttgtcttaaacgacgatatgatttcttatgatgaagaaattggtgttgttaaggttccaatgactgaagaatccttcggtaagggtggtcacgataccggtacatcctatgctgaaggtccatacttctacaagagaaacggtctttactacatggtctatgctgccttcagagaaggttctcacactgaatctcttgcttattctacttctgaaaagccaactggtccatggaagtatggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctattgaaactattccaatgtg

SEQ ID NO: 14673 - DNA, 870 bp, Neocallimastix californiae
  Arabinanase/levansucrase/invertase
taatccaattattaaggatatgtacactgctgatccagctccaatggtttatggtgataccctttacctttacactactcatgatgaagatgtacttaagaacaacttctacacaatggaaaattggtatgtcttctctactaaggatatggttaactggactaaccatggtcaaattttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaagaaattggacatccaattgtttacgaagatgactggaatgactttgacccaactgttttcattgatgatgatggtaaggcttacttatacttcggtaatccagaacttagatacgttgtcttaaacgatgatatgatttcttatgatgaagaaattggtgttgttaaggttccaatgacagccgaatccttcggtaagaatggtgatcgtactacttatggagaaggtccatacttctacaagagaaacggtctttactacatggtctttgctgctttcagagaaggtgcttttactgaatctcttggttatgctacttctgaaaagccaactggtccatggaagtacggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctattgaaactattccaatgtg

SEQ ID NO: 14674 - DNA, 876 bp, Neocallimastix californiae
  Arabinanase/levansucrase/invertase
taatccaattattaaggatatgtacactgctgatccagctccaatggtttatggtgataccctttacctttacactagtcatgatgaaactgaacttaagaacaacttctacactatggaaaactggtatgtcttctctactaaggatatggttaactggactaaccatggtcaaatcttgtctttagatgatattgaatgggctgatgaaagagcttgggctccacaaactgttgaaaagaacggtaagttctatttctacttcccagctcacaagattgatggtggtatggctattggtgttgctgttgctgattctccaattggtccattcaaagaaattggacatccaattgtttatgaagatgactggaatgactttgacccaactgttttcattgatgatgatggtaaggcttacttatacttcggtaatccagaacttagatatgttgtcttaaacgatgatatgatttcttatgatgaagaaattggagttgttaaggttccaatgactgaagaatccttcggtaagggtagtcacgataccggtacatcctatgctgaaggtccatacttctacaagagaaacggtctttactacttagtctatgctgctttcagagaaggttctcaaactgaatctcttgcttacgcaacttctgaaaagccaactggtccatggaagtacggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctattgaaactattccaatgtg

SEQ ID NO: 14675 - DNA, 921 bp, Neocallimastix californiae
  Arabinanase/levansucrase/invertase
taatcataatccattgtttactcatagatatagtgctgacccaggtgttatggtttataataatagagtttatgtctatgctactaatgatggtgatgttgccactaaatttacagacgataatacctatagtcatattaattcacttaatgtcatgtcttctgaagatttagttaattggacagatcatggttcaatcttagttgctggtaataatggtgctgctaaatgggctggtaattcatgggctccatgtgctacttataaaaaaattaatggaaaggataagttcttcctttactttgctaataatgctaatggaattggtgttttaactagtgattctcctactggtcctttcaaagatccaattggtaaagctcttatcactcgtcaaactccaaattgtggtgatgtcgcttggctttttgacccagctgttttagttgatactgatggtactggttacctttacttcggtggtggtgtaccagacggtaaggatgctgcaccaaaaactattagagttgttaaattaggagccgatatggtaagtcttgccggaactccacaacttattgatactccatatgtatttgaagattctggtataaataaaattggaaatacctattactattcttactgtaccaattggtctgcaggtgaaccttatggacaagctagaattgtttatatgaccagtagtaatccaatgggtccattcacatatcaaggtgtctgtttaaataatccaggagaagatttccaaacttatggaaataatcatcatactattattgaattcaaaaataaatattacattttctatcataccgaatggcttaataagcaagttttcggaactcaaaagggttatcgtacttcctttgttaatgaaattacattcagtaatggcaa

SEQ ID NO: 14676 - DNA, 843 bp, Neocallimastix californiae
  Arabinanase/levansucrase/invertase
aaaccctatcatatgggctgatgttcctgatgatgatatcatcagagttgatgatacttattatatggtaagtacaacaatgttctttagtccgggtgctcctattatgaagtcaaaggatctcttttcatgggaaatttgcaactatgtttatgatatccttgctgatggtgacgttcaaactcttaagaatggaaagcatgattattctcatggtcaatgggctgctagtttacgttatcatgagggtactttttatgtcttctttggtagttatggtactaataagtcatatatctttaaaaccaaagatattgaaaaaggtacttggactcgtaatgaaatctttggtatgtatcatgatgcttcaattctctttgatgatgacggtaggaagtatctcgtctatggtggtagtggtgaaatcaaaattaaagaatttaacaatgaaatgaccgacttcaagagaggtggtgctgataaagttttatttagaactggtctttctggtcttgctggtgaaggttctcatattcaaaaaattggtaaatattactatatatttattattgcttggccaaatggaaagggtcgtattgaaatttgttaccgtagtagagatcttcttggaaattatgaaaacaagattgttcttgattccggtttaggttcctatggaagtggtgtagctcaaggtggaatcgttgatacacctgatggtaaatggtatggtcttttattccaagatcatggttctgttggtagaattccagtacttgttccagtcaattggcaaaatgattggccaataatgggtgttaacggtaaagcaccattaacttt

SEQ ID NO: 14677 - DNA, 714 bp, Neocallimastix californiae
  Arabinanase/levansucrase/invertase
cggatgtttacgtgatccatacatctttaagggagaggatggattttactatttacttgctacagatatgaagtcttcccttggttggaatagtaatcgtaatcttttaagtgcaaaatcaatggatcttatccattggactggtataactattattgaaattgctaataagtatcctctcatgaaaggagctgatcgtgcgtgggctcctcaagccatctatgatcgtgaaaagggctcctatatgatatactatgctgctagagttcctggaagggataatagaactataatgtattatgcttatagtaaggacatgaaaagacttgagactgatcctcaagttttatttgctccagctaatggtaatgatgctattgattctgatattattttccaaaatggaaagtattacatgtattacaaaaatgaaacaaataaacgtatttatcttgccactgcctctcatgctaatggtccttacagtgaaataaaacaaatttctgaaggaaatattggtgtagaaggaccaaatatttataaacttaataattcaaataaatggcttttaatgtctgatgcctataatagtggttattatattgtgcaagaaaccactgatttagtaaacttcaggactgttaatcgtaataattacagttttaactttactcctcgtcatggttatgtcattcctataaatggctaccaata

SEQ ID NO: 14678 - DNA, 906 bp, Neocallimastix californiae
  Arabinanase/levansucrase/invertase
aaataaaaatcctttaattactcatagatatagtgcagatccaggtgttatggtttacaatggtagagtttatgtttatgcaactaatgatggtgatgttgctaatagaaatgttggtgaaaataaatatgatcaaattaatactattaattgtatgtcatctgatgatttaattaactggatggatcacggaccaattccagctgctggtggtaatggtgctgccaaatgggctaaaaattcatgggctccaactgctgcttggaagaaaatcaatggtaaggataagtttttcctttactttgccaataacgctagtggtattggtgttttaactgccgattctccaactggtccattcaaggatccaattggtagagctcttatctcacgtcaaactccaaatagtaatgttgaatggctttttgatccagctgtttttgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattcaggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaatcaccacactattattgaattcaagaataagtactacatcttctaccacgctgaatggcttaacaagcaagttttcggttctcaaaagggttaccgtactactcatgttgatgaattaccagttaa

SEQ ID NO: 14679 - DNA, 201 bp, Neocallimastix californiae
  Arabinanase/levansucrase/invertase
aggagcatatctttttgctttcttccaaggtaatgctccagaaaaggaacaattatcttatgctctcagtattgatggttataactttagcattcttaacaatggaagatcgatctggaaatcaaacgtaggtactggttgtattcgtgatccctttattttaaagggtcaagatggttattattatatgttggctactga

SEQ ID NO: 14680 - DNA, 693 bp, Neocallimastix californiae
  Arabinanase/levansucrase/invertase
tggttgtattcgtgatccctttattttaaagggtcaagatggttattattatatgttggctactgatatgagatcgtacagtggctgggatagtaatcgtaatattttaagtgcgaagtcaaaagatttaatacattggaatgatgtcacaagtatagaaattgctaataaatatcctcttactcaaggagctgatcgtgcctgggctccacaagctatctatgatcatgaaaagaattcttatatgatctattttgctgttagagttccaaaccgtggtaataaaaccattatgtattatgcttatagtaaggacatgaaaaaattagatactgctccagcccttttattccaaccaagaaatggtaatgaagctattgattctgatattattttccaaaataataaatactacatgtattacaaggacgaaactagaaaaaccatttgtttagctactgctgatcatgccagtggtccatatcaagaaattaaacaactttctgataatggtattgaagttgaaggttgtaatatttataatattattggaaccaataaatggttaatgatgtctgatgcctatgtcaatcaatatttcgttttacaagaaactaccgatcttgtaaacttcagaactcttaatcgtaacacttatggtttcaactttactccacgtcacggttatgtcat

SEQ ID NO: 14681 - DNA, 921 bp, Neocallimastix californiae
  Arabinanase/levansucrase/invertase
aaatcataatccaatcaatgtattaaagtacagtgctgatccaggtgttatggtttatgatggtagagtttatgtttacgctactaatgatggtattggtgaaaatattggaaataacccaagagataacgattacagtcacattaacactattaatgttatgtcatctagtgatatggtaaactgggttgatcatggtacaattccagctgctggtaacagtggtgctgctaagtgggctggtaattcatgggctccatgtgctgctcacaaaaagattaatggtaaggaaaagttcttcctttactttgctaatagtggtaatggtattggtgttttaactagtgactctccaactggtcctttcgttgatccaattggtggaccacttgtttctcgtagtactctaaactgtaacagtattgtttggttatttgatccagctgttatggttgatgatgatggtactggttatctttacttcggtggtggtgttccagaaaatgctaagtctaacccaaaaactgttcgtgcagttaaattaggtaatgatatgattagtcttgctggtactccacaaactattgatgctccatgggtcttcgaagattctggtattaacaaggctggaaacacttacttctattcttactgtactaactgggataatggaccatacggtaatgctaagattgcttacatgactagtagcagtccattaggtccattccaataccaaggtactgttcttaacaacccaggagatttctttggaactgttggtaacaatcaccacaccattattaacttcaagaacaaatggtatatcttctatcacgctgaatggcttaacaaacaagtcttcggtagtcaaaagggtttccgtacttcacacgttgatgaattaccattcagtaacgg

SEQ ID NO: 14682 - DNA, 597 bp, Neocallimastix californiae
  Arabinanase/levansucrase/invertase
tcccaatgcaattgatccaaatgcattttatgattttaaggggaagttatggcttgtttatggttcttggtcgggtggtatatatattttagaattagatgaaagtacaggtcttccaaaacacaatatttctaatggcaataatactgatagatactatggtaagaagcttgcaggtggtaatcaccaatctattgaaggtccatttattttaccacacaaagctgttggttattattatttatttgtatcctatggctctcttacgtcaaatggtggttaccaaattcgtatgttccgttctaaaaatccagatggtccatatacagatgttgctggaaaagaatttatgagtggtaataattcaagctttggtgttaaagtcatgggtaattataatattcctggaagagaacaggcatatatggctccaggccacaattctgctttacttgatgatgatggtaaagtgttaatattctatcatactcgttttaatgatggtcaagaatatcacgaaccacgtattcatcaaatgtttcttaataaggaaggatggttatgtgctgctccatatgcttatactggagaaactat

SEQ ID NO: 14683 - DNA, 351 bp, Neocallimastix californiae
  Arabinanase/levansucrase/invertase
tcatgatccgtctgtagttaagtatggtaataaatattatatatttggttcccacatggatactgcctatactaccgatttatggaagtttactaaattgtatactggtgttaatgataacaataaaatgtttacaaatttattttcaaaatcaaattatggtgcatttaattttgtaggaaaaaatagtgatggtggttattctgtttgggctcctgatattatatataataatagaatgaaaaaatgggttcaatatttttgtacatcttccacatatattaaatctagtatttgttacgctttagctgataacgttgaaggtccatacacttataaaaattgctttat

SEQ ID NO: 14684 - DNA, 123 bp, Neocallimastix californiae
  Arabinanase/levansucrase/invertase
ttcttcaggtgtgtctgttcatgatccgtctgtagttaagtatggtaataaatattatatatttggttcccacatggatactgcctatactaccgatttatggaagtttactaaattgtatac

SEQ ID NO: 14685 - DNA, 838 bp, Neocallimastix californiae
  Arabinanase/levansucrase/invertase
tcctctcgttagcaacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaatac

SEQ ID NO: 14686 - DNA, 921 bp, Anaeromyces robustus; identical to SEQ ID NO: 14681
  Arabinanase/levansucrase/invertase

SEQ ID NO: 14687 - DNA, 870 bp, Anaeromyces robustus
  Arabinanase/levansucrase/invertase
tcctctcgttagcaacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaatacaataaggatggtagtattgatactattccaat

SEQ ID NO: 14688 - DNA, 840 bp, Anaeromyces robustus
  Arabinanase/levansucrase/invertase
tccaattatctgggcagatgtacctgatccagatattattagagttgatgatacttactatatggtaagtactactatgttttttaatccaggtgctccaataatgaaatcaaaagatcttgtttcatggaaaatttgtaattatgtttatgataaacttgctgatggtgatgttcaaaatcttgcaagaggtcaacatgattattctcatggtcaatgggctactagtttacgttatcataaaggaactttctatgttttctttggtagttatggtactaataaatcttacatttttaaaacaaaagatatagaaaatggtccatggactcgtactgaacttggtggtatgtatcatgatgcttctatgatttttgatgatgatggtagaaattatcttgtttatggagctggtggtgaaattagaattaaagaatttaattctgaaatgaccgattttaagagaggtggtgccgataaaattttatttagaactaacctttcaggtcttgctggtgaaggttctcatgttcaaaaaattaataattattattatattttcattattgcttggccaaatggtaaaggtcgtattgaaatttgttaccgtagtaaagatattcttggtaattatgaaagtagaactgtattagattctggtgttggttcttatggtagtggtgttgcccaaggtggtattgttgatactccagaaggtaaatggtatggtttacttttccaagatcatggttctgttggtagaattccagttcttgttccagttaactggcaaagtgattggccaatgatgggggttaatggtagagctccagtaacttt

SEQ ID NO: 14689 - DNA, 912 bp, Anaeromyces robustus
  Arabinanase/levansucrase/invertase
aaaccataacccagtagtttctcacagatacagtgcagatccaggtgctatggtttatgatggtagagtttatatttatggtagtaatgatggtaatgttgctgaaagacaaggtaaaacaaatgattattctcaaattaaaacaattaatcttttatcatcatctgatttagttaattggatggatcacggtccaattccagcaactggacaaagtggtattgctaaatttgctagtaattcatgggctccagctgcttgtcacaaaaaaattaatggtaaagaaaaattctttgtttactttgctaacaatgctagtggtatttgtgttttagaatctgattctccaactggtccattcaaggatcctcttggaaaaccacttattactagacaaactccaaactcaaatgtagaatggcttttcgatccagcttgtttagttgatgatgatggtactggttacctttacttcggtggtggtgttccaaatggtcaagccgctaacccaagaactgttcgtgttgtcaaattaggagctgatatgaagagtcttgctggaaccccacaaacaattgatgctccatgggtattcgaagattctggtattaataaggttggtaacacttactactacaactattgtaccaactttaatggaggtccatacggtaatggtagaattgcttacatgagtagtaacagtccaatgggtccattcagttacaagggtacttgctttaacaaccaaggtgatttcttacaagatggtggaggtaacaatcaccacactattattgaatttaagaacaaattttacatggtctatcacgctcaatggcttgatatgaaggttaaaggtaaatcaaatggataccgtactactcacattgatgaattaccaatgaatgg

SEQ ID NO: 14690 - DNA, 384 bp, Anaeromyces robustus
  Arabinanase/levansucrase/invertase
tgtatccgttcatgatccatctgttattaagaatggtaataagtattatattttcggttcacatatggatactgcttatactaccgatttatggaaatttactaaattatatacaggtgtcaatgaaaataatagaatgtttactaatttattctctaaatcaaattatggtgcattcaattttgttggtaaaaacagtgaaggtggatattctgtatgggctccagatgttatgtataacaaaaaaatgcgtaaatgggtacaatatttctgtacatcttctacttatattaaatcaagtatttgttatgctttagctgataatgttgaaggtccatacacttatcaaagttgtttcattttctctggtatggattctggaag

SEQ ID NO: 14691 - DNA, 564 bp, Anaeromyces robustus
  Arabinanase/levansucrase/invertase
aaatgctattgatccaaatgtattctatgatttcaatggtagactttggcttgcttatggttcatggtctggaggtatttacattttagaattagatgaaagtacaggtcttccaaaacataatattagtaatggtactaatattgataaatattatggtaagaaacttgctggtggtggtcaccaatctattgaaggtccatacattttaccatataaagctgctggttattactatttatttgtttcatatggtactcttacttctaatggtggttaccaaattcgtttattccgttctaaaaacccagatggtccatatactgatccagctggtaatgaattcatgggtggtactaattcaaactttggtcttaagcttatgggtaattacaatattccaggtagaagtcaagcctatatggctccaggtcataattctgctatgattgatgacaatggaaaggttttaatgttctatcatactcgtttcaatgatggacaagaatatcatgaaccacgtgttcatcaattattccttaataaggaaggttggttctgtgt

SEQ ID NO: 14692 - DNA, 738 bp, Anaeromyces robustus
  Arabinanase/levansucrase/invertase
tttacgtgatccttatatttttaaaggtgaagatggtttatattatttacttgctacagatatgaaatctgcacttggttggaatagtaatcgtaatcttttaagtgcaaaatctaaagatcttattaattggtatgatacaacaagtatagaaattgccaataaatatcctttaatgcaaggagctgatcgtgcatgggctccacaagcgatttatgatccagaaaaaaaatcttatatgatttattatgctgcaagagttcctggacgtgataatagaactattatgtattatgcttatagtaaagatatgaaaaaattagatacagcaccagccttattatttgctccaagtaatggtaatgatgctattgattcagatattattttccaaaatggaaaatattatatgtattataaaaatgaaactaataaacgtatttatcttgctacatctgatcatgctaatggtccatataaagaaataaaacaagtttctgaaggtaatattggtgttgaaggtccaaatatttataaattattaaattctaataaatggcttttaatgtctgatgcctattatgatcattattatgttatgcaagaaactactgatcttcaaaattttaaaacggttaatcgtaatagttatagttttaattttactcctcgtcatggttatgttattcctattactgctcaacaatataatgctcttttagcagcttatccttcaaa

SEQ ID NO: 14693 - DNA, 207 bp, Anaeromyces robustus
  Arabinanase/levansucrase/invertase
tgaaggagatgcttatttatttgcttatttccttggtaatgctcctgaacaagaaagactttcttatgctgtaagtattgatggttataattttaaagctcttaataatggaaaagaagtatggaaatccaatattggaacagaatgtttacgtgatccttatatttttaaaggtgaagatggtttatattatttacttgctacaga

SEQ ID NO: 14694 - DNA, 927 bp, Anaeromyces robustus
  Arabinanase/levansucrase/invertase
aaatcataatcctttaataactcatagatatagtgctgatcctggtgttatgatttacaatgatagagtttatgtatattcaaccaatgatggagatgttgatcttaataataaaaatgttaatggaaatacctatgaccatattaaaagtcttaatgttatgtcttcttcagatttagttaattggcaagaccatggttctattaatgttgcaggtggtgctgctaaatgggctcaatattcatgggctccatgtgctacctataaaaaaattaatggtaaagataaatttttcctttactttgctaataatgctaatggtgttggtgttttaactagtgattctccaactggtcctttcactgatccaattggtaaagctcttatttctcgtgatacaccaaattgtggtgatgttacttggctttttgatccagctgttttagttgatgatgatggtactggttatctttactttggtggtggtgtaccaaatggtatggatgctaatccaaaaactattcgtgttgttaaattaggaagtgatatgattagtcttgctggtcaaccacaattaattgatgctccatacgtttttgaagattctggtattaataaaattggtaatacctatttctattcttattgtactaattggactggtggtcaatatggtggtgctaatattgcttttatgactagtaatagtccaatgggtccatttaaagctggaagttcctgtttcaaaaatccaggagaatttttaggtaattatggtaataatcatcatactattattcaatttaaaaataaatggtacattttctatcataccgaatggcttaataaaattgtttatggagatcaaaagggttatcgtactggtcatcttgatgaattcccagttactaataataatttccctaa

SEQ ID NO: 14695 - DNA, 765 bp, Anaeromyces robustus
  Arabinanase/levansucrase/invertase
aggatgtttacgtgatccatttattcttaaaggtgaagatggtacttactttttattagccactgatatgagatcttatagtggttgggatagtaatcgtaatattttaactgctagatctactgacttaattcattggacaaacgtttctcttattgaagtttgtaataaatatcctattttccaaagaggtgatcgtgcttgggctccacaagcaatttacgatccagaaaaacaagcttatatgatatactttgctgttagagttccaagtaatggtaacaaaactattatgtattacgctcatagtaaggatatgactagatttgataccaccccacaacttttatttgctcctaagaatggtaatgaagctattgatgctgatattatttaccaaggtggtagatattatatgtattataaagatgaaacaagaaaaactattaatttagctcttgctgaacatgcaagtgggccttaccaagaaattaaacaactttctgataatggtattgaagtcgaaggttgtaatatttatccagttgttggtactaataaatggcttatgatgtctgatgcttatgttaatggatatttcgtattacaagaaactactgatttagttaactttagaactcttaatcgtaatacttatggttttaactttactccacgtcatggttatgttatacctgttagtccttcacaatataatgctcttttaaaagcatatccatccagaggtatgtatactataaatgt

SEQ ID NO: 14696 - DNA, 918 bp, Anaeromyces robustus
  Arabinanase/levansucrase/invertase
agtttcaaataaaaatccattgattactcatagatatagtgcagatccaggtgttatggtttacaatgatagagtttatgtttatgccacaaatgatggtgatgttgctaatagaaatgttggtgataatacatatgaacaaattaatactattaattgtatgtcttcagatgatttagttaactggactgatcatggaccaattgctgctgctggtcaaggtggtgcagctaaatgggctaaaaattcatgggctccaactgctgcccataaaactattaatggtaaggaaaaattcttcctttactttgctaacagtggtgctggtattggtgttttagttagtgactctccaactggtccattcactgatccaattggtaaagctcttattactccacaaactccaaattgtgctagtgttacttggcttttcgatcctgctgttttagtcgatactgatggtactggttatctttactttggtggtggtgtcccacaaggtcaagatgctaatccaaaaactattcgtgttgttaaattaggtccagatatgacaagtcttgctggtaatccagaaactattgatgctccatgggtattcgaagattctggtattaataagattggtaatacttatgtttactcttactgtactaactgggctaatggtccacatggtaatgctagaattggttatatgacaagtaatagtccaatgggtccattcactttccaaggtacttgtttcaacaacccaggtgatttcttccaaactactggtaataatcatcacactattattgaattcaagggtaaatattatatcttctatcacacagaatggcttaacaaacaagttttaggtagtcaaaagggttatcgtaccactcatgttaatgaaatgcctgtaaatgg

SEQ ID NO: 14697 - DNA, 915 bp, Anaeromyces robustus
  Arabinanase/levansucrase/invertase
ttcaaataaaaatccaataattactcatagatatagtgctgatccaggtgttatggtttataatggtagagtttatgtttatgccactaatgatggtgatgttgctaatagaaatgttggtgataatacatatgaacaaattaatactattaattgtatgtcttcagatgatttagttaactggactgatcatggaccaattaaggctgctggtcaaggtggtgcagctaaatgggctaaaaattcatgggctccacatgctgctcacaaaactattaatggtaaggaaaaattcttcctttactttgctaacagtggtgctggtattggtgttttagttagtgattctccaactggtccattcactgatccaattggtaaagctcttgttactccacaaactccaaattgttctagtgttacttggcttttcgatcctgctgttttagttgattctgatggtactggttatctttactttggtggtggtgtcccacaaggtcaaaattctaatccaaaaactattcgtgttgttaaattaggtccagatatgacaagtcttgctggtaatccacaaactattgatgctccatgggtatttgaagattctggtattaataaggttggtaatacttatgtttactcttactgtactaactgggctaatggtccatatggtaatgctagaattgcctatatgacaagtaacagtccaatgggtccattccaatatcaaggtacttgtttcaacaacccaggtgatttcttccaaactactggtaataatcatcacactattattgaatttaaggataaatattatatcttctatcacacagaatggcttaacaaacaagttttaggtagtcaaaagggttatcgtaccactcatgttaatgaaatgccaatgaatgg

SEQ ID NO: 14698 - DNA, 858 bp, Anaeromyces robustus
  Arabinanase/levansucrase/invertase
aatgtacacagctgatccagctccattaattgttgatgatactctttacatttacactactcatgatgaagatgttcttataaacaatttctatactatgagagattggtatgtattctctactaaggatatggttaactggactaatcatggtccaatcctctctttagatgatattacttgggctgatgacagagcttgggctccacaaactattgaaagaaatggtaaatactacttctattacccagctcataagattgatggtggtatggctgttggtgttgctattggtgactctccagttggtccattcaaagatattggcgaaccacttgtttatcaagatgattggattgatttcgatccaactgttttcattgatgatgatggtcaagcctacttatactttggtaatccacaacttagatatgttctcttaaatgaagatatggtttcttacaatgaagaagttggtattgttgatgttgaattaactgttgaaggttttggtgaaggtaataataacccaacctcttatgatgaaggaccattcttctataagagaaatggtatttattatatgttattctctggtttcagaaagggttacgaatctgaatacattggttacgctacttcaacttctccaactggtccatggaagtatggtggtattcttatggaagaacatgaagacaaaactttcactaatcactcatctattgttgaattcaatggtcacacctacttcttcttccacactggtgaccttccagatggtggtgacttccacagaagtgttgcttacatcgaatttgaatacaatgaagatggttccattaacccaattaccaa

SEQ ID NO: 14699 - DNA, 858 bp, Anaeromyces robustus; identical to SEQ ID NO: 14698
  Arabinanase/levansucrase/invertase

SEQ ID NO: 14700 - DNA, 522 bp, Piromyces finnis
  Arabinanase/levansucrase/invertase
ttcatttgatgttccaaactgtggtgatattgtttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattctt

SEQ ID NO: 14701 - DNA, 237 bp, Piromyces finnis
  Arabinanase/levansucrase/invertase
tttaaataccggtagcagttcaaacactaattctggtggagcctatttatttacttatttccttggtaatgcaccagaacaagaaagattatcctatgctgttagtacagatggttatcattttaaagctcttaataatggaaaggaagtatggaaatcaagtgtaggtactggatgtttacgtgatccatatatttttaaaggaaaggatggatattactatttattagcaacaga

SEQ ID NO: 14702 - DNA, 759 bp, Piromyces finnis
  Arabinanase/levansucrase/invertase
tggatgtttacgtgatccatatatttttaaaggaaaggatggatattactatttattagcaacagatatgaaatctgctttaggttggaatagtaatcgtaatattttaagtgcaaaatcctctgatcttattcattggacgaatgaaagtagtatagaaattgctaataagtatcctttaatgcaaggagctgatcgtgcctgggctcctcaagccatctatgatcctgaaaaagattcctacatgatttattttgctgcccgagtccctggtcgtgataaccgaaccattatgtactatgcctacagtaagaatatgcaaaaattagatacagccccacaattgttatttgctccaagtaacggtaatgatgccattgattccgatattattttccaaaacaataaatattacatgtattataaaaatgaaaccaacaaacgtatttatttagctaccgctagtcacgcaagtggtccatacagtgaaataaaacaagtttctgaaggaaatattggtgttgaaggacctaatatttatcaacttcaaggtaccaataaatggcttatgatgtctgatgcctatggtaatggctattatgttatgcaagaaaccactgatcttgtaaactttaaaactgtcaatcgtaacagttatagttttaattttactccacgtcatggttatgtcattccaattaatagttctcaatataatgctcttctttctgcctatccatcaaacggaattgctccttt

SEQ ID NO: 14703 - DNA, 717 bp, Piromyces finnis
  Arabinanase/levansucrase/invertase
tggatgtattcgtgatccatttatcttaaagggtcaagatgattattactatttattagctactgatatgaaatcttacttaggttgggacagtaaccgtaatattttaactgcaaaatcaaaggatcttattcattggaatgatgttaccagtattgaaattgctaataaatatcctttaactcaagctgctgatcgtgcctgggctccacaggctatttatgatccagaaaagaaatcttatatgatctattttgctgttagaactccaggaaatggtaataaaactattatgtactatgcctacagtaaggatatgaaaaaattagatactgctccagctcttttatttgcaccaagaaatggtaacgaagccattgattctgatattattttccaaaacaacaaatactacatgtactacaaggatgaaactaagaagaccatttgtttagctactgctgatcatgctagtggtccatatcaagaaattaagcaactttctgatcgtggtattgaagttgaaggttgtaatatttatccagttgttggtactaataaatggttaatgatgtctgatgcctatgttaatggttactttgttttacaagaaactactgatcttgtcaactttagaactcttgatcgtaaaacttatggttttaactttactccacgtcatggttatgttattccaattagcaacaatcaatacaa

SEQ ID NO: 14704 - DNA, 228 bp, Piromyces finnis
  Arabinanase/levansucrase/invertase
ttcctcaaacaacaacagtaatgttaatggtgctttccttttcgccttcttccaaggtaacgctcctgaaaaggaacaattatcctacgctcttagtactgatggttatcacttcaacattcttaactatggaagatccatttggaaatcaaatgtaggtactggatgtattcgtgatccatttatcttaaagggtcaagatgattattactatttattagctactga

SEQ ID NO: 14705 - DNA, 873 bp, Piromyces finnis
  Arabinanase/levansucrase/invertase
tccactcatcactaatatgtacactgctgatccagctccaatggtttacggtgataccctttacctttacactactcacgatgaaaacaaccttaaaaacaatttctacactatgcttgattggtacgttttctccactaaggatatggttaactggactaaccatggtaagattttctctttagatgatattagctgggctgatgacagagcttgggctccacaagctattgaaagaaacggtaaattctacctttactgtccagttcacaaaactaacggtggtatggctattgctgtcggtgtttctgacaagccaaccggtccatttaaggatattggtcatccacttgttgatgaaggtgactggaacgatattgacccaactgttttcattgatgatgatggtcaagcttacttatacttcggtaacccagaacttagatatgttcttttgaacgaagatatgatttctatcaataaatctgttggtgttaagaagattaagatgactgaagaagccttcggtaagggtagtcacgataccggtacaacttatggtgaaggtccatacttctacaagagaaacggtatttattacatggcctatgctgccttcagacaaggtaagaacattgaatctcttggttactctacttctacttctccaactggtccatggaagtacggtggtccacttatgactgaagaaggtggtgctttcactgttcacccaggtattgttgatttcaagggtcattcttacctcttctaccacactggtgaacttccaggtggtggtgacttccacagaagtgttggtttcgctgaattcagatataataaggatggttctattccagttgttccaaa

SEQ ID NO: 14706 - DNA, 384 bp, Piromyces finnis
  Arabinanase/levansucrase/invertase
ggtatctgttcacgatccatctgttgtcaaaaatggtaataaatattatattttcggttctcatatggatactgcttttactactgatttatggaagtttacaaagttatatacaggtgttaatgaaaacaataaaatgttttcaaatttattctcaaaatcaaattatggtgctttcaactttgttggtaaaaatagtgaaggtggattctcagtttgggctccagatgttatgtttaataagagaatgaataaatgggttcaatatttctgtacttcttctacatatattaaatccagtatttgttatgctttagctgataatattgaaggtccatacacttataaggattgcttcatcttctctggtatggattcaggtag

SEQ ID NO: 14707 - DNA, 564 bp, Piromyces finnis
  Arabinanase/levansucrase/invertase
aaatgccattgatccaaatgcattctacgatttcaatggtaaattatggttggcttatggttcatggtctggtggtatctatatcttagaattagatgaaagtactggtcttccaaaacataacatcaataatggaaataacatagataaatactatggtaagaagttagctggtggtaatcatcaatctattgaaggcccatacattttaccacataaagctgctggatattactatcttttcgtttcctatggtactcttacatctaacggtggttaccaaattcgtttattccgttcaaagaacccagatggtccatatactgatgctgctggtagagaatttatgagtggtactaattccaactttggtgtcaagattatgggtaattacaatattccaggaagaagccaagcttacatggctccaggtcacaattctgctttaattgatgacaatggaaaaatcttactcttctatcacactcgtttcaatgatggtcaagaatatcacgagccacgtattcatcaaatgttccttaacaaggaaggatggcttgttgc

SEQ ID NO: 14708 - DNA, 909 bp, Piromyces finnis
  Arabinanase/levansucrase/invertase
gaatcacaacccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaataaggaagttttcggtactcaaaagggttatcgtacttctcatgttgatgaaatgcc

SEQ ID NO: 14709 - DNA, 912 bp, Piromyces finnis
  Arabinanase/levansucrase/invertase
caatcacaacccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattctt

SEQ ID NO: 14710 - DNA, 909 bp, Piromyces finnis
  Arabinanase/levansucrase/invertase
taacaagaatccattaattacccacagatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaataaggaagttttcggtactcaaaagggttatcgtacttctcatgttgatgaaatgcc

SEQ ID NO: 14711 - DNA, 915 bp, Piromyces finnis
  Arabinanase/levansucrase/invertase
gaatcacaacccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattctt

SEQ ID NO: 14712 - DNA, 909 bp, Piromyces finnis; identical to SEQ ID NO: 14708
  Arabinanase/levansucrase/invertase

SEQ ID NO: 14713 - DNA, 912 bp, Piromyces finnis; identical to SEQ ID NO: 14709
  Arabinanase/levansucrase/invertase

SEQ ID NO: 14714 - DNA, 915 bp, Piromyces finnis
  Arabinanase/levansucrase/invertase
taacaagaatccattaattacccacagatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtattggtgttttaagtagtgattcaccaaccggtccatttaccgatccacttggtggaccaattatttcacgtagtcttccaaactgtaataacattgtttggttatttgatccagctgtttttgttgatgatgatggtacaggttacatttactttggaggaggtgttccagaaggacaatctagcaatccaaagacagtccgtgctgccaagttaagtgatgatatgattagaatttccggtactccacaaaccattgatgctccatgggtctttgaagattcaggtattcacaagtatggcgatacttacttctactcctactgtactaactgggataatggaccatacggtaatgccaagattgcctacatgaccagtaagagtccattaggaccattcacataccaaggtactcttttcaacaacccaggtgaattctttggtactactggtaacaatcaccacactattattgaattcaagggtaagtggtacatcttctaccacgctgaatggctcaatgtccaagtctacggaagtcaaaagggttaccgtaccactcacgttgatgaacttccattctt

SEQ ID NO: 14715 - DNA, 906 bp, Piromyces finnis
  Arabinanase/levansucrase/invertase
caatcacaacccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaataaggaagttttcggtactcaaaagggttatcgtacttctcatgttgatgaaatgcc

SEQ ID NO: 14716 - DNA, 918 bp, Piromyces finnis
  Arabinanase/levansucrase/invertase
gaatcacaacccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggataatggaccatatggtaatgctagaattgcatacatgactagtaacagtccaatgggaccattcagttacaaaggtacatgtttcaacaatccaggagatttcttccaaactactggtaataatcaccacactattattgaatttaaaaacaaatattatattttctatcacactgaatggcttaacaagcaagttttcggtagtcaaaagggttatcgtactactcatgttaatgaaatgccagttaacgg

SEQ ID NO: 14717 - DNA, 915 bp, Piromyces finnis; identical to SEQ ID NO: 14711
  Arabinanase/levansucrase/invertase

SEQ ID NO: 14718 - DNA, 915 bp, Piromyces finnis
  Arabinanase/levansucrase/invertase
gaaccacaacccacttagtactcttaaatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattctt

SEQ ID NO: 14719 - DNA, 915 bp, Piromyces finnis; identical to SEQ ID NO: 14714
  Arabinanase/levansucrase/invertase

SEQ ID NO: 14720 - DNA, 918 bp, Piromyces finnis; identical to SEQ ID NO: 14716
  Arabinanase/levansucrase/invertase

SEQ ID NO: 14721 - DNA, 327 bp, Neocallimastix californiae
  ARF/SAR SUPERFAMILY PROTEIN-RELATED
taataacaacaacaataataataataataatagcaataataataataataataataacaataacaacaataataataataataacaataataacaacaataataataataataataataactcaaaccaacaaacatatagttttggttatggtcttaaaaatgatccagttccatccaaaggttgtggtaagaacccatctcttccaaagaccggttccttcgaatttaattggtctggtggtaaacgtactgttcgtattgatattccagataactatgacaacaagaaagcctatcgtttagttttcggtatgcattgtatggg

SEQ ID NO: 14722 - DNA, 2613 bp, Neocallimastix californiae
  ARF/SAR SUPERFAMILY PROTEIN-RELATED
ttttgttgatcgtgaaagatttgatgatacaagagaagaatggaatgcttttaagattaaatgggataatgaaataagagataattttaaacaaatatcagttttttctggtgataatgaatccatgcttaattttgggtggtattctactgaagatactaaaccagttattcgttttggcactcaagaagatatgtcggatgctaaagaattcactggtaatgttgaatattataaaaacttattaattggctcacgaaagtattctatatactcaaatcaagttacagtaagtggtttagaacgtaataatacttattattaccaaagatatatagatggaaaatgggaaaaatcagttaaatttgttactcgtgatccagataattttaactttatatttgtaggtgatccacaaattggtggttcacatggtaaacctaatttcttagatatgtccaaagaacttactaacgatgaagctacaagaaatgatgcttttaattgggaacgtacaatgaataaagctttcgaattaaaaagtaataatcctccaagtcttttattatcagctggtgatcaagctgatgatgaaaaacttcaagattatttagatgaaactcaattttcagccttacttcaacctgctgtattaaagggaattccacatgctatgactgttggtaatcacgaacaatataacgaaaatttcagacatcactttaatactccaaattcttttactgaaatagaacgctctgaccgtgaagtcattcctggttttaattacttctttagatttaataatgtattagttgttgttcttgatactaatgaaccttctacttatgactattctcatactatgaaaaatgcagttacaaaatatccagatactacttggcgtattgtaatgtttcatcatgatcttttcggtattggtagaacccattcacaaggaacttatattgttaataaattaagacctattttaaacccattattagcaaagtataaagttgatcttgttattaatggtcacgatcattattattcaacatctcattttgtttcttttgacggtgttaattatgatatttcagaaatttctgaaaataaaacatttaataatcctaaaggtatcctttatattactgctaactgtgctacaggaagtaaacttaatccaagaaatgatgctaaggttgattatatttatcattcaaatcaaacttacactgctacttttggtattattgatttcgaaaaggatattgagaaacaagtaaatagaattactattaattattatgatgttgaatccctcgatgttaccgatggatcttatataatagaaaaagatcttgattatgtaagagaagaagaaccagaacctgaatgttgggctgaagaatttggatatgaatgttgtcttttcagttcaatggtttcctacgttgacgataaaggacgttattgggatttccaaaatggaaattggtgtggcgtaactaataaacctatgattattaataaaagtaaaataccttataagcctaacaaatgttggtctttagaaagaggtattcaatgttgtccatcttccattaaatctactagctatataaatgatggtgtatatggtgttgtaaatgaaaataatggaataggttttcgttactgtggtattcaacttccagtaatttcagatattgaaccaaacaataatacaccagtaagccaagaaagtacttgttgggctaatgattatggctacgattgttgtgggcctgaaatagtaaaaggtaattatattgataatgatggtatctggtatcaaaatgattcttattggtgtggattagtaacatataataaaaatgatatagaaatcgttaatgatcaatgttggccagataataaatttaaatgttgttcaccaggtactaaggttgaatacacagatgaagaagcattatggggtgttgaaaatggtaattggtgttacattactagatttacatcccctccagttactaccactccagctaccactgctccaactactactactactactactactactactactactactactactacaactacaactacaactacaactacttcatcaataaatacaccagttaattatcaatgttggccaggtgaatatgaatgttgttcaccaggtactaaggttgaatacacggatgaagaagcattatggggtgttgaaaatggtaattggtgttacattactagatttacatcccctccagtaactaccacttcaactaccaccattccaactactactactactactactactactactactactactactactactactacttcatcaataaatacaccagttaatgatcaatgttggccaggtgaatatgaatgttgttcaccaggtactaaggttgaatacacggatgaagaagcattatggggtgttgaaaatggtaattggtgttacattactagatttacatccccaccaattactactactccaactaccaccattccaactactactactactactactactactactactactactactactactactacttcatc

SEQ ID NO: 14723 - DNA, 742 bp, Neocallimastix californiae
  AT18611P-RELATED
accaacaataagatcaatagatgagatgaaacttgttttttcagatgaatttgatggtgatgagttagataaatctgtatgggatgttgaagttaattgttggggaggtggtaatggagaaaaacaatgttatgttgatcatgaggaaaatatatttgttaaagatggtcagttacatattaaggctataccaaaaggtgaatataaattaactgatgaggaaaagaaatcatgcactaataataatgagaattcatgtggatggactcaaagtgttactagtggtcgtattagaacttataagagtggtcatgcttggaagtatggtaaagttagagttaaggctaaattaccagcaggtccatatctttggccagctatatggatgttaccacaagacgatgtttatggtacatgggcagcttcaggagaaattgatatcatggaagctagaggacaagttccggatgctgtaggtcatgccattcattatggaggtcaatggccaaataatgttttttcatctgaaactgcttctgttaaagatgttatcaatgatttccatgtttatggattagattgggaagagaatttcctcatttttagtgttgatgaagtcgaatactttactgttgatcttcgtaaaagcttctattctggaaaaggaagtaatccatacaaggatattcgtcaaccatttgatgaaaaattccatcttttattgaatgttgcagtaggtgga

SEQ ID NO: 14724 - DNA, 1662 bp, Anaeromyces robustus
  AT18611P-RELATED
accaactataagatctgttgatgaaatgaaacttgttttttcagatgaatttgaaggaaatgaattagacagatctgtatgggatgttgaagttaattgttggggaggtggtaacggtgaaaaacaatgttatgttgatcatgatgaaaatatttttgtaaagaatggtcaacttcatattaaagctgttccaaaaggtcaatataaattaactgatcaagaaatgaaaacatgtactaataataatgaaaactcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtacctgatgctgtaggtcatgcaatacattttggtggtcaatggccagataatgactttatgtctgaaacagcttctattaaaaatgttattaatgatttccatgtttatggtttagattgggaagaaaacttccttatctttactgttgacgagaaaccatattataccgttgatcttcgtaagagtttttggtctggtaagggaactaatccatataaaaagattcgtcaaccatttgatgaaaaattccatcttttattaaatgttgctgttggtggtaattatttcaatggtattggtgaatttgattatggtcgtgatacaccacaatggactcgtccagaaatgattattgattatgttcgtgtctatcaattaccacgtcatgttaatgaaccagaacctattcaaactttaccaactactccaccagaagattctaaggctccatcaattccaagtatggatgattataaattagtattttcagatgaatttgaaggaaataaattagatagatctgtatgggatgttgaagttaattgttggggaggtggtaacggtgaaaaacaatgttatgttgatcatgatgaaaatatttttgtaaagaatggtcaacttcatattaaagctgttccaaaaggtcaatataaattaactgatcaagaaatgaaaacatgtactaataataatgaagattcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtatcaaatgctattggaaatgctattcattttggtggtcaatggccaaataatgattttgtagataaaacatacaacctttctaatattattaatgatttccatgtctatggattagattgggaagaagattatttattattctcagtagatgaagaagtcactttctttgttgatcttcgtagaagtttctggtctggtaagggtaataatccatataaaaagattcgtcaaccatttgatgaaaaattccatcttttattaaatgttgctgttggtggtaattatttcaa

SEQ ID NO: 14725 - DNA, 51 bp, Neocallimastix californiae
  B_KETOACYL_SYNTHASE
tccttcctacaccatcgataccgcctgttctacaggttcctctgcccttca

SEQ ID NO: 14726 - DNA, 51 bp, Neocallimastix californiae
  B_KETOACYL_SYNTHASE
tccatccatttgtactaatactgcttgctcagcttcaatgaccgccttaaa

SEQ ID NO: 14727 - DNA, 51 bp, Neocallimastix californiae
  B_KETOACYL_SYNTHASE
tccaattcgtaccccagttggtgcctgtgcctctgccgttgaatctgttga

SEQ ID NO: 14728 - DNA, 51 bp, Neocallimastix californiae
  B_KETOACYL_SYNTHASE
tccatctttcactatcgatacggcctgctctactggttcttctgcacttca

SEQ ID NO: 14729 - DNA, 51 bp, Neocallimastix californiae
  B_KETOACYL_SYNTHASE
tccaattaagacaccagttggtgcttgtgctactgccgttgaatctgttga

SEQ ID NO: 14730 - DNA, 51 bp, Neocallimastix californiae
  B_KETOACYL_SYNTHASE
accttcctttactatcgatactgcttgttctacaggtgcttctgccctcca

SEQ ID NO: 14731 - DNA, 51 bp, Neocallimastix californiae
  B_KETOACYL_SYNTHASE
tccatcgctttccactaataccgcttgttcctcttccatgaccgccttatc

SEQ ID NO: 14732 - DNA, 51 bp, Neocallimastix californiae
  B_KETOACYL_SYNTHASE
tccttcagtgacagtggatactgcttgttccactggtgccaccgcccttca

SEQ ID NO: 14733 - DNA, 51 bp, Neocallimastix californiae
  B_KETOACYL_SYNTHASE
tccatccttcactatggatactgcttgttcaactggtgcttctgctcttca

SEQ ID NO: 14734 - DNA, 51 bp, Neocallimastix californiae
  B_KETOACYL_SYNTHASE
tccaattaagactccagtcggtgcctgtgctactgctgttgaatctgttga

SEQ ID NO: 14735 - DNA, 51 bp, Neocallimastix californiae
  B_KETOACYL_SYNTHASE
accagccatttctatggatactgcatgctcaacaggagctaccgcactaca

SEQ ID NO: 14736 - DNA, 51 bp, Neocallimastix californiae; identical to SEQ ID NO: 14735
  B_KETOACYL_SYNTHASE

SEQ ID NO: 14737 - DNA, 51 bp, Neocallimastix californiae
  B_KETOACYL_SYNTHASE
cccagcaatttccatagatacagcatgttcaacaggagctacagcattgca

SEQ ID NO: 14738 - DNA, 51 bp, Neocallimastix californiae
  B_KETOACYL_SYNTHASE
tccatccttcaccattgataccgcttgttccacaggttcttctgctcttca

SEQ ID NO: 14739 - DNA, 51 bp, Anaeromyces robustus
  B_KETOACYL_SYNTHASE
tccaattcgtactccagttggtgcttgtgcctctgctgttgaatctgttga

SEQ ID NO: 14740 - DNA, 51 bp, Anaeromyces robustus
  B_KETOACYL_SYNTHASE
accttctttcacgattgataccgcttgttctactggtgcttctgctttaca

SEQ ID NO: 14741 - DNA, 51 bp, Anaeromyces robustus
  B_KETOACYL_SYNTHASE
accttctttcactattgataccgcttgttccactggtgcttctgctttaca

SEQ ID NO: 14742 - DNA, 51 bp, Anaeromyces robustus
  B_KETOACYL_SYNTHASE
tccatcattaactatggatactgcctgttctactggtggatcagctattca

SEQ ID NO: 14743 - DNA, 51 bp, Anaeromyces robustus
  B_KETOACYL_SYNTHASE
tccatctgatactattgataccgcttgttcaagtggtttaaatgatgttaa

SEQ ID NO: 14744 - DNA, 51 bp, Anaeromyces robustus
  B_KETOACYL_SYNTHASE
tccaatcaagactccagttggtgcttgtgctactgctgtagaatctgtaga

SEQ ID NO: 14745 - DNA, 51 bp, Anaeromyces robustus
  B_KETOACYL_SYNTHASE
tccatcttatactatggatacggcttgttctacaggtgcttcagctattca

SEQ ID NO: 14746 - DNA, 51 bp, Anaeromyces robustus
  B_KETOACYL_SYNTHASE
acctgctatatcgattgatacagcatgttctacaggagcaacagcagtaca

SEQ ID NO: 14747 - DNA, 51 bp, Piromyces finnis
  B_KETOACYL_SYNTHASE
accttcatatactattgatactgcatgttctaccggtagttctgcactcca

SEQ ID NO: 14748 - DNA, 51 bp, Piromyces finnis
  B_KETOACYL_SYNTHASE
cccttctttcacaattgatactgcttgctcaacaggtgctaccgcacttca

SEQ ID NO: 14749 - DNA, 51 bp, Piromyces finnis
  B_KETOACYL_SYNTHASE
tccatctgataccgttgatactgcttgttccagtggtttaaatgatgtcaa

SEQ ID NO: 14750 - DNA, 51 bp, Piromyces finnis
  B_KETOACYL_SYNTHASE
tccatcattatccaccaataccgcttgctcttcttcattgactgctttatc

SEQ ID NO: 14751 - DNA, 51 bp, Piromyces finnis
  B_KETOACYL_SYNTHASE
tccaattaagactccagttggtgcttgtgctactgctgtcgaatctgttga

SEQ ID NO: 14752 - DNA, 51 bp, Piromyces finnis; identical to SEQ ID NO: 14751
  B_KETOACYL_SYNTHASE

SEQ ID NO: 14753 - DNA, 51 bp, Piromyces finnis; identical to SEQ ID NO: 14751
  B_KETOACYL_SYNTHASE

SEQ ID NO: 14754 - DNA, 51 bp, Piromyces finnis; identical to SEQ ID NO: 14751
  B_KETOACYL_SYNTHASE

SEQ ID NO: 14755 - DNA, 51 bp, Piromyces finnis
  B_KETOACYL_SYNTHASE
tccatctatttgtactaacactgcatgctctgcttctatgactgccttaaa

SEQ ID NO: 14756 - DNA, 51 bp, Piromyces finnis
  B_KETOACYL_SYNTHASE
tccatctgttactgttgatacagcttgttccactggtgcaacagctcttca

SEQ ID NO: 14757 - DNA, 624 bp, Neocallimastix californiae
  Barwin-like endoglucanases
tggtaagactactcgttactgggattgttgtcttgcatcatgttcatggcaagaaaacactaagaaagctggagctagtggtgttgttagatcatgtagcaaagatggtatgactccatttactgatctttctaatctctggagagttaagagtggatgtgaaggtggttctgtctacatgtgtaatgaccaacaaccatgggctgttaacgacaacgttgcttatggttttgttgcttctcacgaaaagtgttgtacttgtcaacgtcttaagttcacttctggtccagttgctggtaagcaaatgattgtccaaactaccaacaccggtggtgatctttcttccaaccacttcgatattcaaatgccaggtggtggtttcggtatctttgatggatgtacctcacaattcggaggaggtcacaactggggtgaacgttatggtggtattaagagtgcttctgaatgtgctaaccttccatctgtcttaaagcaaggttgtgaatggagattcaactggttcaagaatgctgataacccaaatgttgtttttgaacgtgtccaatgtccaaaggaacttactgacattactggttgtgttccaaatgatgattcctctgttaa

SEQ ID NO: 14758 - DNA, 72 bp, Neocallimastix californiae
  Barwin-like endoglucanases
atggaaatactctagatctactcactatggtttaacttatgctggtgcttgtgcttttggtgtttacggttt

SEQ ID NO: 14759 - DNA, 492 bp, Neocallimastix californiae
  Barwin-like endoglucanases
agttgatactaagctttctcttagaggtaatttcattgctccaaatggtaactactacactcaattctggccatctctccaaggtgattatgataactatctttcttgtggtgaatgttatgaattagaaattactcaagaagatggttctctttatccagaagataatagacgttctgaaaacattattgctcaaattgttgattcctgtccatgttccgctaatgctaagtggtgttgtggttcaggtattgatcactgtaatgaaattgactttaagtatggttgtccaattccagaaggtagtgtacactttgatttatctgatattgctatggctcgtttacaaactaatgatccaaatggtggtatggttgaaggtgttattccaattcgttacaagcgtgttccatgtccagttaaaggtaatatctatattagaattcttccaggtgctaaccaatggtatttcgctattaatgtagttaatgt

SEQ ID NO: 14760 - DNA, 633 bp, Neocallimastix californiae
  Barwin-like endoglucanases
atggaaatactccagatctactcacttcggtttaacctatggtggtgcttgtggtttcggtttatacggtttatgtactactaaattcaacgaaactggtgaactttgtgttagattctgtgaacattacccagatctttgtaaggatccagatgatatcactttaagaggtaatttctgtgctccaaatggtaattactacactcaattctggtcttctcttccaggtgattatgataactatctttcttgtggtgaatgttatgaagttgaaagaactttaccagatggttcatcttacccagctggagaaggtactgatcatattcttttacaagttgttgattcctgtccatgtaccgctaatgctaagtggtgttgtggttccggagttgatcactgtaatgaaattgatttcaagtatggttgtccaattccagaaggtagctggcacgttgatttatccgatattgctatgtctcgtttacaaaccaatgatccatatggtgttatggttgatggtgttattcctattaagtatagacgtgttccatgtccagttaagggtaacattcatgtctggttacgtccaggtgctggtccatggtactttgctcttaccgttgtcaatgt

SEQ ID NO: 14761 - DNA, 462 bp, Neocallimastix californiae
  Barwin-like endoglucanases
ttcagcatttgcttggaaatgggctaaagaaggtatcgccagtatgacttggtatactgatttctctcatgaaaatttagcttgtaattgtgttccaaatgcaatggttgttggaccaactgttgctttagctgaagttgcttatggtgcttttgatcattttggcagtggtccagcatgtggtttatgttatcgtttatcaccatacgctactgctgatggtactccactctctccaatcccagaaccaattgtcttcagggttactgatgaatgtccacatcaatctaacgctgaatggtgtccaggacccgaaggtggtaaaaatgctcatggttttgaagatcactttgatgttaacattgatagttggggtggtaaattaagagattggttccaaggtggtcacatgcaagctaaatatgaattagtttcatgtgaagaatggccaggttggtccga

SEQ ID NO: 14762 - DNA, 609 bp, Neocallimastix californiae
  Barwin-like endoglucanases
gggtaccactaccagatactgggattgttgtaaaccatcatgtgcttggccaggtaaattcgaatacaagactaatattaaattatgtgctgccgatggaagtgcacttctcgataataatttaatttctggatgtgaaggtggcccaacttatacttgtgaagatcaaactccatgggctgttgatgacgttactgcttatggttatgctgccgctaacattccaggtttaactgaagctgattggtgttgtacttgttatgctttaactttcacttccttcccaattaagggtaagcaaatgattgttcaaattacaaacactggtggtgatttaggtgaaggtcacttcgatcttcaaattccaggtggtggttttggtttattcaatggttgttctccaagatacccagatattccagatgaagactggggtgaccgtaatggtggtgttacttctcgtgaaggttgttacaagttaccagtaagtatgcaagaaggttgtctcttcaaatttgactggttcagaggagctgataatccagaagttacttatgttaaggttgactgtcctcaagaattaattgatgtcagtggatgtactcgtat

SEQ ID NO: 14763 - DNA, 609 bp, Neocallimastix californiae
  Barwin-like endoglucanases
aggtactaccactcgttactgggattgctgtaagccatcttgttcatggccagacaaggcaccagtttctgctccagttagacaatgtaaggctgatggttttaccgctcttaccaactataatgctaagtctggttgtgaaggtggtgaatcttacatgtgttctgaccaaagaccatgggctgtttctgaagttttatcatatggttatgctgctgcttctatcaaaggtttaaccgaaaaggaatggtgttgtcgttgttatgccttaactttcacctctggtccagttaaaggtaagcaaatggttgtccaagttactaacactggtggtgatcttggtgataatcactttgatattcaaattccaggtggtggtttcggtattttcaatggttgttctgcacaatttaatactcctgatgaagtttggggtactcgttacggtggtgtcgctagccgtgatgattgtgaaggtcttccagaagctattaaagagtcttgctactggagattcgactggttcctcaatgctgataacccaactatggtctttgatgaagttgaatgtccagttgaattaactagaaataccgactgtattcacaa

SEQ ID NO: 14764 - DNA, 480 bp, Neocallimastix californiae
  Barwin-like endoglucanases
ttctggtgaagccagtatgactcactacgaattaaatggtggtggtggttcttgtaatgttagtgctatgggtaacgccgctggtccaactgctgccattagtggtttatcttatggatcatggagtggtttaggtggtggtcctgcttgtggtctttgttacgctctaactgtatatggtagttatgatggtcaagctgatccagctttattcccgaagtgttctattgttgttcgtattaccgatcaatgtccatacccagataataaggaatggtgtccaggtccagaacaaccagaatctgagggtttcttaaatccacgtggtatgagatatcactttgatgttaatatttctagtggtcaaggtgaagctcgtgaatggttcccacgtgatgcctctggaaaccttttaggtactggtaaggtttacttcgaaatggtttcatgtagagaatggagtggttggaaatatggtgc

SEQ ID NO: 14765 - DNA, 633 bp, Neocallimastix californiae
  Barwin-like endoglucanases
aggtgttaccactcgttactatgattgttgtaaaccatcttgttcatggccaggtaaggctgatgtcttccatccagtaagacattgtactgttgatggtactactcttattgaagatcaagaagctccatctgcttgtcaaaaggatgttgttggtactgctcatatgtgtgaaaaccaacaaccatgggctgtaagtgactcactttcatacggttttgctgctgctgctttaccaggtggtgaatctgtttcctgctgtaaatgctatgctttaactttcattgatccaccaattcgtggtaagcaattagttgttcaagttactaacactggtgctgatgtcggttctaaccaattcgatcttcaaattccaggtggtggtgtcggtattttcgatgcttgcactaacatgtatggtttacctgctggttcaaatggttggggtaaacaatatggtggtattactggtattgaagattgtgaaaccttcccagaatccttaaaggaaggttgtaaatggagattcaactggttattaggagctgataacccaagaatgaaatttgccgaagttgattgtccaaaagaacttactgatattactggttgtattagaaaagacgctaagca

SEQ ID NO: 14766 - DNA, 495 bp, Neocallimastix californiae
  Barwin-like endoglucanases
agatccagctggtcgtacttatcgtggtaactttgctgctccacaaggtaactactacactcaattctggggtgccttagaaggtgatcaagataactacttgtcttgtggtgaatgctttgaagtttacaagactaagccagatggttctgattacaaaccaggagaagatggttaccaaccaccagttcttctttctgttattgattcctgtccatgtaatgctaatggtaaatggtgttgtggttctgaatgggatcaatgtcaagaaattgacttcaagtatggttgtccagttccaaaggatagtattcaccttgatctttcagatattgctatggctcgtcttcaatctggttcttccaacggacatatggaagctggtgttattccaaacaaatacagaagagttccatgtccaagattaggtaacatgtacatttggcttcgtaaagatgctggtccatactggttcgctttctctgttgttaactc

SEQ ID NO: 14767 - DNA, 75 bp, Neocallimastix californiae
  Barwin-like endoglucanases
attccattattctcgttctactcactttggtttaaccttcggtggtgcttgtggttttggtttatatcaagtttg

SEQ ID NO: 14768 - DNA, 321 bp, Neocallimastix californiae
  Barwin-like endoglucanases
atatactggtgatggtaccacttatggtgatccacttacaggaggttattgtatgatgccagattctgaagcttacacgaaagatatgatgtttgctgctatgaatttaccacaatataatatttctgctggatgcggaagttgtcttattttagctcaagctgataaaccagaaagagttatcagagttcgtgttgtagatcgttgtggtgaatgtccaaagggtgatattgatcttagtaataccgcttggaaagctttaactggtgattttattccaggtcgtgtaaagattatatggagtattgttccatgtaccga

SEQ ID NO: 14769 - DNA, 480 bp, Neocallimastix californiae
  Barwin-like endoglucanases
ttctggtgaagctagtatgactcactacgaattaaacggtggtggtggttcctgtaatgttagtgctatgggtaatgctgctggtccaactgctgctattagtggtttatcttatggttcatggagtggtttaggtggtggtccagcttgtggtctttgctacgccttaactgtttatggtagttatgatggtcaagctgatccagctttattcccaaaatgttcacttgttgttcgtgttactgatcaatgtccatatccagataataaggaatggtgtccaggtccagaacaaccagaatctgagggattcttaaatccacgtggtatgagataccacttcgatattaatatttctagtggtcaaggtgaagctcgtgaatggttcccacgtgatgcctctggtaaccttttaggtactggtaaggtttactttgaaatggtttcatgtagagaatggagtggttggaaatatggtgc

SEQ ID NO: 14770 - DNA, 622 bp, Neocallimastix californiae
  Barwin-like endoglucanases
gggtgttacaactcgttactacgattgttgtaaaccatcttgttcatggccaggtaaggctgacgttactcaaccagtcagacaatgtgctgtcgatggtaaaactcttttaactgatttcagtgctccatccgcttgtcaaactgatgttgaaggtatttctcacatgtgtgaagatcaacaaccatgggctgttagtgatgtcttatcttacggttttgccgctgctgctttaccaggtggtgaatctaaatcttgctgtgcttgttatgctattaccttcagtgaaccaccaattagaggtaagcaaattgttgtccaagttactaataccggttctgatgttggttccaaccaatttgatcttcaaattccaggtggtggtgttggtatttttgatgcttgtaccaacatgtacggtttaccagctggttctaatggttggggtaagaaatatggtggtatttccagtatcgaagactgtgattccttcccagaagctttacaagctggttgtcgttggagattcgaattcttattaggtgctgataatccaaagatgacctttgttgaagttgaatgtccaaaggttcttactgatattactggttgtatccgtaaa

SEQ ID NO: 14771 - DNA, 507 bp, Neocallimastix californiae
  Barwin-like endoglucanases
gaagggaaaagcttcagttactagatatggtagtatgggtattttatcttgtaactgtaagatttcagctatggaagtcggtccagcctgtgctattaacgaaaatgcttatggtggttatgatggtttaggttctggtgtagcttgtggtatgtgctacaagttaactccatatggtacttccgaaaccgatcaatggccaaaatctgaagctgatcttccaggaccaatggtcttcaaggttactgatatttgtccatataatgctaatccagcttggtgtccaagtcaagaatctgctccaaagaacagtgttggtatggaataccactttgatattaatgttgattcatggcaaccagaaacccttcttaaatggtttgctaatggtactttaggtacaatgaatgttgaattcgaattagtttcttgtgaagaatggattggttggtctaagaagggtaaattcgaaggtcttggtgataatccatggtggggttgttgtcc

SEQ ID NO: 14772 - DNA, 603 bp, Neocallimastix californiae
  Barwin-like endoglucanases
taagactacacgttactgggattgttgcaaaccttcatgtgcttggaactataaagccaacgtaagtaaggaagttaattcctgttacagggatggttccattgtatctattccatggattacaagtggttgtggaggtggtgatgccttcatgtgtaacgatcaacaaccatgggctattaatgataagttatcctatggttttgctgctgctaatatttctggtagtgatgaagaacattggtgttgtgcttgtttcaaaattacatttactagtacttcaattgcaggtaaggaaatgattgttcaagttacaaatactggtggtgatcttggtgaaaatcatttcgatattcaaatgccaggtggtggtcttggtcttttcgatggttgttccccacaatttggtgttgatgcatctaaatggggtgaacgttatggtggacttacttctgaagctggctgtgataatttaccaaaagttcttcaaccaggttgtcactggagattcggttggtttgaaaacgctgataatccagctatggaatttgaagaagttgaatgtccagctgaattaattaagattactggttgtgctcgtct

SEQ ID NO: 14773 - DNA, 393 bp, Neocallimastix californiae
  Barwin-like endoglucanases
atcttgtggtgaatgttttgaagtttacaagactaagccagatggttctgactacaaaccaggagaagatggttaccaaccaccagttcttctttctgttattgattcctgtccatgtaatgctaatggtaaatggtgttgtggttccgaatgggatcaatgtcaagaaattgacttcaagtatggttgtccagttccaaaggacagtattcaccttgatctttctgatattgctatggctcgtcttcaatccggttcttccaacggtcatatggaagctggtgttattccaaacaaatacagaagagttccatgtccaaagttaggtaatatgtacatctggcttcgtgaagatgctggtccatactggttcgccttctctgtcgttaactc

SEQ ID NO: 14774 - DNA, 159 bp, Neocallimastix californiae
  Barwin-like endoglucanases
attccattactcccgttccactcactttggtttaacctttggtggtgcttgtggttttggtttataccaagtttgtggttcagatcacaactacactggtgaatttgctaccctttgtgatgctttctgtaaagcttatccaactttatgtaaggatcc

SEQ ID NO: 14775 - DNA, 633 bp, Neocallimastix californiae
  Barwin-like endoglucanases
aggtgttactactcgttactacgattgttgtaagccatcttgttcatggccaggtaaggctgatgttttccatccagtaagacactgtaaagttgatggtactactcttattgaagatcaagaagctccatctgcttgtcaaaaggatgttgttggtactgctcatatgtgtgaaaatcaacaaccatgggctgtaagtgactctctttcatatggtttcgctgctgctgctttaccaggtggtgaatctgtttcctgttgtaaatgttatgctttaacattcactgatccaccaattcgtggtaaacaattagttgttcaagttactaacactggttctgatgttggttctaatcaatttgatcttcagattccaggtggtggtgtcggtattttcgatgcttgtactaatatgtatggtttaccagctggttcaaatggctggggtaaacaatatggtggtattactggtattgaagattgtgaatccttcccagaatccttaaaggaaggatgtaaatggagattcaactggttattaggagctgataatccaaaaatgaaattcgctgaagttgaatgtccaaaagtacttactgatattaccggctgtattagaaaagacgctaaaca

SEQ ID NO: 14776 - DNA, 633 bp, Neocallimastix californiae
  Barwin-like endoglucanases
atggaaatactctagatctactcacttcggtttaacctatggtggtgcatgtggtttcggtttatacggtttatgtactactaaatttaatgaaactggtgaactttgtgttagattctgtgaacactacccagatctttgtaaggatccagatgatattactttaagaggtaacttctgtgctccaaacggtaactactacactcaattctggtcttctcttccaggtgactatgataactatctttcctgtggtgaatgttacgaagttgaaagaactttaccagatggttcttcttacccagctggtgaaggtactgatcatattattttacaagttgttgattcctgtccatgtactgctaatgctaagtggtgctgtggatccggtgttgatcactgtaacgaaattgatttcaagtatggttgtccaatcccagaaggtagttggcacgttgatttatcagatattgccatgtctcgtttacaaacaaatgatccatatggggttatggttgatggtgttattccaattaagtacaagcgtgtcccatgtccagtgaagggtaacattcacgtttggttacgtccaggtgccggtccatggtactttgctcttactgttgtcaatgt

SEQ ID NO: 14777 - DNA, 633 bp, Neocallimastix californiae
  Barwin-like endoglucanases
tggtaagaccactcgttattgggattgttgtcttgcttcttgttcttggtccgaaaacactaatgcttctcacccagtaaatgcctgtcaaaaggatggtaaaactgttttcaacaagttcgattggactattggtagtgcttgctctggtggtcaaggttatatgtgtactgacaatcaaccatgggctattaatgacaacgtttcatatggttttgttgccgctggtttcagtagcggtagtcaaaaggattggtgttgtacttgtcaaagacttgaattcacttcaggtccagttgctggtaagcaaatggttgtccaaattactaacactggtggtgatctttctaacaatcatttcgatattcaaatgccaggtggtggtgttggtatctttaatggatgtcaatctcaattcggagctccaagtgatggttggggtgaacgttatggtggtgttaagtctgcttctgactgtagtagtcttccagccgaattacaagatggttgtaagtggagattcgattggttcaagaatgctgataatccatccgttactttcgaacgtgttcaatgtccaaaagaacttactgatattaccggctgtattccagttgatgatgctagtgctaa

SEQ ID NO: 14778 - DNA, 609 bp, Neocallimastix californiae
  Barwin-like endoglucanases
aggtactactactcgttactgggattgttgtaagccatcttgttcatggccagacaaagcacctgtttctgctccagtcagacaatgtaaggctgatggtttcactgctcttacaaactacaatgctaaatctggttgtgaaggtggtgaatcttacatgtgttcagaccaaagaccatgggctgtttctgaagttttatcctatggttatgccgctgcctctatcaagggtttaaccgaaaaggaatggtgttgtcgttgttacgctttaaccttcacttctggtccagttaagggtaagcaaatggttgtccaagttactaacactggtggtgatcttggtgataatcactttgatattcaaattccaggtggtggtttcggtatcttcaacggttgttccgctcaattcaatactccagatgaagtttggggtactcgttacggtggtgttgccagtcgtgatgattgtgaaggacttccaaaagaaattcaagaatcttgttactggagattcgattggttccttaacgctgataacccaaccatggtcttcgatgaagtagaatgtccagctgaattaactaagaatactgactgtattcacca

SEQ ID NO: 14779 - DNA, 633 bp, Neocallimastix californiae
  Barwin-like endoglucanases
tggtaagacaactcgttactgggattgttgtcttgcttcttgttcatggagtgaaaataccaatgctaaacatccagttaatgcttgtcaaaaggatggtaagaccgttattaataacttcagttatttaattggtagtgcttgttctggtggtagtggttacatgtgtagtaataatcaaccatgggctattaacgacaacgtttcctatggtttcgttgctgctggtttcagtagtggtagtcaaaaggattggtgttgtacttgtcaaagacttgaattcacttctggtccaattgctggtaaacaaatggttgtccaaattactaacactggtggtgatctttctaataatcactttgatattcaaatgccaggtggtggtgttggtatcttcaatggttgttcttctcaatttggtgctccaaatgatggttggggagaacgttatggtggtgtcaagtcagctgctgactgtagccaacttccaactgaattacaagaaggttgtaaatggagatttaactggttcaaaaatgctgataatccatccgttacttttgaacgtgttcaatgtccaaaagaacttactgatattactggttgtgttccagctgatgatgccagtgctaa

SEQ ID NO: 14780 - DNA, 495 bp, Neocallimastix californiae
  Barwin-like endoglucanases
ggatccagaaggttatacctatcgtggtaactttgctgccccacaaggtaactactacacccaattctggggttctttagaaggagatcaagataactatttatcctgtggtgaatgttttgaagtttataaaaccaaacccgatggttcagactatcaaccaggagaagaaggatatcaaccaccagttcttctttcagtcattgattcatgtccatgtaatgcgaatggtaaatggtgttgtggttctgaatgggatcaatgtcaagaaattgatttcaagtatggttgtccagttccaaaagacagtattcaccttgatctttccgatattgctatggcacgtcttcaatcgggttcatccaacggtcatatggaagctggtgtcattccaaataagtacagaagagtaccatgtcccagattaggtaacatgtacatctggcttcgtgaagatgccggtccatactggtttgctttctctgtggtgaatag

SEQ ID NO: 14781 - DNA, 72 bp, Neocallimastix californiae
  Barwin-like endoglucanases
attccattattcacgttccactcactttggtttaactttcggtggtgcatgtggttttggtttataccaagt

SEQ ID NO: 14782 - DNA, 417 bp, Neocallimastix californiae
  Barwin-like endoglucanases
gacttggtatactgattattcacatgaaaatttagcttgtaattgtgttccaaatgcaatggttgttggtccaactgttgctttagccgaagttgcttatggtgcttttgatcatttcggaagtggtccagcatgtggtttatgttatcgtttatctccatatgcaactgctgatggaactccactttctcctatccctgaaccaattgtcttcagagttactgatgaatgtccacatcagtccaatactgaatggtgtccaggaccagaaggtggtaaaaacgctcacggttttgaagatcactttgatgtaaacattgatagttggggtggtaaattaagagattggttccaaggtggtcatatgcaagctaaatatgaattagtttcatgtgaagaatggccaggatggtccga

SEQ ID NO: 14783 - DNA, 498 bp, Neocallimastix californiae
  Barwin-like endoglucanases
agatcccgaaggtcttacctaccgtggtaattttgctgcaccacaaggtaattactacacccaattttggggtatattagaaggagatcaagataactatttatcatgtggtgaatgttttgaagtatataaaacaaaagaagatggtactgattacaaaccaggagaagaaggttacacacctccagttcttctttcggttattgattcatgtccatgtagtgccaatggtaaatggtgttgtggttcagaatgggatcaatgtcaagaagttaacaactttaaatacggttgtccagtacccaaggatagtattcaccttgatctttctgatgttgctatggcacgtcttcaatctggtactcccgatggacatatgccagcaggtgttattccaaacaagtaccgtagagtaccatgcccaagattaggtaatatgtacatttggcttcgtcaaaatgcctcaccttactggttctcctttactgtagttaattc

SEQ ID NO: 14784 - DNA, 72 bp, Neocallimastix californiae
  Barwin-like endoglucanases
ccattattcacgttccacccactttggtattaccgttgctggtgcttgtggtttcggtttatatcaagtttg

SEQ ID NO: 14785 - DNA, 612 bp, Neocallimastix californiae
  Barwin-like endoglucanases
tggtactactacaggttactgggattgttgtgttgcttcctgttcatgggatggtaatgttgaaggaagtaagcctgttaaagcatgtaagaaggatggtgtctccttaattactgaggaactttggaaggtaaaaagtgtctgtgataatgaaggagatggatatatgtgtaatgataatcaacccattgtcataaatgataatcttgcccttggttttgctgcttctcatgaaaagtgttgttcctgtcaactcttacaatttacttcaagtaatgtaaagggtaaaaaaatgattgttcaagtcactaacactggttcagatattggtagtaatcactttgatcttcaaattcctggtgctggtgtcggtatcttcaacggttgtagtaagcaatggggtgctccaggcgatggttggggtagacgttatggtggtgtcactacaaaagccgaatgtagtcaacttccagctcaattaagagccggttgtgaatggagatttggatggtttgccagttctgataatccaggtgttgtctatgaacgtgttcaatgtccaaaacaacttactgatatcaccggttgtgttcttccagatgatgctcaaca

SEQ ID NO: 14786 - DNA, 507 bp, Neocallimastix californiae
  Barwin-like endoglucanases
aaagggaaaggcttctgttactagatatggtagtatgggtattttatcttgtaactgtaagatttcagctatggaagtcggtccagcttgtgctattaatgaaaatgcttatggtggttatgatggtttaggttctggtgttgcctgtggtatgtgctacaaattaactccatatggtacttctgaaacagatcaatggccaaaatctgaagctgatcttccaggaccaatggttttcaaggttacagatatttgtccatataatgctaatccagcttggtgtccaagtcaagaatcagctccaaagaacagtgttggtatggaataccactttgatattaatgttgactcatggcaaccagaaacacttattaaatggttcggtaatggtagtttaggtactatgaatgttgattttgaattagtttcctgtgaagaatggattggttggtctaagaagggtcaattcgaaggtcttggtgataatccatggtggggttgttgtcc

SEQ ID NO: 14787 - DNA, 609 bp, Neocallimastix californiae
  Barwin-like endoglucanases
gggtactactaccagatattgggattgttgtaaaccatcttgtgcctggccaggtaaatttgaatacaagaccaatattaaattatgtgctgctgatggtagcccacttctcgataataatttaatttctggttgtgaaggtggaccaacttatacttgtgaagatcaaactccatgggctgttgatgatgttactgcttatggttatgctgccgcaaacattccaggtttaacagaagctgattggtgttgtacttgttatgctttaactttcacttccttcccaattaagggtaaacaaatgattgttcaaattactaacactggtggtgatttaggtgatggtcactttgatcttcaaattccaggtggtggttttggtttatttaatggttgttccccaagatatccagatattccagatgaagactggggtgatcgtaatggtggtgttatatctcgtgaaggttgttataaattaccaaaaagtatgcaagaaggttgtctcttcaaatttgactggttcagaggagctgataatcctgatgttacttatgttaaggttgattgtccacaagaattacttgatgtaagtggatgtacccgtat

SEQ ID NO: 14788 - DNA, 318 bp, Neocallimastix californiae
  Barwin-like endoglucanases
ttacagtggtgatggtacagcttatggagatgccacttcaggtggtaattgtttattcccaaagaaggaatactataatgatatgatgtacgctgctctcaacaataaacaatacaatacagatatgggttgtggtctctgtgcagtagtagtttcaactagtaacccatacaaaccaattagagtacgtattattgatcaatgtccagaatgtgctcacggaagtttagatttcagtgataaggcttttaaggccctttcaaacaaaactccggatcgtattaagattacttgggctcttattccttgtgatgtcga

SEQ ID NO: 14789 - DNA, 606 bp, Neocallimastix californiae
  Barwin-like endoglucanases
tggaaaaactacgggttactgggattgctgtgttgcttcctgttcatgggatgctaatgttcctggagctaagccagttagagcttgtagaaagaatggtgtcagcttaattactgaagaactttggaaagttaagagtgtctgtgataatggagaaggctacatgtgtaataataatcaacctattgttatcaatgataagcttgcctacggtttcgctgcttcacatgaaaagtgttgtacctgtcagagacttcaattcacttccggtaatgtgaagggtaaacaaatgattgttcaaattacgaatactggttctgatcttggtagtaatcactttgatcttcaaattccaggtgctggtgttggtattttcaatggttgtactaaacaatggggagctccaaatgatggttggggcagacgttatggtggagtcacctcgaaatcccaatgtagtcaacttccatctcaattaagagcaggttgtgaatggagatttggatggtttgaaggatcagataatccagatgtcgtctttgaacgtgttcgttgtccaaaagctctcactgatattactggttgtattcttccagatgaatctca

SEQ ID NO: 14790 - DNA, 633 bp, Neocallimastix californiae
  Barwin-like endoglucanases
tggtaagactactcgttactgggattgttgtcttgcttcctgttcatggagtgaaaatgttggtgcctctcacccagttaatgcctgtaaaaaggatggtactactcttattactgatatttccaacttatggagaattaagagtggttgtcaaggtggtgaagcttacatgtgtaatgctcaacaaccatggattattaatgataaggtttcttacggtttcgttgctgccggttttgacagtggtaaccaaaagcaatggtgttgttcctgtcaaaaacttcaattcacttctggtccagttgctggtaagcaaatgattgttcaagttactaacactggtactgatctttctgaaaaccactttgatattcaaatgccaggtggtggtgttggtattttcaacggttgttcttctcaatggaatgctggttctgatggttggggtcaacgtttcggtggtatttcctccgtttctgaatgttctcaacttccagctgaattaagagatggttgtaaatggagattcgattggttcaagaacgctgataatccagctgttgtttttgaacgtgttcaatgtccaaaggaacttactgacattactggttgtattccaccagatgatgctca

SEQ ID NO: 14791 - DNA, 72 bp, Neocallimastix californiae
  Barwin-like endoglucanases
ctggcattattctagatctacacactatggtttaacctatgctggtgcctgtgctttcggtgtttatggttt

SEQ ID NO: 14792 - DNA, 492 bp, Neocallimastix californiae
  Barwin-like endoglucanases
agttgatactaaactttctcttagaggtaacttcattgctccaaacggtaactactacactcaattctggtcttctcttccaggagattatgataattatctttcttgtggtgaatgttatgaattagaaattacccaagaagatggttctctttatccagaaaaacaaagacgttctgaaaacattattgcccaaattgtagattcctgtccatgttctgccaatgctaaatggtgttgtggatcaggtattgaccattgtaatgaaattgactttaaatatggttgtccaatcccagaagatagtgtacactttgatttatctgatattgctatggctcgtttacaaaccaatgatccaaacggaggaatggttgaaggtgttattccaattcgttacaaacgtgttccatgtccagttaaaggtaacatttatattagaattcttccaggtgctaaccaatggtatttcgctatcaatgttgttaacgt

SEQ ID NO: 14793 - DNA, 633 bp, Neocallimastix californiae
  Barwin-like endoglucanases
atggaaatactccagatctactcactttggtttaacttacggtggtgcttgtggtttcggtttatacggtttatgtactactaagtacaacgaaactggtgctctttgtcaaaagttctgtaagaactacccagatctttgtaaggatccagataacatctctttaagaggtaacttctgtgctccaaacggtaactattacactcaattctggtcttctcttccaggagattatgataactacctttcctgtggtgaatgttatgaagttgaaagaactcaaccagatggttcttcctacccaaaagatacgaagactgataacattcttttacaagttgtcgattcctgtccatgtactgctaatgctaagtggtgttgtggttctggtgttgatcactgtaatgaaattgacttcaaatatggttgtccaattccagaaggtagctggcacgtcgatttatcagatattgctatgtctcgtttacaaactaacgatccatacggtactatgtttgatggtgttattccaattcgttacaagcgtgttccatgtccagtcaagggtaacattcacgtttggttacgtccaggtgctggtccatggtactttgcccttaccgttgttaatgt

SEQ ID NO: 14794 - DNA, 633 bp, Anaeromyces robustus; identical to SEQ ID NO: 14790
  Barwin-like endoglucanases

SEQ ID NO: 14795 - DNA, 72 bp, Anaeromyces robustus; identical to SEQ ID NO: 14791
  Barwin-like endoglucanases

SEQ ID NO: 14796 - DNA, 492 bp, Anaeromyces robustus; identical to SEQ ID NO: 14792
  Barwin-like endoglucanases

SEQ ID NO: 14797 - DNA, 597 bp, Anaeromyces robustus
  Barwin-like endoglucanases
tcaaaccactcgttattgggattgttgtaaaccatcttgtgcctggaattataaagctaaggtcactcatgaagtttattcttgtagaaaagatggtagtattgaaccagtagtatatgctactagtggttgtggaggtggtcaagcctttatgtgtaatgaccaacaaccatgggagattaatgataaattatcttatggttttgctgcagccaatatttcaggtagtgatgaagaacattggtgttgtgcttgtttcaaacttactttcacatctacttcaattgctggtaaacaaatgattgttcaagttactaatactggtggtgatcttggtaataatcattttgatattcaaatgccaggtggtggtcttggtctttttgatggttgttcaccacaatttggtgttgatgcttctaaatggggtaataaatatggtggtcttacatccgaaagtcaatgttccctcttacctaaagtacttcaaccaggttgtcattggagatatggttggtttgaagatgctgataatccagctatggaatttgaagaagttcaatgtccacaagaattagttgatattactggttgtgc

SEQ ID NO: 14798 - DNA, 633 bp, Anaeromyces robustus; identical to SEQ ID NO: 14793
  Barwin-like endoglucanases

SEQ ID NO: 14799 - DNA, 69 bp, Anaeromyces robustus
  Barwin-like endoglucanases
ccactattctcgttcaactcactttggtttaactttcggtggtgcttgtggttttggtttataccaagt

SEQ ID NO: 14800 - DNA, 498 bp, Anaeromyces robustus
  Barwin-like endoglucanases
ggatccagtcggtcgttcttaccgtggtaactttgctgctccacaaggtaactactacactcaattctggggttctttagaaggtgatcaagataattacttatcttgtggtgaatgtttcgaagtttacaaaacaaaggaagatggttctgattacaagccaggagaagaaggttatcaaccaccagttcttctttcagttattgattcatgtccatgtagtgctaatggtaaatggtgttgtggttctgaatgggatcaatgtcaagaagtcaataacttcaaatacggttgtccagttccaaaagacagtattcaccttgatctttcagatattgctatggctcgtcttcaaagtggttcctctaatggtcatatggaagctggtgttattccaaacaaatacagaagagttccatgtccaagattaggtaatatgtacatttggcttcgtaaggatgccggtccatactggttctcattctctgttgttaactc

SEQ ID NO: 14801 - DNA, 609 bp, Anaeromyces robustus
  Barwin-like endoglucanases
aggtacaaccactagatactgggattgttgtaaaccatcctgtgcctggccaggtaaattcgaatacaaaactaatattaaattatgtaatgccgataacagtccacttcttgataacaacttaaaatctggttgtgaaggtggtccaacttacacttgtgaagaccaaacaccatgggctgttgatgaagttactgcttatggttttgctgctgccagtattccaaatcaaactgaagccgattggtgttgtacttgttatgctttaactttcacttccttcccaattaaaggtaagcaaatgattgttcaagtcacaaacactggtggtgatttaggtgaaggtcactttgatattcaaattccaggtggtggtttcggtttatttaatggatgttcaccaagatatccagaaattccagatgaagactggggtgaccgtaatggtggtgttacttctcgtgaaaactgttataaattaccaaagactatgcaagaaggttgtctcttcaaatttgactggttcagaggagctgataacccagatgttacttatgttaaggttgattgtccaaaggaattacttgaagttagtggatgtactcgtat

SEQ ID NO: 14802 - DNA, 321 bp, Anaeromyces robustus
  Barwin-like endoglucanases
ctatactggtgatggtaccacttatggtgatcctgttactggaggttactgtatgatgcctgattctgaagcttacactaaagatatgatgttcgctgctatgaatttaccacaatataacatttctgctggttgtggttcttgtcttattttagctcaagctgataaaccagacagagtcatcagagttcgtgttgttgatcgttgtggtgaatgtccaaagggtgatattgatcttagtaatactgcttggaaagctttaactggtgattttattccaagtcgtgttaaaattatttggagtattgttccatgtactga

SEQ ID NO: 14803 - DNA, 609 bp, Anaeromyces robustus
  Barwin-like endoglucanases
gggtaatactactcgttactgggattgttgtaaaccatcttgttcatggccagaaaaggctttagtttctcaaccagttcaacaatgtaaaaaagatggtattactccaattactaatttcaatgctaaatctggttgtgaaggtggtgaatctttcatgtgtttaaaccaacaaccatgggctgtttcagaagtattatcttatggttatgctgccgcatctattgcaggtttaactgaagctgattggtgttgtcgttgttacgctttaactttcactactggtccagctaaaggtaaacaaattgttgttcaagttactaacactggtggagatcttggtgaaaatcactttgatcttcaaatcccaggtggtggtgttggtattttcaatggttgttccactcaatttaatactgatactgatggttggggtgaacgttatggtggtattggtaaacgtagtgactgtgaaatgcttccagaagaaattcgtcaagcttgttactggcgtttcgattggttccttggatctgataacccagaaatggtctttgatgaagttgaatgtccaattgaattaactcaaaacactggttgtattcataa

SEQ ID NO: 14804 - DNA, 633 bp, Anaeromyces robustus
  Barwin-like endoglucanases
aggtgttaccactcgttattatgattgttgtaaaccatcttgttcatggccaggtaaagctgatgtcttccatccagtaagacattgtgctgttgatggtactaccttaattgatgatcaagaagcaccatctgcttgtcaaaaagatgttaaaggaaccgctcatatgtgtgaaaaccaacaaccatgggcaattaatgatcatctttcctttggtttcgctgctgctgctttaccaggaggtgaatctgtttcttgttgtaaatgttatgcattaactttcactgacccaccaattcgtggtaaacaattagttgttcaagttactaatactggtgctgatgtcggttctaaccaattcgatcttcaaattccaggtggtggtgttggtattttcgatgcttgtactaatatgtatggtttaccagctggttccaatggttggggtaaacaatatggtggtattacttctattgaagattgtgaatctttcccagaatcattaaaagaaggttgtaaatggagattcaactggttattaggagctgataatccaaaaatgaaattcgctgaagttgattgtccaaaagaacttactgatattactggttgtatcagaaaggatgccaaaca

SEQ ID NO: 14805 - DNA, 507 bp, Anaeromyces robustus
  Barwin-like endoglucanases
gaaaggaaaagcttcagttactagatatggtagtatgggtattttatcttgtaattgtaagatttccgctatggaagtcggtccagcttgtgctattaatgaaaatgcttatggtggttacgatggtttaggttctggtgttgcttgtggtatgtgttacaaattaactccatacggtactgctgaaactgaccaatggccaaaatcagaagctgatcttcctggaccaatggtcttcaaggtcactgatatttgtccacacaatgccaacccagcttggtgtccaagtcaagaatctgctccaaagaacagtgttggtatggaataccactttgatattaatgtcgattcatggcaaccagaaactcttcttaaatggttcgctaatggtactttaggtactatgtatgtagatttcgaattagtttcctgtgaagaatggattggttggtctaagaagggacaattcgaaggtcttggtgataatccatggtggggttgttgtcc

SEQ ID NO: 14806 - DNA, 480 bp, Anaeromyces robustus
  Barwin-like endoglucanases
atctggtgaagccagtatgactcactatgaattaaatggtggtggtggttcatgtaacgttagtgctatgggtaatgctgccggtccaactgctgctattagtggtttatcttatggttcatggagtggtttaggtggtggtccagcttgtggtctttgctatgccttgacggtttatggtagttacgatggacaagctgatccagctttattcccaaaatgttcaattgttgttcgtattactgatcaatgtccatatccagataataaagaatggtgtccaggaccagaacaaccagaatctgaaaaattcttaaacccacgtggtatgagatatcactttgatattaacatttctagtggtcaaggtgaagcccgtgaatggttcccacgtgatgcttctggtaatcttttaggtactggtaaagtatacttccaaatggtttcatgtagagaatggagtggttggaaatatggtgc

SEQ ID NO: 14807 - DNA, 465 bp, Anaeromyces robustus
  Barwin-like endoglucanases
ttcagcccttgcttggacatgggctaaagaaggtattgccagtatgacctggtatactgattattctcatcaaaatttagcttgtaactgtgttccaaatgctatggttgttggtccaaccgttgctttggctgaagttgcttatggtgctttcgatcactttggtagtggtccagcttgtggtttatgttaccgtttatctccatttgctactgctgacggtactccacttaatccaaaaccagaaccaatagttttcagagttactgatgaatgtccacatcaatccaatgctgaatggtgtccaggtccagaaggtggtaaaaatgcccatggttttgaacatcactttgatgttaatattgatagttgggaaggtaaattaagagattggttccaaggtggtcacatgcaagctaactttgaattagtttcttgtgaagaatggccaggttggtctgatga

SEQ ID NO: 14808 - DNA, 603 bp, Anaeromyces robustus
  Barwin-like endoglucanases
tcaaaccactcgttattgggattgttgtaaaccatcttgtgcctggaattataaggctaaagtcactcatgaagtttattcttgtagaaaagatggtagtattgaaccagtagtatatgctactagtggttgtggaggtggtgaagccttcatgtgtaatgatcaacaaccatgggcaattaatgataaattatcttatggttttgctgcagccaatatttcaggtagtgatgaagaacattggtgttgtgcttgtttcaaacttactttcacatccacttcaattgctggtaaacaaatgattgttcaagttactaatactggtggtgatcttggtaataatcattttgatattcaaatgccaggtggtggtcttggtctttttgatggttgttccccacaatttggtgttgatgcttctaaatggggtaataaatatggtggtcttacctcagaaagtcaatgttccctcttacctaaagtacttcaaccaggttgtcattggagatatggttggtttgaagatgctgataatccagctatggaatttgaagaagttcaatgtccacaagaattagttgatattactggttgtgctcgtct

SEQ ID NO: 14809 - DNA, 318 bp, Anaeromyces robustus
  Barwin-like endoglucanases
ttacagtggtgatggtactgcttatggtgatgctacttcaggtggtaattgtttattcccaaaaaaggaatattacaatgatatgatgtatgctgctcttaataacaaacaatataatcttgatatgggttgtggtctttgtgctgttgtagtttcaactagtaacccatacaaagctattagagtacgtattattgatcaatgtccagaatgtgaacacggaagtttagattttagtgataaagctttcaaagctctttccaatatggatccagctcgtattaagattacatgggctcttattccatgtgatgttga

SEQ ID NO: 14810 - DNA, 609 bp, Anaeromyces robustus
  Barwin-like endoglucanases
tggtactactacaggttattgggattgttgtgttgcttcttgttcatgggaaaataatgttaaaggtggaggtcaacccgttaaagcatgtaaaaaggatggtatgactttagttactgaagaattatggaaagttaaaagtgtttgtgataatggtgatgcttatatgtgtaatgatcaacaacctattgttgttaatgatcaattggctcttggttttgctgcttcccatgaaccatgttgtacttgtcaattattacaatttacttctagtaatgttaaaggtaagaaaatgattgtacaagttactaatactggtgatgatattggtaataatcactttgatcttcaaattccaggtgctggtgttggtattttcaatggttgttctaaacaatggggagctggtaatgatggttggggtagacgttatggtggtgttacttcacaagctgaatgtagtcaacttccatctgaattaagagctggttgtgaatggagatttggttggtttgccagttctgataatccaacagttacttatgaacgtgttcaatgtccacaacaacttacaagtattactggttgtgttctttctgatgatgctca

SEQ ID NO: 14811 - DNA, 301 bp, Piromyces finnis
  Barwin-like endoglucanases
aggtgttactacagcctattgggattgttgtgttgcttcttgttcttgggatgctaacgtttcgggtagtaagccagttaaagcatgtcgtaaagatggagtatctcttgttaccgaagaactttggaaagttaaaagtgtatgtgataatggtgatgcctatatgtgtaatgatcaacaaccgattgtaattaatgaaaaactttcatatggttttgctgcttctcatgatccatgttgttcttgtcaaagacttcaatttacttctggtccaattaagggaaaacaaatgattgttcaa

SEQ ID NO: 14812 - DNA, 507 bp, Piromyces finnis
  Barwin-like endoglucanases
aaagggaaaggcttcagttaccagatatggtagtatgggtattttatcttgtaattgtaaaatttcagcaatggaagttggtccagcttgtgctatcaatgaaaatgcctatggtggttatgatggtttaggttcaggagttgcttgtggtatgtgttacaaattaactccatatggtacttctgaaactgaccaatggccaaaatcagaagctgaccttccaggaccaatggtcttcaaggttactgatatttgtccatacaatgctaatccaaaatggtgtccaagtcaagaatctgctccaaagaacagtgttggtatggaatatcactttgatattaatgttgattcttggcaaccagaaactcttatcaaatggttcggtaatggttcattaggtacaatgaatgtcgaattcgaattagtttcctgtgaagaatggctcggttggtcaaagaagggaaaattcgaaggtcttggtgataatccatggtggggttgttgtcc

SEQ ID NO: 14813 - DNA, 622 bp, Piromyces finnis
  Barwin-like endoglucanases
aggtgttactactcgttactacgattgttgtaagccatcttgttcatggccaggtaaggctgatgtcacccaaccagttagacaatgtgctatggatggtaagactcttttaactgatttcagttctccatctgcttgtcaaaccgatgttgaaggtatttcacatatgtgtgaagaccaacaaccatgggcagtcagtgatgttttatcttacggttttgctgctgctgctttaccaggtggtgaatctgtttcttgctgtgcttgttacgctattactttctctgaaccaccaattagaggtaagcaaattgttgttcaagttactaacactggtgctgatgtcggttcaaaccaattcgatcttcaaattccaggtggtggtgttggtattttcgatgcttgtactaatatgtacggtttaccaagtggatctaacggttggggtaagaagtacggtggtattgacaagattgaagattgtgactccttcccagaagctcttcaagctggttgccgttggagattcgaattcttattaggtgctgataatccaaagatgacctttgttgaagttgaatgtccaaaggttcttactgatatcactggttgtattcgtaac

SEQ ID NO: 14814 - DNA, 622 bp, Piromyces finnis
  Barwin-like endoglucanases
aggtgtcaccactcgttactacgattgttgtaagccatcttgttcatggccaggtaaggctgatgtcacccaaccagttagacaatgtgctatggatggtaagactcttttaactgatttcagttctccatctgcttgtcaaaccgatgttgaaggtatttcacatatgtgtgaagaccaacaaccatgggcagtcagtgatgttttatcttacggttttgctgctgctgctttaccaggtggtgaatctgtttcttgctgtgcttgttacgctattactttctctgaaccaccaattagaggtaagcaaattgttgttcaagttactaacactggtgctgatgtcggttcaaaccaattcgatcttcaaattccaggtggtggtgttggtattttcgatgcttgtactaatatgtacggtttaccaagtggatctaacggttggggtaagaagtacggtggtattgacaagattgaagattgtgactccttcccagaagctcttcaagctggttgccgttggagattcgaattcttattaggtgctgataatccaaagatgacctttgttgaagttgaatgtccaaaggttcttactgatatcactggttgtattcgtaac

SEQ ID NO: 14815 - DNA, 480 bp, Piromyces finnis
  Barwin-like endoglucanases
ttctggtgaagcaagtatgactcactacgaattaaatggtggtggtggttcttgtaatgttagtgctatgggtaatgctgctggtccaactgctgctattagtggtttatcatatggttcatggagtggtttaggtggtggtccagcttgtggtctttgctatgccttgactgtttttggtagttatgatggtcaagctgatccagaattattcccaaaatgttctattgttgttcgtattactgatcaatgtccatacccagataacaaggaatggtgcccaggtccagaacaaccagaatctgagggattcttaaacccacgtggtatgagatatcactttgatattaatatttctagtggtcaaggtgaagctcgtgaatggttcccacgtgatgcttctggtaaccttttaggtaccggtaaagtttacttcgaaatggtttcatgcagagaatggagtggttggaagtatggtgc

SEQ ID NO: 14816 - DNA, 633 bp, Piromyces finnis
  Barwin-like endoglucanases
atggaagttttccagatctactcacttcggtttaacttacggtggtgcttgtggtttcggtttatatggtttatgtactactaagtacaatgaaactggtgaactctgtatgagattctgtgacaaatacccagatctttgtgctgatccaccaaacatttctttaagaggtaacttctgtgctccaaacggtaactactacactcaattctggtcttctcttccaggagattatgataactacctttcctgtggtgaatgttatgaagttgaaagaactcaaccagatggttcatcttacccagaaggtgaaggtactgataacattcttttacaagttgttgattcctgtccatgtactgctaatgctaagtggtgctgtggttctggtgttgatcactgtaatgaaattgacttcaaatatggttgtccaatcccagaaggtagctggcacgttgatttatctgatattgctatgtctcgtttacaaactaacgatccatacggtggaatggttgatggtgttattccaattcgttacaagcgtgttccatgtccagtcaagggtaacattcacgtctggttacgtccaggtgccggtcaatggtactttgctcttaccgttgtcaatgt

SEQ ID NO: 14817 - DNA, 462 bp, Piromyces finnis
  Barwin-like endoglucanases
agctcttgcttggacatgggctaaggaaggtattgctagtatgacttggtatactgattactctcacgaaaatttagcttgtaattgtgttccaaatgctatggttgtaggtcctactgttgctttagctgaagttgcttatggtgcttttgaccactttggtagtggtccagcttgtggtttatgttatcgtttatccccatttgctactgctgatggtaaacctctttctccaattccagaaccaattgttttcagagttactgatgaatgtccacatcaatctaatatggaatggtgtccaggtccagaaggtggcttaaacgatcatggttttgcaaatcactttgatgttaacattgatagttggggtggtaaattaagagactggttccaaggtggtcacatgcaagctaactttgaattagtttcttgtgaagaatggccaggttggtcagatga

SEQ ID NO: 14818 - DNA, 321 bp, Piromyces finnis
  Barwin-like endoglucanases
ttatactggagatggtactacttatggtgatccagtaaccgggggttattgtatgatgccagattctgaagcttataccaaagatatgatgtttgctgccatgaatttaccacaatataatatttctgctggttgtggttcttgtcttattttagctcaagctgataaaccagaaagagttattagagttcgtgttgttgatcgttgtggtgaatgcccaaagggtgatattgatcttagtaacacagcttggaaagctttaactggtgattttatcccaggtcgtgtaaaaattatttggagtatcgtcccatgtactga

SEQ ID NO: 14819 - DNA, 318 bp, Piromyces finnis
  Barwin-like endoglucanases
ttacagtggtgatggtactgcttatggtgatgctacttcaggtggaaattgtttattcccaaaaaaagaatattataatgatatgatgtatgccgctcttaataataagcaatacaatgatgatatgggttgtggtctttgtgcagttgttgtttcaacaagcaatccatacaaagctattagagttcgtattattgaccaatgtccagaatgtgaacacggaagtttagatttcagtgataaagcattcaaagctctttcaaacaaaactccagatcgtataaagattacatgggcacttattccatgtgatgtcga

SEQ ID NO: 14820 - DNA, 627 bp, Neocallimastix californiae
  Barwin-like_endoglucanase
tggtaagactactcgttactgggattgttgtcttgcatcatgttcatggcaagaaaacactaagaaagctggagctagtggtgttgttagatcatgtagcaaagatggtatgactccatttactgatctttctaatctctggagagttaagagtggatgtgaaggtggttctgtctacatgtgtaatgaccaacaaccatgggctgttaacgacaacgttgcttatggttttgttgcttctcacgaaaagtgttgtacttgtcaacgtcttaagttcacttctggtccagttgctggtaagcaaatgattgtccaaactaccaacaccggtggtgatctttcttccaaccacttcgatattcaaatgccaggtggtggtttcggtatctttgatggatgtacctcacaattcggaggaggtcacaactggggtgaacgttatggtggtattaagagtgcttctgaatgtgctaaccttccatctgtcttaaagcaaggttgtgaatggagattcaactggttcaagaatgctgataacccaaatgttgtttttgaacgtgtccaatgtccaaaggaacttactgacattactggttgtgttccaaatgatgattcctctgttaagaa

SEQ ID NO: 14821 - DNA, 369 bp, Neocallimastix californiae
  Barwin-like_endoglucanase
tggtaactactacactcaattctggccatctctccaaggtgattatgataactatctttcttgtggtgaatgttatgaattagaaattactcaagaagatggttctctttatccagaagataatagacgttctgaaaacattattgctcaaattgttgattcctgtccatgttccgctaatgctaagtggtgttgtggttcaggtattgatcactgtaatgaaattgactttaagtatggttgtccaattccagaaggtagtgtacactttgatttatctgatattgctatggctcgtttacaaactaatgatccaaatggtggtatggttgaaggtgttattccaattcgttacaagcgtgttccatg

SEQ ID NO: 14822 - DNA, 87 bp, Neocallimastix californiae
  Barwin-like_endoglucanase
tgcaactaaccaagaatggaaatactctagatctactcactatggtttaacttatgctggtgcttgtgcttttggtgtttacggttt

SEQ ID NO: 14823 - DNA, 366 bp, Neocallimastix californiae
  Barwin-like_endoglucanase
tggtaattactacactcaattctggtcttctcttccaggtgattatgataactatctttcttgtggtgaatgttatgaagttgaaagaactttaccagatggttcatcttacccagctggagaaggtactgatcatattcttttacaagttgttgattcctgtccatgtaccgctaatgctaagtggtgttgtggttccggagttgatcactgtaatgaaattgatttcaagtatggttgtccaattccagaaggtagctggcacgttgatttatccgatattgctatgtctcgtttacaaaccaatgatccatatggtgttatggttgatggtgttattcctattaagtatagacgtgttccatg

SEQ ID NO: 14824 - DNA, 84 bp, Neocallimastix californiae
  Barwin-like_endoglucanase
cacagaccaaccatggaaatactccagatctactcacttcggtttaacctatggtggtgcttgtggtttcggtttatacggttt

SEQ ID NO: 14825 - DNA, 612 bp, Neocallimastix californiae
  Barwin-like_endoglucanase
gggtaccactaccagatactgggattgttgtaaaccatcatgtgcttggccaggtaaattcgaatacaagactaatattaaattatgtgctgccgatggaagtgcacttctcgataataatttaatttctggatgtgaaggtggcccaacttatacttgtgaagatcaaactccatgggctgttgatgacgttactgcttatggttatgctgccgctaacattccaggtttaactgaagctgattggtgttgtacttgttatgctttaactttcacttccttcccaattaagggtaagcaaatgattgttcaaattacaaacactggtggtgatttaggtgaaggtcacttcgatcttcaaattccaggtggtggttttggtttattcaatggttgttctccaagatacccagatattccagatgaagactggggtgaccgtaatggtggtgttacttctcgtgaaggttgttacaagttaccagtaagtatgcaagaaggttgtctcttcaaatttgactggttcagaggagctgataatccagaagttacttatgttaaggttgactgtcctcaagaattaattgatgtcagtggatgtactcgtatgaa

SEQ ID NO: 14826 - DNA, 609 bp, Neocallimastix californiae; identical to SEQ ID NO: 14763
  Barwin-like_endoglucanase

SEQ ID NO: 14827 - DNA, 636 bp, Neocallimastix californiae
  Barwin-like_endoglucanase
aggtgttaccactcgttactatgattgttgtaaaccatcttgttcatggccaggtaaggctgatgtcttccatccagtaagacattgtactgttgatggtactactcttattgaagatcaagaagctccatctgcttgtcaaaaggatgttgttggtactgctcatatgtgtgaaaaccaacaaccatgggctgtaagtgactcactttcatacggttttgctgctgctgctttaccaggtggtgaatctgtttcctgctgtaaatgctatgctttaactttcattgatccaccaattcgtggtaagcaattagttgttcaagttactaacactggtgctgatgtcggttctaaccaattcgatcttcaaattccaggtggtggtgtcggtattttcgatgcttgcactaacatgtatggtttacctgctggttcaaatggttggggtaaacaatatggtggtattactggtattgaagattgtgaaaccttcccagaatccttaaaggaaggttgtaaatggagattcaactggttattaggagctgataacccaagaatgaaatttgccgaagttgattgtccaaaagaacttactgatattactggttgtattagaaaagacgctaagcaaag

SEQ ID NO: 14828 - DNA, 315 bp, Neocallimastix californiae
  Barwin-like_endoglucanase
tactggtgatggtaccacttatggtgatccacttacaggaggttattgtatgatgccagattctgaagcttacacgaaagatatgatgtttgctgctatgaatttaccacaatataatatttctgctggatgcggaagttgtcttattttagctcaagctgataaaccagaaagagttatcagagttcgtgttgtagatcgttgtggtgaatgtccaaagggtgatattgatcttagtaataccgcttggaaagctttaactggtgattttattccaggtcgtgtaaagattatatggagtattgttccatgtac

SEQ ID NO: 14829 - DNA, 622 bp, Neocallimastix californiae; identical to SEQ ID NO: 14770
  Barwin-like_endoglucanase

SEQ ID NO: 14830 - DNA, 603 bp, Neocallimastix californiae; identical to SEQ ID NO: 14772
  Barwin-like_endoglucanase

SEQ ID NO: 14831 - DNA, 636 bp, Neocallimastix californiae
  Barwin-like_endoglucanase
aggtgttactactcgttactacgattgttgtaagccatcttgttcatggccaggtaaggctgatgttttccatccagtaagacactgtaaagttgatggtactactcttattgaagatcaagaagctccatctgcttgtcaaaaggatgttgttggtactgctcatatgtgtgaaaatcaacaaccatgggctgtaagtgactctctttcatatggtttcgctgctgctgctttaccaggtggtgaatctgtttcctgttgtaaatgttatgctttaacattcactgatccaccaattcgtggtaaacaattagttgttcaagttactaacactggttctgatgttggttctaatcaatttgatcttcagattccaggtggtggtgtcggtattttcgatgcttgtactaatatgtatggtttaccagctggttcaaatggctggggtaaacaatatggtggtattactggtattgaagattgtgaatccttcccagaatccttaaaggaaggatgtaaatggagattcaactggttattaggagctgataatccaaaaatgaaattcgctgaagttgaatgtccaaaagtacttactgatattaccggctgtattagaaaagacgctaaacaaag

SEQ ID NO: 14832 - DNA, 84 bp, Neocallimastix californiae
  Barwin-like_endoglucanase
tactgatcaaccatggaaatactctagatctactcacttcggtttaacctatggtggtgcatgtggtttcggtttatacggttt

SEQ ID NO: 14833 - DNA, 366 bp, Neocallimastix californiae
  Barwin-like_endoglucanase
cggtaactactacactcaattctggtcttctcttccaggtgactatgataactatctttcctgtggtgaatgttacgaagttgaaagaactttaccagatggttcttcttacccagctggtgaaggtactgatcatattattttacaagttgttgattcctgtccatgtactgctaatgctaagtggtgctgtggatccggtgttgatcactgtaacgaaattgatttcaagtatggttgtccaatcccagaaggtagttggcacgttgatttatcagatattgccatgtctcgtttacaaacaaatgatccatatggggttatggttgatggtgttattccaattaagtacaagcgtgtcccatg

SEQ ID NO: 14834 - DNA, 633 bp, Neocallimastix californiae; identical to SEQ ID NO: 14777
  Barwin-like_endoglucanase

SEQ ID NO: 14835 - DNA, 606 bp, Neocallimastix californiae
  Barwin-like_endoglucanase
aggtactactactcgttactgggattgttgtaagccatcttgttcatggccagacaaagcacctgtttctgctccagtcagacaatgtaaggctgatggtttcactgctcttacaaactacaatgctaaatctggttgtgaaggtggtgaatcttacatgtgttcagaccaaagaccatgggctgtttctgaagttttatcctatggttatgccgctgcctctatcaagggtttaaccgaaaaggaatggtgttgtcgttgttacgctttaaccttcacttctggtccagttaagggtaagcaaatggttgtccaagttactaacactggtggtgatcttggtgataatcactttgatattcaaattccaggtggtggtttcggtatcttcaacggttgttccgctcaattcaatactccagatgaagtttggggtactcgttacggtggtgttgccagtcgtgatgattgtgaaggacttccaaaagaaattcaagaatcttgttactggagattcgattggttccttaacgctgataacccaaccatggtcttcgatgaagtagaatgtccagctgaattaactaagaatactgactgtattca

SEQ ID NO: 14836 - DNA, 633 bp, Neocallimastix californiae; identical to SEQ ID NO: 14779
  Barwin-like_endoglucanase

SEQ ID NO: 14837 - DNA, 615 bp, Neocallimastix californiae
  Barwin-like_endoglucanase
tggtactactacaggttactgggattgttgtgttgcttcctgttcatgggatggtaatgttgaaggaagtaagcctgttaaagcatgtaagaaggatggtgtctccttaattactgaggaactttggaaggtaaaaagtgtctgtgataatgaaggagatggatatatgtgtaatgataatcaacccattgtcataaatgataatcttgcccttggttttgctgcttctcatgaaaagtgttgttcctgtcaactcttacaatttacttcaagtaatgtaaagggtaaaaaaatgattgttcaagtcactaacactggttcagatattggtagtaatcactttgatcttcaaattcctggtgctggtgtcggtatcttcaacggttgtagtaagcaatggggtgctccaggcgatggttggggtagacgttatggtggtgtcactacaaaagccgaatgtagtcaacttccagctcaattaagagccggttgtgaatggagatttggatggtttgccagttctgataatccaggtgttgtctatgaacgtgttcaatgtccaaaacaacttactgatatcaccggttgtgttcttccagatgatgctcaacaaaa

SEQ ID NO: 14838 - DNA, 612 bp, Neocallimastix californiae
  Barwin-like_endoglucanase
gggtactactaccagatattgggattgttgtaaaccatcttgtgcctggccaggtaaatttgaatacaagaccaatattaaattatgtgctgctgatggtagcccacttctcgataataatttaatttctggttgtgaaggtggaccaacttatacttgtgaagatcaaactccatgggctgttgatgatgttactgcttatggttatgctgccgcaaacattccaggtttaacagaagctgattggtgttgtacttgttatgctttaactttcacttccttcccaattaagggtaaacaaatgattgttcaaattactaacactggtggtgatttaggtgatggtcactttgatcttcaaattccaggtggtggttttggtttatttaatggttgttccccaagatatccagatattccagatgaagactggggtgatcgtaatggtggtgttatatctcgtgaaggttgttataaattaccaaaaagtatgcaagaaggttgtctcttcaaatttgactggttcagaggagctgataatcctgatgttacttatgttaaggttgattgtccacaagaattacttgatgtaagtggatgtacccgtatgaa

SEQ ID NO: 14839 - DNA, 309 bp, Neocallimastix californiae
  Barwin-like_endoglucanase
tggtgatggtacagcttatggagatgccacttcaggtggtaattgtttattcccaaagaaggaatactataatgatatgatgtacgctgctctcaacaataaacaatacaatacagatatgggttgtggtctctgtgcagtagtagtttcaactagtaacccatacaaaccaattagagtacgtattattgatcaatgtccagaatgtgctcacggaagtttagatttcagtgataaggcttttaaggccctttcaaacaaaactccggatcgtattaagattacttgggctcttattccttgtgatgt

SEQ ID NO: 14840 - DNA, 612 bp, Neocallimastix californiae
  Barwin-like_endoglucanase
tggaaaaactacgggttactgggattgctgtgttgcttcctgttcatgggatgctaatgttcctggagctaagccagttagagcttgtagaaagaatggtgtcagcttaattactgaagaactttggaaagttaagagtgtctgtgataatggagaaggctacatgtgtaataataatcaacctattgttatcaatgataagcttgcctacggtttcgctgcttcacatgaaaagtgttgtacctgtcagagacttcaattcacttccggtaatgtgaagggtaaacaaatgattgttcaaattacgaatactggttctgatcttggtagtaatcactttgatcttcaaattccaggtgctggtgttggtattttcaatggttgtactaaacaatggggagctccaaatgatggttggggcagacgttatggtggagtcacctcgaaatcccaatgtagtcaacttccatctcaattaagagcaggttgtgaatggagatttggatggtttgaaggatcagataatccagatgtcgtctttgaacgtgttcgttgtccaaaagctctcactgatattactggttgtattcttccagatgaatctcaacaaaa

SEQ ID NO: 14841 - DNA, 639 bp, Neocallimastix californiae
  Barwin-like_endoglucanase
tggtaagactactcgttactgggattgttgtcttgcttcctgttcatggagtgaaaatgttggtgcctctcacccagttaatgcctgtaaaaaggatggtactactcttattactgatatttccaacttatggagaattaagagtggttgtcaaggtggtgaagcttacatgtgtaatgctcaacaaccatggattattaatgataaggtttcttacggtttcgttgctgccggttttgacagtggtaaccaaaagcaatggtgttgttcctgtcaaaaacttcaattcacttctggtccagttgctggtaagcaaatgattgttcaagttactaacactggtactgatctttctgaaaaccactttgatattcaaatgccaggtggtggtgttggtattttcaacggttgttcttctcaatggaatgctggttctgatggttggggtcaacgtttcggtggtatttcctccgtttctgaatgttctcaacttccagctgaattaagagatggttgtaaatggagattcgattggttcaagaacgctgataatccagctgttgtttttgaacgtgttcaatgtccaaaggaacttactgacattactggttgtattccaccagatgatgctcaacaaaa

SEQ ID NO: 14842 - DNA, 369 bp, Neocallimastix californiae
  Barwin-like_endoglucanase
cggtaactactacactcaattctggtcttctcttccaggagattatgataattatctttcttgtggtgaatgttatgaattagaaattacccaagaagatggttctctttatccagaaaaacaaagacgttctgaaaacattattgcccaaattgtagattcctgtccatgttctgccaatgctaaatggtgttgtggatcaggtattgaccattgtaatgaaattgactttaaatatggttgtccaatcccagaagatagtgtacactttgatttatctgatattgctatggctcgtttacaaaccaatgatccaaacggaggaatggttgaaggtgttattccaattcgttacaaacgtgttccatg

SEQ ID NO: 14843 - DNA, 84 bp, Neocallimastix californiae
  Barwin-like_endoglucanase
tagaaatcatgactggcattattctagatctacacactatggtttaacctatgctggtgcctgtgctttcggtgtttatggttt

SEQ ID NO: 14844 - DNA, 366 bp, Neocallimastix californiae
  Barwin-like_endoglucanase
cggtaactattacactcaattctggtcttctcttccaggagattatgataactacctttcctgtggtgaatgttatgaagttgaaagaactcaaccagatggttcttcctacccaaaagatacgaagactgataacattcttttacaagttgtcgattcctgtccatgtactgctaatgctaagtggtgttgtggttctggtgttgatcactgtaatgaaattgacttcaaatatggttgtccaattccagaaggtagctggcacgtcgatttatcagatattgctatgtctcgtttacaaactaacgatccatacggtactatgtttgatggtgttattccaattcgttacaagcgtgttccatg

SEQ ID NO: 14845 - DNA, 84 bp, Neocallimastix californiae
  Barwin-like_endoglucanase
tagtgatcaaccatggaaatactccagatctactcactttggtttaacttacggtggtgcttgtggtttcggtttatacggttt

SEQ ID NO: 14846 - DNA, 639 bp, Anaeromyces robustus; identical to SEQ ID NO: 14841
  Barwin-like_endoglucanase

SEQ ID NO: 14847 - DNA, 369 bp, Anaeromyces robustus; identical to SEQ ID NO: 14842
  Barwin-like_endoglucanase

SEQ ID NO: 14848 - DNA, 84 bp, Anaeromyces robustus; identical to SEQ ID NO: 14843
  Barwin-like_endoglucanase

SEQ ID NO: 14849 - DNA, 597 bp, Anaeromyces robustus; identical to SEQ ID NO: 14797
  Barwin-like_endoglucanase

SEQ ID NO: 14850 - DNA, 366 bp, Anaeromyces robustus; identical to SEQ ID NO: 14844
  Barwin-like_endoglucanase

SEQ ID NO: 14851 - DNA, 84 bp, Anaeromyces robustus; identical to SEQ ID NO: 14845
  Barwin-like_endoglucanase

SEQ ID NO: 14852 - DNA, 612 bp, Anaeromyces robustus
  Barwin-like_endoglucanase
aggtacaaccactagatactgggattgttgtaaaccatcctgtgcctggccaggtaaattcgaatacaaaactaatattaaattatgtaatgccgataacagtccacttcttgataacaacttaaaatctggttgtgaaggtggtccaacttacacttgtgaagaccaaacaccatgggctgttgatgaagttactgcttatggttttgctgctgccagtattccaaatcaaactgaagccgattggtgttgtacttgttatgctttaactttcacttccttcccaattaaaggtaagcaaatgattgttcaagtcacaaacactggtggtgatttaggtgaaggtcactttgatattcaaattccaggtggtggtttcggtttatttaatggatgttcaccaagatatccagaaattccagatgaagactggggtgaccgtaatggtggtgttacttctcgtgaaaactgttataaattaccaaagactatgcaagaaggttgtctcttcaaatttgactggttcagaggagctgataacccagatgttacttatgttaaggttgattgtccaaaggaattacttgaagttagtggatgtactcgtatgaa

SEQ ID NO: 14853 - DNA, 315 bp, Anaeromyces robustus
  Barwin-like_endoglucanase
tactggtgatggtaccacttatggtgatcctgttactggaggttactgtatgatgcctgattctgaagcttacactaaagatatgatgttcgctgctatgaatttaccacaatataacatttctgctggttgtggttcttgtcttattttagctcaagctgataaaccagacagagtcatcagagttcgtgttgttgatcgttgtggtgaatgtccaaagggtgatattgatcttagtaatactgcttggaaagctttaactggtgattttattccaagtcgtgttaaaattatttggagtattgttccatgtac

SEQ ID NO: 14854 - DNA, 609 bp, Anaeromyces robustus; identical to SEQ ID NO: 14803
  Barwin-like_endoglucanase

SEQ ID NO: 14855 - DNA, 636 bp, Anaeromyces robustus
  Barwin-like_endoglucanase
aggtgttaccactcgttattatgattgttgtaaaccatcttgttcatggccaggtaaagctgatgtcttccatccagtaagacattgtgctgttgatggtactaccttaattgatgatcaagaagcaccatctgcttgtcaaaaagatgttaaaggaaccgctcatatgtgtgaaaaccaacaaccatgggcaattaatgatcatctttcctttggtttcgctgctgctgctttaccaggaggtgaatctgtttcttgttgtaaatgttatgcattaactttcactgacccaccaattcgtggtaaacaattagttgttcaagttactaatactggtgctgatgtcggttctaaccaattcgatcttcaaattccaggtggtggtgttggtattttcgatgcttgtactaatatgtatggtttaccagctggttccaatggttggggtaaacaatatggtggtattacttctattgaagattgtgaatctttcccagaatcattaaaagaaggttgtaaatggagattcaactggttattaggagctgataatccaaaaatgaaattcgctgaagttgattgtccaaaagaacttactgatattactggttgtatcagaaaggatgccaaacaaag

SEQ ID NO: 14856 - DNA, 603 bp, Anaeromyces robustus; identical to SEQ ID NO: 14808
  Barwin-like_endoglucanase

SEQ ID NO: 14857 - DNA, 618 bp, Anaeromyces robustus
  Barwin-like_endoglucanase
tggtactactacaggttattgggattgttgtgttgcttcttgttcatgggaaaataatgttaaaggtggaggtcaacccgttaaagcatgtaaaaaggatggtatgactttagttactgaagaattatggaaagttaaaagtgtttgtgataatggtgatgcttatatgtgtaatgatcaacaacctattgttgttaatgatcaattggctcttggttttgctgcttcccatgaaccatgttgtacttgtcaattattacaatttacttctagtaatgttaaaggtaagaaaatgattgtacaagttactaatactggtgatgatattggtaataatcactttgatcttcaaattccaggtgctggtgttggtattttcaatggttgttctaaacaatggggagctggtaatgatggttggggtagacgttatggtggtgttacttcacaagctgaatgtagtcaacttccatctgaattaagagctggttgtgaatggagatttggttggtttgccagttctgataatccaacagttacttatgaacgtgttcaatgtccacaacaacttacaagtattactggttgtgttctttctgatgatgctcaacaaaagaa

SEQ ID NO: 14858 - DNA, 301 bp, Piromyces finnis; identical to SEQ ID NO: 14811
  Barwin-like_endoglucanase

SEQ ID NO: 14859 - DNA, 456 bp, Piromyces finnis
  Barwin-like_endoglucanase
cgcctggaaatgggccaaaaagggaaaggcttcagttaccagatatggtagtatgggtattttatcttgtaattgtaaaatttcagcaatggaagttggtccagcttgtgctatcaatgaaaatgcctatggtggttatgatggtttaggttcaggagttgcttgtggtatgtgttacaaattaactccatatggtacttctgaaactgaccaatggccaaaatcagaagctgaccttccaggaccaatggtcttcaaggttactgatatttgtccatacaatgctaatccaaaatggtgtccaagtcaagaatctgctccaaagaacagtgttggtatggaatatcactttgatattaatgttgattcttggcaaccagaaactcttatcaaatggttcggtaatggttcattaggtacaatgaatgtcgaattcgaattagtttcctgtgaaga

SEQ ID NO: 14860 - DNA, 622 bp, Piromyces finnis; identical to SEQ ID NO: 14813
  Barwin-like_endoglucanase

SEQ ID NO: 14861 - DNA, 622 bp, Piromyces finnis; identical to SEQ ID NO: 14814
  Barwin-like_endoglucanase

SEQ ID NO: 14862 - DNA, 393 bp, Piromyces finnis
  Barwin-like_endoglucanase
ccttgcttctgctgcaaaagcttgggaatgggattgggctacttctggtgaagcaagtatgactcactacgaattaaatggtggtggtggttcttgtaatgttagtgctatgggtaatgctgctggtccaactgctgctattagtggtttatcatatggttcatggagtggtttaggtggtggtccagcttgtggtctttgctatgccttgactgtttttggtagttatgatggtcaagctgatccagaattattcccaaaatgttctattgttgttcgtattactgatcaatgtccatacccagataacaaggaatggtgcccaggtccagaacaaccagaatctgagggattcttaaacccacgtggtatgagatatcactttgatattaa

SEQ ID NO: 14863 - DNA, 366 bp, Piromyces finnis
  Barwin-like_endoglucanase
cggtaactactacactcaattctggtcttctcttccaggagattatgataactacctttcctgtggtgaatgttatgaagttgaaagaactcaaccagatggttcatcttacccagaaggtgaaggtactgataacattcttttacaagttgttgattcctgtccatgtactgctaatgctaagtggtgctgtggttctggtgttgatcactgtaatgaaattgacttcaaatatggttgtccaatcccagaaggtagctggcacgttgatttatctgatattgctatgtctcgtttacaaactaacgatccatacggtggaatggttgatggtgttattccaattcgttacaagcgtgttccatg

SEQ ID NO: 14864 - DNA, 84 bp, Piromyces finnis
  Barwin-like_endoglucanase
tcaagatcaaccatggaagttttccagatctactcacttcggtttaacttacggtggtgcttgtggtttcggtttatatggttt

SEQ ID NO: 14865 - DNA, 321 bp, Piromyces finnis; identical to SEQ ID NO: 14818
  Barwin-like_endoglucanase

SEQ ID NO: 14866 - DNA, 312 bp, Piromyces finnis
  Barwin-like_endoglucanase
cagtggtgatggtactgcttatggtgatgctacttcaggtggaaattgtttattcccaaaaaaagaatattataatgatatgatgtatgccgctcttaataataagcaatacaatgatgatatgggttgtggtctttgtgcagttgttgtttcaacaagcaatccatacaaagctattagagttcgtattattgaccaatgtccagaatgtgaacacggaagtttagatttcagtgataaagcattcaaagctctttcaaacaaaactccagatcgtataaagattacatgggcacttattccatgtgatgt

SEQ ID NO: 14867 - DNA, 1102 bp, Neocallimastix californiae
  Beta_cellobiohydrolase
cactatttctggaaatccatttagcggagttgaattctacattaatccatactatgttgaagaagttgatggagcaattgctcaaatgtccgattcttcccttattgctaaggctgaaaagatgaagacctactctaatgctatctggttagataccattaagaacatgcaaagttggttagaatctaacttacaaggagctcaatctcaacaccaatctagtggtaaggatgttttaactgttttcgtcgtttacgatttaccaggtcgtgattgtcacgctcttgcttctaatggtgaacttcttgctaacgatggtgattttactcgttacaagtctgaatacattgatgtcattgaaggtcacttaaagacttacaaatctcaaccagttgttcttattgttgaaccagattcacttgctaacatggttaccaatcttgattccactccagcatgtcgtgattctgaaaagtattacatggatggccatgcttacttaattaagaagtttggtgttcttccacatgttgctatgtatcttgatattggtcacgccttctggttaggttgggatgacaaccgtgaaaaggctggtaaggtttatgccaaggttatcagctctggtgctccaggtaaggttcgtggtttcactgataatgttgctaactacactccatgggaagatccaactctttctcgtggaccagaaaccgaatggaacccatgtccagatgaaaagagatacttacaagctattcaaaaggacttcaagtcagctggtattcaatcagtttacttcgtttgtgatacttctcgtaatggtaagaaggttgaccgtaagcacccaggagaatggtgtaaccaaactggagttggtattggagccagaccacaagccagtccagtttctggtatggaataccttgatgctttctactggattaagccacttggtgaatctgatggtacctctgatgaaagtgcagctcgtttcgatggttactgtggtcatgaaaccgctatgaagccagctccagaagccggtcaatggttccaaaagcactttgaacaaggtattaagaatgctaacccaccactc

SEQ ID NO: 14868 - DNA, 1083 bp, Neocallimastix californiae
  Beta_cellobiohydrolase
cgtttatgaagatgctgaagaattctatgtcttcccagattatcaaaagcaagttaagagttcttatgataaattaatggctgaaggtgaaactgaaattgctgaacttgtcgctaaagttgctagatatccaactccaacttggttagctaacacagctgcttctaagctcgttccaaaagttttagctcaagttactgaacaaatgaaaaagactggtaagaaggtattaacttctttcattatttacaacttaccaaacagagattgttctgctgttgcctctagaggtgaattaggtattgaacaccttggagtttacaaggaatggattgatgaaattgctggttactttgctgctcacgaaggaccaattgttgctattattgaaccagatgcccttggtaacatggttagtaacagtaacagtgaactctgtgctgaggctttcgaaactcaaatggaagctcttgtctatgctattactaagcttaacttaccaaatgttggtgtttaccaagatgttgcccaagttggttggttaggttggggaggtaacatgaatttacttattccaattcttgaacaactcttaaacaaggtcggtactggtgttttacgtggtttcagttccaacatttctaacaaccaaccattagttagaccagatccaccagaaagaactttaagtggtaactccagtcaaagtgaatacgaatacagtttgaaagttagagaaaacttaaaaaaggttggtatggttgactttggatgggttgttgatacctcacgtaatggtgtaccaaatatcaagaccaaaggtgaaaattggtgtaacattaagggtgccggtattggaagaagaccagaggcttctccagctgatttaccaggacttgatgctgtttactggttcaagccaccaggtgaatctgatggtagtgacagagttggtcaatggggttatgatccaagttgtgctagtgaggattctcttactgactctccaatggctggtcaatggttccacaagcaatttgttgaattagctgttaatgctaatccatccttcaaggatgaacc

SEQ ID NO: 14869 - DNA, 324 bp, Neocallimastix californiae
  Beta_cellobiohydrolase
acaattcactcacaatggtaatccatttgctaataaggaattctatattaatccatactatgttaaagaagtcgaaggtgccattgctcaaatgtcagattcttcccttattgctaaggctgaaaagatgaagactttctctaatgctatctggcttgattctatcaaaaacatgcaaagttggttagaatcaaatttgaaaggtgctcttgctcaacaaaatgcttctggtaaagatgttttaactgttttcgtcgtttacgatttaccaggtcgtgattgtcacgctcttgcttctaatggtgaacttcttgctaacgatgg

SEQ ID NO: 14870 - DNA, 1105 bp, Neocallimastix californiae
  Beta_cellobiohydrolase
acaatacactcacaatggtaatccattctctgatgttgaattcttcattaatccatactatactgctgaagttgatgccgcaattgctcaaatgagtgattcttcccttatcgctaaggctgaaaagatgaagacatactctaatgctatttggttagataccattaagaatatgaatgagtggttagaaaagaatttaaagggagctcttgctcaacaaagtggaagtaagaaggttttaaccgtttttgtggtttacgatttaccaggtcgtgattgtcacgctcttgcttctaatggtgaacttctcgccaatgatggtgatttagctcgttacaagtctgaatacattgatgttattgaaggtcacttaaagacttataaatctcaaccagttgttcttattgttgaacctgattcacttgctaacttagttactaaccttgaatctactccagcttgtgctgactccgaaaaatactatcttgatggtcatgcttacttaattcaaaagtttggtattcttccacatgttgctatgtatcttgatattggtcacgccttctggttaggttgggatgataaccgtgaaaaggcagctaaggtttactctaaggttatcagttccggttccccaggtaaggttcgtggtttcactgataatgttgctaactacactccatgggaagatccaacactttctcgtggaccagacactgaatggaacccatgtccagatgaaaagagatacttagaagccatgcacaaggacttcaaggcagcaggtattagttccgtttacttcgtttgtgatacttctcgtaatggtaagaaggttgaccgtaagcacccaggagaatggtgtaaccaaactggagttggtattggtgccagaccacaagctagtccagtttctggtatggaataccttgatgctttctactggattaagccacttggtgaatctgatggtacctctgatgaatctgcagctcgtttcgatggttactgtggtcatgaaaccgctatgaagccagctccagaagccggtcaatggttccaaaagcactttgaacaaggtattaagaatgctaacccaccactc

SEQ ID NO: 14871 - DNA, 990 bp, Neocallimastix californiae
  Beta_cellobiohydrolase
acaatacaccatttctggtaatccattcaagggtgttgaattctacatcaatccatactatgttgaagaagttgatggagctattgctcaaatgtctgactcttccctcattgctaaggctgaaaagatgaagacttactctaatgctatttggttagatactattaagaatatgcaaagttggttagaatctaacttacaaggagctcaatctcaacaccaaagtagtggtaaagatatcttaacagttttcgttgtttatgatttaccaggtcgtgattgtcacgctcttgcctctaacggtgaacttcttgccaatgatggagatttagctcgttacaagtctgaatatattgatgttattgaaggtcacttaaagacttacaaatctcaaccagttgttcttattgttgaacccgattcacttgctaacttagttactaatcttgaatctactccagcttgtgctgattctgaaaaatactatcttgaaggacatgcttatttaattaagaagcttggtgttcttccacatgttgctatgtatcttgatattggtcacgctttctggttaggttgggatgataatcgtgaaaaggctggtaaagtttatgctaaggttattagttctggtgctccaggtaatgttcgtggtttcactgataatgtttctaactacactccatgggaagatccaactctttctcgtggaccagaaactgaatggaacccatgtccagatgaaaagagatacttagaagctatttctaaggacttcaaatcagcaggtatcaaatccgtttactttgtttctgatagttctcgtaatggtaagaaggttgatcgtaagcacccaggagaatggtgtaaccaaactggtgttggtgttggtgccagaccacaagccagtccaatttctagcatggaataccttgatgctttctactggattaagccacttggtgaatccgatggtacttctgatgacta

SEQ ID NO: 14872 - DNA, 994 bp, Neocallimastix californiae
  Beta_cellobiohydrolase
tccatccttcttcagtactggaaacatttacagtaacagtcaataccaaggtgaagttcaatcttctattaataaattaagtggtgaattacaacaacaagctaacagagtaaaatacactccaactgctgtttggttagcttgggatggtgctccaggtgaagttccaaagcatcttggtgctgctggtggtaacactgctgtcttcatgatgtactggatcccaactcgtgattgtaacagtaatgcttcccaaggtggtgcttctgacttaaattcttacaagaattacgttgacagtgtttacaattcattcagatcctatggtaacagtaaaattgttgttgtcgtcgaaccagatactcttggtaacatggtgacttctcaaggtaatgaaaactgtagaagaactgctgttattcataagcaagctcttgcttatgctataaacaaattcggtagtcttaacaatgttcaagtctaccttgatgccggtcacagtcaatggttaaccggttatgaagatgaaactgctgaaattattaaggaaatattagatatggctccacaaggtaagattcgtggtttctccactaatgtatctaacttccaacctgtccaaagagaatatgaatatcatactcgtctttacgatgctcttgaaaaggttggtgtcaagaatatgagattcatcgttgatactagtcgtaatggtgttgatatcagtgaagaatttgcaaagactaagacctggtgtaactttgttggtactggttttggtgaacgtccaaagggtaatccagacccagttaacatgccattattagatgcttatatgtggttaaagccaccagcagaatctgacggttcttctactggtgctcgtgctgatccagtttgtgctcgttctgattctcttccaggggctccagacgctggtcaatggttccatgaatactttgtccaattattaaagaatgctaatccaaaattc

SEQ ID NO: 14873 - DNA, 1105 bp, Neocallimastix californiae
  Beta_cellobiohydrolase
atacactattaatggtaatccatttgccaatgttgaattctatattaatccatactatgttgaagaagttgacaatgccatttcccaaatgtctgactcttcccttattgctaaggctgaaaagatgaagacttactccaatgctatttggttagataacattaaaaacatgcaaagttggttacaaccaaacttagaaggtgctctctctcaacaaaatagtggtggtaccccagttttaactgtctttgttgtttatgatttaccaggtcgtgattgtcacgctcttgcctccaatggtgaacttcttgccaatgactctgatatggaacgttacaagtcagaatatattgatgttattgaaggtcacttaaagacttacaagtctcaacctgttgttcttgttattgaaccagattcccttgctaacatggtcactaacattgaaagtactccagcttgtgctgattctcaaaattactactttgatggacacgcctacttacttaagaagcttggtgtcttcccaaatgtagccttatatcttgatattggtcacgccttctggttaggttgggatgataaccgtgaaaaggctgcaaaggtctatgctaaggttattcaatctggtgcaccagctaaggttcgtggtttcgttgataacgttgctaactacactccatgggaagacccaactctttcacgtggtccagatactgaatggaacccatgtccagatgaaaagagatacttagaagctatgcacaaggactttactagtgccggtattcaatctgtctacttcttctctgattcctctcgtaacggtaagaagactgaccgtaagcacccaggtgaatggtgtaaccaaaccggttgtggtattggtgccagaccaaaagccagtccaatctctggtatggaataccttgatgccttctactgggttaagccaattggtgaatctgatggtacctcagatactagtgctaagcgttatgatggttactgtggtcacgaaactgccatgaagccagctccagaagccggtcaatggttccaaaagttcttcgaagaaggtcttaagaatgccaatccaccactt

SEQ ID NO: 14874 - DNA, 627 bp, Neocallimastix californiae
  Beta_cellobiohydrolase
caccatttctggtaatccatttaagggtgttgaattttacattaacccatactatgttgatgaagttgatggagccattgctcaaatgtccgattcttctcttattgctaaggctgaaaagatgaaaacttactctaatgctatttggttagataccattaagaacatgcaaagttggttagaatctaacttaaagggtgctcttgctgaacacaattcaactggaaaggatattttaactgttttcgttgtttacgatttaccaggtcgtgattgtcacgctcttgcttccaatggtgaacttcttgccaactctggtgatatggaacgttacaagtctgaatacattgatgtcattgaaggtcacttaaaggaatataactctcaaccagttgttcttattgttgaaccagattctcttgctaacttagttactaatcttgaatctactccagcttgtcgtgattctgaaaagtattatcttgatggtcatgcttacttaattcaaaagcttggtgttcttccacatgttgctatgtatcttgatattggtcacgccttctggttaggttgggatgataatcgtgaaaaggctggtaaggtttatgccaaggttattcaattcag

SEQ ID NO: 14875 - DNA, 892 bp, Neocallimastix californiae
  Beta_cellobiohydrolase
acaatataccattaatggtaatccattcaagggtgttgaattttacattaacccatactatgttgatgaagttaatggagccattgctcaaatgtccgattcttctcttattgctaaggctgaaaagatgaagacttactctaatgctatttggttagataccattaagaacatgcaaagttggttagaatctaacttagaaggagctctttctcaacaagaatctactggtaagaaagttttaactgttttcgttgtttacgatttaccaggtcgtgattgtcatgctcttgcttccaatggtgaacttcttgccaactctggtgatatggaacgttacaagaccgaatacattgatgtcattgaaggtcacttaaagaaatacaagtctcaaccagttgttcttattgttgaaccagattctcttgctaacatggttactaatattgaaactactccagcttgtgctgattcacaaaactattactatgatggtcatgcctacttacttaagaagtttggagttcttccacatgttgctatgtatcttgatattggtcacgccttctggttaggttgggatgataatcgtgaaaaggctggtaaggtttatgccaaggttattcaatcaggttcaccaggtaaggttcgtggtttcaccgataatgtttcaaactacactccatgggaagatccaactctttctcgtggaccagaaactgaatggaatccatgtccagatgaaaagagatatttagaagctatgcacaaggacttcaaggcggcaggtattgaatcagtttactttgtttccgatacttctcgtaatggacacaagactgaccgtaagcacccaggagaatggtgtaaccaaacaggagttggtattgga

SEQ ID NO: 14876 - DNA, 453 bp, Neocallimastix californiae
  Beta_cellobiohydrolase
acaatacaccatttctggtaatccattcaagggtgttgaattctacatcaatccatactatgttgaagaagttgatggagctattgctcaaatgtctgactcttcccttattgctaaggctgaaaagatgaagacttactctaatgctatttggttagataccattaagaacatgcaaagttggttagaatctaatttacaaggagctcaatctcaacaccaaagtagtggtaaggatatcttaactgttttcgttgtttacgatttaccaggtcgtgattgtcacgctcttgcttctaacggtgaacttcttgccaatgatggagatttagctcgttacaagtctgaatacattgatgttattgaaggtcacttaaagacttacaaatctcaaccagttgttcttattgttgaacccgattcacttgctaacttagttacaaatcttgaatc

SEQ ID NO: 14877 - DNA, 970 bp, Neocallimastix californiae
  Beta_cellobiohydrolase
atcagttgctccaactgaaaatttctttgataacgaactttatattagcccaaactatgttaaagaaattgaatcaactattccagatttgagtccagaattacaagcaaaagccaagaatgttgaaaaggtttcttctgctgtttggttagcctatgaaggtgctccaaatgatgttgctccacatcttaaagctgctggttcaaagactgttactttcattctttatatgattccaactcgtgattgtaatagtttagcttctgctggtggtgtttctgatcttgacaagtacaagggttatgttgacaagattgctaacactattaagaaattcccagaatctaaggttgttatggttattgaaccagatactcttggtaatcttattacaggtgaaactgaagcttgtaagaatgttcacactttacataagcaagctttagcttatgccgctaatgttttcggtaacatgagtaatgttagtgcttatcttgatgctgctcatagtaaatggttaggatgggctgctgataaggttgccgctgttgttaaggaaattttagacaatgctccaaatgctaatattcgtggttttagtactaatgtttctaattacatgccaattgaagctgaatatgaatatcatcaaaaactccatgatgctcttgaagaagtcggtattaaggacaaaagattcattgttgatactggtcgtagtggtgttgatgtacgtgaagaattcgatgttaaccaaacctggtgtaatttaatttatgctggtttaggtgaaccatcacgtggaagtccagatccagaaaatatgccattattagatgctttcatgtggctcaaaccaccaggtgaagctgatggttctgacactggttctagagctgatccagtttgtggacgtgaagattcattcccaggttctccagatgctggttcatggttcggagaatacttt

SEQ ID NO: 14878 - DNA, 301 bp, Neocallimastix californiae
  Beta_cellobiohydrolase
atacaccatttctggtaatccattcaagggtgttgaattctacatcaatccatactatgttgaagaagttgatggagctattgctcaaatgtctgattcttccctcattgctaaggctgaaaagatgaagacttactctaatgctatttggttagatactattaagaatatgcaaagttggttagaatctaacttacaaggagctcaatctcaacaccaaagtagtggtaaggatatcttaacagttttcgttgtttatgatttaccaggtcgtgattgtcacgctcttgcctctaacggt

SEQ ID NO: 14879 - DNA, 1102 bp, Neocallimastix californiae
  Beta_cellobiohydrolase
caccattgaaggtaatccatttgctaatgtcgaattttacattaatccatactatgttgaagaagttgataatgccatctcccaaatgtctgactcttcccttattgctaaggccgaaaagatgaagacctactctaatgctatttggttagataatattaagaatatgcaaagttggttagaaccaaacttaaagggtgctctctctcaacaaaacagtggtggtactccagttttaactgtctttgtcgtttacgatttaccaggtcgtgattgtcacgctcttgcctccaatggtgaacttcttgccaatgactctgatatggaacgttataagtcagaatacattgatgtcattgaaggccacttaaagacttacaagtctcaacccgttgttcttgttattgaaccagattcccttgctaatatggttactaacattgaaagtactccagcttgtgctgattctcaaacttactattatgatggacacgcctacttacttaagaagcttggtgtcttccccaatgtagccttatatcttgatattggtcatgccttctggttaggttgggatgataaccgtgaaaaggctgcaaaggtttattctaaggttattcaatctggttctccagcaaaggttcgtggtttcgttgataatgttgctaactacactccatgggaagacccaactctttcacgtggtccagatactgaatggaacccatgtccagatgaaaagagatacttggaggctatgcacaaggacttcaaggcagctggtattcaatctgtctacttcttctctgattcatctcgtaacggtaagaagactgaccgtaaacacccaggtgaatggtgtaaccaaactggttgtggtgtcggtgcaagaccaaaagcaagtccaatctctggtatggaataccttgatgccttctattgggttaagccaatcggtgaatctgatggtacctctgatactagtgctaaacgttatgatggttactgtggtcacgaaactgccatgaaaccagctccagaagccggtcaatggttccaaaaattcttcgaagaaggtatcaagaacgccaatccaccactt

SEQ ID NO: 14880 - DNA, 271 bp, Neocallimastix californiae
  Beta_cellobiohydrolase
tgaacaatatactcacaatggtaatccattcgcaaataaggatttctatattaatccatactatgtcgaagaaattgaaggtgctattgctcaaatgtctgattcttcccttattgctaaggctgaaaagatgaagacttactctaatgccatctggcttgattccatcaaaaatatgcaaagttggttagaaactaatttgaagggtgctctttctcaacaaaatgcttctggtaaagatgttttaaccgttttcgttgtttacgattta

SEQ ID NO: 14881 - DNA, 1087 bp, Neocallimastix californiae
  Beta_cellobiohydrolase
agaaggctctggcaatccatttaaagacgctgaattctacattaatccatattatactactgaagttgatgctgccattactaaaataagtaacgcttctcttattgctaaggctgaaaaaatgaaggaattctcaaatgccatttggttagattctattaaaaatatgaacgaattgcttgaaagcagtttaaatggtgctcttgctcaacaagaaagtggatataagaaagttttaaccgtttttgttgtttacaatttaccaggtcgtgattgtcatgctcttgcttctaatggtgaacttcttgccaatgatgctgactttgatcgttacaagtctgaatacattgatgttattgaaggtcacttaaagacttacaaatctcaaccagttgttcttattgttgaaccaaattcacttacaaacttagtgactaaccttgaatctactccagcttgttctgattccgaaaaatactatcgtgaaggaaatgcttacttaattaagaagtttggagttttaccacacgttgctctatatcttgatattggtcatgcctatttattaggttgggatgatactcgtgaaaaagctgctagactttaccatgatgttattagatcaggtgctccaggtaatattcgtggttttgctgataatattggtggcttcgttccatgggatgatccaaatctttctaatggaccagaaactgaatggaatccatgtccagatgagaagagatacttaaaagctatgtacagcgatttcgtgtctgcaggtattcatagcgttaaattcgttactgatacttcacataatggtaagaagtttgattatagtgatagggaattatggtgtaaatcaacatctgctggtgttggtgctagaccaatggctattccaattactactatagattatcttgatgctttctattggattaagccatttggtaacgtatctgaattaccaaatcaaagtagctttgataatgtttgtaaagatggtttagaaatatattcaagcgatacctggagtcaaaaggtctttgaagaaggtattaggaatgctaatccaccactc

SEQ ID NO: 14882 - DNA, 1083 bp, Neocallimastix californiae
  Beta_cellobiohydrolase
cgtatatgaagatgctgaagatttcttcgttttcccagactatcaaaagcaagttaagagttcatacgataaattaatagctgaaggtgaaacagaagttgcagaaattgttgccaaggttgctagatacccaactccaacttggttagccaacacagcggcttccaaactcgttccaaaggttttagcccaagttactgaacaaatgaaacagactggtaagaagattttaacttctttcattatttacaatttaccaaacagagattgttctgctgttgcctcaagaggtgaattaggtacagaacatcttggtgtctataaagaatggattgatgaaattgcaggttattttgccgctcatgaaggaccaattgttgcaattattgaaccagatgcccttggtaatatggttggtaatagtaacagtgaactttgtgctgaagcttttgaaactcaaatggaagctcttgtctatgccattacaaaacttaacttaccaaatgttagtgtttaccaagatgttgcccaagttggttggttaggttggggtggtaacatgagattacttattccaattcttgaacaactcttaaacaaagtcggtactggtgttttacgtggtttcagttctaacatttctaataatcaaccattaacaaaaccagatccaccagaaaaaactttaagtggctgcacaagtcaaagtgaatatgaatacagtttgaatgttagagaagccttaagaaaagttggtatggtagactttggatgggttgttgatacctctcgtaatggtgttccaaatattaagactaagggtgaaaattggtgtaatattaagggtgctggtattggtagaagaccagaagctacaccagaagatttacctggtcttgatgctgtttactggttcaaaccaccaggtgaatctgatggtagtgacagagaaggacaatttggttatgatccaatgtgtgctagtgaagattctcttacggattctccaagagctggtcagtggttccacaagcaatttgttgaattagctgtaaatgctaacccatccttcaaggatgaacc

SEQ ID NO: 14883 - DNA, 991 bp, Neocallimastix californiae
  Beta_cellobiohydrolase
tggtgacaacttctttgaaaatgaactttacagtaacttcaaattccaaggtgaagttgattcttccattaaaaagttaagtggtaatgttaagcaaaaggccgaaaaggtaaaatatgttccaacggctgcttggttagcttgggaaggtgcccccaatgaagttccacaataccttgatgaagctggctcaaagaccgtggtcttcgtcttatatatgattccaactcgtgattgtaatgctaatgcctctgctggtggtacagccaatattgataagtacaagtcctacgtggataagatttacaacaccattaacaaatatccaaactctagaattgttatgattcttgaaccagatactattggtaaccttgtcactgctaacaatgccaactgtagaaatgtccaaaatatgcataagcaagctctctcctacgccatcagtaaatttggtactcaaagtaatgtaagagtctatcttgatgccgctcacggtgcctggttaaacccacacgcggataagaccgctcaagtaattaaggaaatcttaaacaatgctggtaatggaaaacttcgtggtatcagtaccaatgtttctaactaccaaagcgttgccagcgaatacaaataccatcaaaaccttaacagagctcttgaaaaccttggtgtcagaggcttaaagtttattgttgatacctctcgtaacggtgctaacgttgaaggtgccttcaatgcctccggtacctggtgtaacttcaagggtgccggtttaggtgaacgtccaaagggtaatccaaacccaggtagtatgccattacttgatgcctacatgtggattaagactccaggagaagctgatggttcctctcaaggttctagagctgatccagtttgtgctcgtggtgattctcttcaaggtgctccagatgctggttcatggttccatgattactttgtcatgttgattaacaatgccaacccacctttc

SEQ ID NO: 14884 - DNA, 991 bp, Neocallimastix californiae
  Beta_cellobiohydrolase
ctccttcttcagttccggaaatatttacagtaatagtcaataccaaagtgaagttcaatcatctattaacaaattaagtggtgaattacagcaacaagcttctagagtaaaatacaccccaaccgctgtttggttagcttggtatggtgctccaaatgaagttccaaaacatcttggggctgctggtggtaacactgctgtcttcataatgtactggattccaactcgtgattgtaacagtaatgcctctcaaggtggtgctagcgacttaaattcttacaagaattatgtcgatagtgtttataacaccttcagatctaacggtaacagtagaatcgttattgttattgaaccagatactattggtaacatagtgacttctcaagggaatgaaaattgtagaagaactgctattattcataaggaagcccttgcatatgccgttaacaaatttggtagtcttaacaatgttcaagtttatcttgatgccggtcacagccaatggttaaccggttatgaagatgaaactgctgctattattaaagaaattttagatatggcaccacaaggtaagattcgtggattctccactaatatttctaacttccaacccgttcaaagagaatatgaatatcatactcgtctttatgatgctcttgaaaaggttggtatcagcaatatgagatttattgttgatactagtcgtaatggggttgatatcagtgaagcctttgctaagactaagacctggtgtaactttgttggtactggttttggtgaacgtccaaagggtaatccagatcctataaatatgccattattagatgcttacatgtggttaaagccaccagcagaatctgatggttcttctcaaggtatgcgtgctgatccagtctgtgctcgtcctgattctcttccaggagctccagaagctggtcaatggttccacgattattttgttcaattattaagaaatgcaaatccaaaattc

SEQ ID NO: 14885 - DNA, 1105 bp, Neocallimastix californiae
  Beta_cellobiohydrolase
aattaccctcaacggtaatccattcgccaataaaatcttctacattaatccttattatgttgaagaagttgatggtgccattgctcaaatgattgatgcttctcttatttcaaaggctgaaaaaatgaagactttctcaaatgctatttggcttgatactatcaaaaatatgcaaagttggttagaacctaatttaaagggagcccttgctcaacaaaagtctgccggaaaggaagttttaacggttttcgttgtttacgatttaccaggtcgtgattgtcatgctcttgcttccaatggtgaacttcttgctaataaaggagattgggctcgttacaagtccgaatatattgatgtcattgaagaaaagttaagaacttacaaatctcaacccgtcgttcttattgttgaaccagattcattggctaacatggtcactaatcttgattctactccagcttgtcgtgattctgaaagatattacatggatggccatgcctacttaattcaaaaattcggtgttcttccacatgttgctatgtatcttgatattggtcatgccttctggttaggatgggatgataatcgtcaaaaggccggaaaggtctattccaaggtgattcaatctggagcaccaggtaaagttcgtggtttcacggataatgtggctaactacactccatgggaagatccaaccctttctcgtggaccagaaaccgaatggaatccatgtccagatgaaaagagatacttagaagctattcacaaggacttcacggctgtaggcattccatcggtttactttgtttgtgatacttctcgtaatggtaaaaaggttgatcgtaagcatccaggagaatggtgtaaccaaactggagttggtattggtgccagaccacaagccagtccaatttccggtatgccataccttgatgccttttattggattaagccacttggtgaatctgatggtacctctgataccagtgctgctcgtttcgatggttactgtggacatgaaactgccatgaagccagccccagaagccggtcaatggttccaaaagcactttgaacaaggtcttaaaaatgctaatccaccactc

SEQ ID NO: 14886 - DNA, 1111 bp, Neocallimastix californiae
  Beta_cellobiohydrolase
atactctctctctggtaacccattcgctggtcacaagttctacgttaatccatactacgttgataaagttgacaaggccattgctcaaatgcacgactacgacagttcacttaaatttaaggccgaaaagatgaaggaatactctaacgctatttggttagataccattaataacatggaagcctggttagaaagaaaccttaagggtgctcttgctcaacaaaatgccgaaggtagtagagttttaactgtcttcgtcgtttacgatttaccaggccgtgactgtcaggctcttgcctccaacggtgaacttctcgccaacaatggtgatatgaaacgttacaaatctgaatacattgatatcattgatagacgcttatctacttacaagtctcaaccaattgttcttgttattgaaccaaattcccttgctaacttagttactaaccttgaaaacattccagcttgtgctgactctgaaaaatactacttagatggtcacgcttacttaattaagaagttcggttcccacccacacgttgccatgtacctcgatattggtcacgctttctggttaggttgggatgataaacgtgctagtgccgctaagatttactctaaagttattaaccctggtgctccaggtaaagttcgtggtttcgcttccaacgtcgctaactacactccatgggaagacccagaactttctcgtggcccagacactgaatggaacccttgcccagatgaaaagagatacatcaaagccatgtacaaggaattcaaggctgccggtatctcctctgtttacttcattgaagatacttctcgtaatggtcacaagacttaccgtaaccactcaggtgaatggtgtaaccaaatgggatctggtattggtgccagaccaaaggcttatccagtttccggtatggaatatctagatgctttctactgggttaaaccatacggtgaatctgatggtacttctgatgaatctgataagagttttgatggttactgtggtcacgcaaccgccatgaagccagctccagaagccggtcaatggttccaaaaattcttcgaagaaggtcttatgaatgctaacccaccactt

SEQ ID NO: 14887 - DNA, 1102 bp, Neocallimastix californiae
  Beta_cellobiohydrolase
atacaagatcaatggtaacccattcaagggtgttgatttctaccttaacccatactacgttgaagaagttgaaaatgctcttaacaatcttattgattcttctcttagatcaaaggttgaaaagatgaagactttctctaatgctatctggcttgataccattaataacatgcaaagttggttagaaccaaaccttaagggtgctcttgctcaacaccaatctactggtaaggatgtcttaactgtctttgttgtttacgatttaccaggtcgtgattgtcacgctcttgcttccaatggtgaacttcttgctaacgatgctgatgctcaacgttacaagaccgaatacattgatgttattgaatctcacttaaagcaatacactgctcaaccagttgttcttattattgaaccagattcacttgctaacatggttactaaccttgatgatccacactgttctcaatctgaatcctactatatggatggtcatgcttacttacttaagaagtttggtgttcttgaccacgttgctatgtaccttgatattggtcacgctttctggttaggttgggatgataaccgtgaaaaggctgctaagctttacaagaaggttattgactctgcttctccaggtaaggttcgtggtttcgttgataatgttgctaactacactccatgggaagacccaactctttctcgtggtccagatactgactggaacccatgtccagatgaaaagagatacttagaagctgttaagaaggactttacttctgctggtattaagtctgtttacttcgtcagtgatacttctcgtaatggtcacaagaccgaccgtaagcacccaggtgaatggtgtaaccaaactggtgttggtgttggtgctcgtccacaagctagtccagtttctggtatggattaccttgatgctttctactggattaagccacttggtgaatctgatggtacctctgatgaatctgctgttcgtttcgatggttactgtggtcacgataccgctatgaaaccagctccagaagccggtcaatggttccaagctcacttcgaacaaggtgttgaaaacgctaacccaccactc

SEQ ID NO: 14888 - DNA, 1105 bp, Neocallimastix californiae
  Beta_cellobiohydrolase
attcaagatcagtggtaacccattcaagggtgttgatttctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaaccttaagggtgctcttgctcaacaccaatctactggtaaggatgtcttaactgtctttgttgtttacgatttaccaggtcgtgattgtcacgctatggcttccaatggtgaacttcttgctaacgattctgatgctcaacgttacaagactgaatacattgatgttattgaaagtcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatggattaccttgatgctttctactggattaagccacttggtgaatctgatggtacctctgacgaatctgctgatcgtttcgatggttactgtggtcacgataccgctatgaaaccagctccagaagccggtcaatggttccaaaagcacttcgaacaaggtcttgaaaacgctaacccaccactt

SEQ ID NO: 14889 - DNA, 1105 bp, Neocallimastix californiae
  Beta_cellobiohydrolase
atacaagatcagtggtaacccattctctggagttgaattctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaatcttaagggtgcactttcacaacaccaatctactggtaaggatgtcttaactgtctttgttgtttacgatttaccaggtcgtgattgtcacgctcttgcttccaatggtgaacttcttgctaacgattctgatgctcaacgttacaagactgaatacattgatgttattgaaaaacaattaaagcaatacactgctcaaccagttgttcttattattgaaccagattcacttgctaacatggttactaacattgaaaccactccagcttgtgctgaatctcaagattactacttcgatggtcacgcttacttacttaagaagttcggtgttcttgaccacgttgctatgtaccttgatattggtcacgctttctggttaggttgggatgataaccgtgaaaaggcctctaaggtttacaagaaggttattgactctggttctccaggtaaggttcgtggtttcgttgataacgttgctaactacactccatgggaagacccaactctttctcgtggtccagaaactgaatggaacccatgtccagatgaaaagagatacttacaagctatgtacaaggactttaccgctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatggttactgtggtcacgataccgctatgaaaccagctccagaagccggtcaatggttccaaaagcacttcgaacaaggtcttgaaaatgctaacccaccactc

SEQ ID NO: 14890 - DNA, 1093 bp, Neocallimastix californiae
  Beta_cellobiohydrolase
tcaatattctcataatggtaatccattcaaggatgttgaatttttcattaatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacatcagatgaaagtgcagctcgtttcgatggttattgtggacatgaaacagccatgaaaccagcaccagaagctggtcaatggttccaaaagcactttgaacaaggtattaagaatgcc

SEQ ID NO: 14891 - DNA, 1105 bp, Neocallimastix californiae
  Beta_cellobiohydrolase
tcaatattctcataatggtaatccattcaaggatgttgaatttttcattaatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacctcagatgaaagtgcagctcgtttcgatggttattgtggacatgaaacagccatgaaaccagcaccagaagctggtcaatggttccaaaagcactttgaacaaggtattaagaatgccaatcctccactt

SEQ ID NO: 14892 - DNA, 1108 bp, Neocallimastix californiae
  Beta_cellobiohydrolase
acagtacactcacaatggtaatccatttgctaataagattttctatattaacccatactatgttgaagaagtggatggtgctatcgctcaaatgtctgattcttccttgatttctaaggctgaaaagatgaagacttactccaatgctatctggcttgattccatcaaaaatatgcaaagttggttggaatcaaatttaaaaggtgctctctcccaacaaaatgcctctggtcaagatgttttaactgttttcgttgtctacgatttaccaggtcgtgattgtcatgctcttgcttctaatggtgaacttcttgccaatgatagtgattgggctcgttataagactgaatatattgatgtcattgaaggtcacttaaagacttacaaatctcaaccagttgttcttattattgaaccagattcacttgcaaatatggttactaatcttgattctactccagcttgtcgtgattccgaaaagtattacatggatggtcatgcttatttaattcaaaagtttggtgttcttcctcacgttgctatgtatcttgatattggtcacgccttctggttaggttgggatgataatcgtcaaaaagctggtaaggtctactccaaagttatcagctctggtgctccaggtaaggttcgtggattcactgataatgttgctaactacactccatgggaagatccaactctttctcgtggaccagaaactgaatggaatccatgcccagatgaaaagagatatttagaagctatgtataaagactttaaggccgctggtattgaatccgtttacttcgtttgtgactcttctcgtaatggtaagaaagttgatcgtaaacacccaggtgaatggtgtaaccaaactggtgctggtgttggttatagaccacaagccaatccaatttcaggtatgagttatcttgatgctttctactggattaagccacttggtgaatccgatggtacttctgatgaaagtgcagctcgtttcgatggctactgtggacatgaaactgccatgaaaccagctccagaagccggtcaatggttccaaaagttctttgaggaaggtcttaagaatgctaatccagctctt

SEQ ID NO: 14893 - DNA, 1003 bp, Neocallimastix californiae
  Beta_cellobiohydrolase
cactagaagaccagctcaaactagtgataacttctttgaaaatgaactttacagtaacttcaagttccaaggtgaagttgatacatctattgctaaattaagtggtcaattacaagaaaaggctaaaaaggttaagtacgttccaactgctgcttggttagcttgggaaggtgccactaatgaagttccacaataccttaatgaagctggtgacaagactgttgtctttgtcttatatatgattccaactcgtgattgtaacgctaatgcttctgttggtggatctggtagtttagacaagtacaagggttatgtcgacaacatttacaacactattaacagatatccaaattcaagaattgttatgattcttgaaccagatactattggtaatcttgttactgctaacaatgataattgtagaaacgttcaaaacatgcacaaacaagctctttcttacgccattagtaaattcggtactcaaagtaatgttagagtttatcttgatgctgctcacggtgcttggttaaattcacacgccgatagaactgctcaagttattgctgaaatcttacgtaatgctggtaatggtaagattcgtggtattagtactaacatttctaactaccaacaagttagtgatgaataccaatatcaccaaaaccttaacagagctcttgaaagccaaggtttcagaggtatgaaattcattgttgatacttctcgtaatggtcaaaatgttactgctgccttctctagaaacaacacctggtgtaacttcaagggtgctggtttaggtccacgtccacaagccaatccaaatccaaacatgcctttacttgatgcttacatgtggattaaaactccaggtgaagctgatggttctgctactggttctagagctgatccagtttgtgctagacaagattctcttcaaggtgctccagatgctggttcatggttccacgattactttgttatgttattacaaaacgctaaccca

SEQ ID NO: 14894 - DNA, 934 bp, Neocallimastix californiae
  Beta_cellobiohydrolase
taaatttgaaaacttcttcgaaaatgaactttacattaaccaagattacgttaaaaagattgaatctactttaaaggatatgactccagaattacaagctaaggctaagaatgttgaaaaggttgcaactgctgtttggttagcttgggaaggtgctccaggtgaagttgaaccacaccttaaggctgctggtaacaagactattacctttattctttacatgattccaactcgtgactgtaatagtttagcttcagctggtggtgctgctgattttgaaaaataccaaggttatgttgacagtattgctgctactattaagaaatacccagatgctaaggttaacatggttattgaaccagatactcttggtaaccttattactggtgaaactgaagcttgtaagaaggttcatgacttacacagaaaagctttatcttacgccgttaacgttttcggtaacatgagtaatgttaatgcttatcttgatgctgcccaccacaaatggttaggttggggaacagacaaggttgctgctctcattaaggacattttagataatgctccagatggtgatattcgtggtattagtactaatgtttctaactaccaatccattgataatgaataccaataccacactgaccttcacgctgctcttgaagctgtcggtattactggaaagaaattcattgttgataccggtcgtagtggtgttgatgttactgaagaattcaatgttaaccaaacctggtgtaaccttatctacgctggtttaggtgaaaaatctcgtggtaacccagatccagaaaagtacccattattagatgccttcatgtggcttaaaccaccagcagaatctgatggttctgatgttggtagcagagctgatccagtttgtgctcgtgaagattcattcccaggtgctccagac

SEQ ID NO: 14895 - DNA, 1083 bp, Neocallimastix californiae
  Beta_cellobiohydrolase
tgcttttgctgaagctgatgacttctacgttttcccagattatcaaaaacaagttaagagttcatacgatcaattaattgctgaaggtcaaaacgatgttgctgaaattgttgctaaagttgctagatatccaactccaacttggttagctaatactcaagcttccaaacttgttccaaaggtcttagctcaagttactgaacaaatgaaggctaccggcaaaaagattttaactgctttcattatttataatttaccaaacagagattgttctgctgttgcttcaagaggtgaattaggtattgaacatcttggtgtttacaaggaatggattgatgaaattgcaggttattttaaagctcacgaaggaccaatcgttgctattattgaaccagatgcccttggtaatatggttagtaacagtaatagtgaactttgtgctgaagctttcgatactcaaatggaagctattgtttatgctattaataaacttagcttaccaaatgttagtgtttaccaagatgtagctcaagttggttggttaggttggactggtaacatgaatattcttgttccaattcttgaacaaatcttaaacaaggttggtacaggtaaattacgtggtttcagttctaacatttctaataatcaaccattagttaaaccagatccaccagaagctactttaagtggtaacaagagtcaaagtgaatatgaatacagtttgaatgttagagaagccttaagaaaggttggtattgccgatatgggttgggttgttgatacttctcgtaatggtagaactaacattaagactagaggtgaaaactggtgtaatattaagggtgctggtattggtagaagaccagaagctaatccagctgatttaccagaacttgatgctgtttactggtttaagccaccaggtgaatctgatggtagtgacagaaagggacaatggggttatgatccatcttgtgctagtgaagattctcttactgattctccaatggccggtcaatggttccataaacaatttgttgaattagctgttaatgctgttccatcattcgaagatgaacc

SEQ ID NO: 14896 - DNA, 477 bp, Neocallimastix californiae
  Beta_cellobiohydrolase
tttctctggtaacccattcgctggtcacaagttctacattaatccatactacgttgacgaagttgacaaggccattgctcaaatgaacggttcacttagaattaaggccgaaaagttgaaggaatactctaacgctatttggttagataccatccataaaatggaagtacgattagaaagaaaccttaggggtgctcttgctcaacaaaatgccgaaggtagtagagttttaactgtcttcgtcgtttacgatttaccaggtcgtgactgtcaggctcttgcctccaacggtgaacttctcgccaacgatggtgatatgaaacgttacaagactgaatacattgatatcattgatagtgtcttaattagttaccattctcaaccaattgttcttgttattgaaccaaattcccttgctaacttagttactaaccttgaaaacattccagcttgtgctgactctgaaaaatactactt

SEQ ID NO: 14897 - DNA, 348 bp, Anaeromyces robustus
  Beta_cellobiohydrolase
atacaagatcagtggtaacccattctctggagttgaattctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaatcttaagggtgcactttcacaacaccaatctactggtaaggatgtcttaactgtctttgttgtttacgatttaccaggtcgtgattgtcacgctcttgcttccaatggtgaacttcttgctaacgattctgatgctcaacgttacaagactgaata

SEQ ID NO: 14898 - DNA, 1105 bp, Anaeromyces robustus
  Beta_cellobiohydrolase
atacagacacaatggtaacccattcaaaggtgttgaattcttcattaacccatactatgttgatgaagttgataaggctattgctcaaatgaccaactcatctcttaaggctaaggctgaaaagatgaagactttctctaacgctatttggctcgataccattaagaacatgaatgaatggttagaaagaaaccttaagggagctcttgctcaacaaaacgcttctaacaagaatgttttaactgttttcgttgtttacgatttaccaggtcgtgattgtcacgctcttgcttctaatggtgaacttcttgctaatgattctgactttgctcgttacaagtctgaatatattgatgttattgaaactcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatggttactgtggtcacgataccgctatgaaaccagctccagaagccggtcaatggttccaaaagcacttcgaacaaggtcttgaaaatgctaacccaccactc

SEQ ID NO: 14899 - DNA, 969 bp, Anaeromyces robustus
  Beta_cellobiohydrolase
cactagaagaccagctcaaactagtgataacttctttgaaaatgaactttacagtaacttcaagttccaaggtgaagttgatacatctattgctaaattaagtggtcaattacaagaaaaggctaaaaaggttaagtacgttccaactgctgcttggttagcttgggaaggtgccactaatgaagttccacaataccttaatgaagctggtgacaagactgttgtctttgtcttatatatgattccaactcgtgattgtaacgctaatgcttctgttggtggatctggtagtttagacaagtacaagggttatgtcgacaacatttacaacactattaacagatatccaaattcaagaattgttatgattcttgaaccagatactattggtaatcttgttactgctaacaatgataattgtagaaacgttcaaaacatgcacaaacaagctctttcttacgccattagtaaattcggtactcaaagtaatgttagagtttatcttgatgctgctcacggtgcttggttaaattcacacgccgatagaactgctcaagttattgctgaaatcttacgtaatgctggtaatggtaagattcgtggtattagtactaacatttctaactaccaacaagttagtgatgaataccaatatcaccaaaaccttaacagagctcttgaaagccaaggtttcagaggtatgaaattcattgttgatacttctcgtaatggtcaaaatgttactgctgccttctctagaaacaacacctggtgtaacttcaagggtgctggtttaggtccacgtccacaagccaatccaaatccaaacatgcctttacttgatgcttacatgtggattaaaactccaggtgaagctgatggttctgctactggttctagagctgatccagtttgtgctagacaagattctcttcaaggtgctccagatgctggttcatggttccacga

SEQ ID NO: 14900 - DNA, 304 bp, Anaeromyces robustus
  Beta_cellobiohydrolase
atacaagatcaatggtaacccattcaagggtgttgatttctaccttaacccatactacgttgaagaagttgaaaatgctcttaacaatcttattgattcttctcttagatcaaaggttgaaaagatgaagactttctctaatgctatctggcttgataccattaataacatgcaaagttggttagaaccaaaccttaagggtgctcttgctcaacaccaatctactggtaaggatgtcttaactgtctttgttgtttacgatttaccaggtcgtgattgtcacgctcttgcttccaatggtgaa

SEQ ID NO: 14901 - DNA, 1083 bp, Anaeromyces robustus; identical to SEQ ID NO: 14895
  Beta_cellobiohydrolase

SEQ ID NO: 14902 - DNA, 654 bp, Anaeromyces robustus
  Beta_cellobiohydrolase
taaaccagttacttctaattctgaaaacttctttgataatgaactttacattaaccaagattacgttaaaaagattgaatcatctttaaaatctatgtctccagaattacaagctaaggctaagaatgttgaaaaggttgcaactgctgtttggttagcttgggaaggtgctccaggagaagtcgctccacaccttaaggctgctggtaacaagactattacctttattctttacatgattccaactcgtgactgtaacagtttagcttcagctggtggtgctgctgactttgaaaaataccaaggttatgttgacagtattgccgctactattaagaaatatccaaatgctaaggttaacatggttattgaaccagatactcttggtaaccttattactggtgaaactgaagcttgtaagaaggttcatgacttacacagaaaagctttatcttacgctgttaacgttttcggtaacatgagtaatgttaatgcttatcttgatgctgcccaccacaaatggttaggttggggaacagacaaggttgctgctcttatcaaggacattttagacaatgctccagatggtgatattcgtggtattagtactaatgtttctaactaccaatccattgaaaatgaataccaatacca

SEQ ID NO: 14903 - DNA, 984 bp, Anaeromyces robustus
  Beta_cellobiohydrolase
taaatttgaaaacttcttcgaaaatgaactttacattaaccaagattacgttaaaaagattgaatctactttaaaggatatgactccagaattacaagctaaggctaagaatgttgaaaaggttgcaactgctgtttggttagcttgggaaggtgctccaggtgaagttgaaccacaccttaaggctgctggtaacaagactattacctttattctttacatgattccaactcgtgactgtaatagtttagcttcagctggtggtgctgctgattttgaaaaataccaaggttatgttgacagtattgctgctactattaagaaatacccagatgctaaggttaacatggttattgaaccagatactcttggtaaccttattactggtgaaactgaagcttgtaagaaggttcatgacttacacagaaaagctttatcttacgccgttaacgttttcggtaacatgagtaatgttaatgcttatcttgatgctgcccaccacaaatggttaggttggggaacagacaaggttgctgctctcattaaggacattttagataatgctccagatggtgatattcgtggtattagtactaatgtttctaactaccaatccattgataatgaataccaataccacactgaccttcacgctgctcttgaagctgtcggtattactggaaagaaattcattgttgataccggtcgtagtggtgttgatgttactgaagaattcaatgttaaccaaacctggtgtaaccttatctacgctggtttaggtgaaaaatctcgtggtaacccagatccagaaaagtacccattattagatgccttcatgtggcttaaaccaccagcagaatctgatggttctgatgttggtagcagagctgatccagtttgtgctcgtgaagattcattcccaggtgctccagacgctggttcatggtttaaggaatatttcattgctatgttagaaaaatctcc

SEQ ID NO: 14904 - DNA, 762 bp, Anaeromyces robustus
  Beta_cellobiohydrolase
acaatacactatttctggtaacccattctctggtgttgaattttacattaatccatattatgttgaagaagttgataatgccattgctcaaatgactgattcttctcttaaagctaaagctgaaaaaatgaaaacttatccaaatgctatttggcttgataacattaagaacatgcaaagttggttacaaccaaatcttgaaaaagctcttgctcaacaatctggtagtaaaaaggttttaactgttttcgttgtttacgatttaccaggtcgtgattgtcacgctatggcttccaatggtgaacttcttgctaacgattctgatgctcaacgttacaagactgaatacattgatgttattgaagaacaattaaagaaatacaaatctcaaccaattgtccttattattgaaccagattcacttgctaacatggttactaacattgaaaccactccagcttgtgctgaatctcaagattattactttgatggtcatgcttacttacttaaaaaattcggtgtcttacaacatgttgctatgtaccttgatattggtcacgctttctggttaggttgggatgataaccgtgaaaaggctgctaaggtttacaagaaagttattgattctggttctccaggtaaggttcgtggtttcgttgataacgttgctaactacactccatgggaagacccaactctttctcgtggtccagatactgaatggaacccatgtccagatgaaaagagatacttagaagctat

SEQ ID NO: 14905 - DNA, 1009 bp, Anaeromyces robustus
  Beta_cellobiohydrolase
gacttacccaactgttaatccttccttcttcagtggaaatatttacagtaattaccaatatcaatctgaagtccaatcttctattaacaaattaagtggtaatttacaacaacaagctaatagagttaaatacgttccaactgctgtttggttagcttgggatggtgcaccaaaagaagttcaaagacaccttagttccgctaatggcagtactgctgtctttattatgtactggattccaactcgtgattgtaacagtaatgcttctcaaggtggtgctaatgatttaaatgcttacaaatcttatgttgatgatgttgctaatacctttagatctaatcaaggtagtagaattgttattgttgttgaaccagatactattggtaatatggttacttctcaaaacaatgaaaattgtagaagaactgcagttattcacaaacaagctcttgcttatgctgttaatagatttggtagtcttaataatgtacaagtttatcttgatgctggtcacagtcaatggttaactggttatgaagatgaaactgctgctgttattaaggaaattttagatatggctaatcaaggtaagattcgtggtttctctactaatgtttctaacttccaaccaattgataaggaatacgaatatcaaactagactttatgatgctcttgaaaatgttggtattactgatatgagatttgttattgatactagtcgtaatggtcaagatattagtgaagctttcgctaaaactaaaacttggtgtaatttagttggtactggttttggtgaacgtccaaagggtaatccagatccaattaatatgccattattagatgcttacatgtggttaaaaccaccagcagaatctgatggttcttctcaaggtatgcgtgctgatccagtttgtgctcgttctgattctcttccaaatgctccagaagctggttcatggttccatgactatttcgttcaattattgagaaatgccaatccaccattt

SEQ ID NO: 14906 - DNA, 1083 bp, Anaeromyces robustus
  Beta_cellobiohydrolase
tgtttatgaagatgctgaagaattttatgttttccctaattatcaaaaacaagttaaaagttcttatgatcaattaattgctgaaggtgaaccagaaattgctgaaattgttgctaaagttgctaaatatccaactccaacctggttaacaaacactgatgctgctaaacttgtaccacaagttttatctcaagttactaaacaaatgaaaaaaactggtaaaaaaattttaacttctttcattatttataatttaccaaacagagattgttcagccgttgcttctcgtggtgaattaggtattgaacatcttggtgtttataaggaatggattgatgaaattgcaggttatttcaaaaatcatgaaggaccaattgttgctgttgttgaaccagatgcttttggtaatatgattaatagtaatgataatgaactttgtaaggaagcctttgatactcaaatggaagctcttgtttatgctattactcatcttaatgctccaaatgttggtgtttatttagatcttgctcaagttggttggttaggttggagtggtaatatgcgtttccttattccacttcttgaagaagttcttaataaggttggtacaggtattttacgtggtttcacttctaatatttctaattatcaaccattagttaaaccagaagttccagaagttactttatccggtaatccaagtcaaagtgaatatgaatatagtttgaatgttagagaagccttaaagaaaattggtatggttgattttggttgggtagttgatacttctcgtaatggtgtatctaatattaaaactaaaggtgaatcatggtgtaatattaaaggtgcaggtataggtagaagaccagaagctaatccaccagatttaccaggacttgatgctgtttattggtttaaaccaccaggtgaatctgatggtagtgatagaaaaggtcaatggggttatgatccatcttgtgaaagtgttgattctcttactgattctccaatggcaggtcaatggtaccataaacaatttgttgaattagctgttaatgctaatccatcatttaaagatgaacc

SEQ ID NO: 14907 - DNA, 954 bp, Anaeromyces robustus
  Beta_cellobiohydrolase
ttctaataatgttaatccatttgctgaaagtgaattatatgttgatccaaattaccaacaagaacttgataatcttagttcaactataaaggatccaactgttattgaaaaagttgaaaaaatgaaacaatattctactggtatttggttagattctattcaatctgttaatgaattattagaaagtaatttagataatgcttatgctcaacaagtagaaagtggtaaaaatgttttaactacttttgttctttataatttaccaggtcgtgattgtcatgctattactacaaatggtgaacttcttgctaaagattctgatttagaacgttataagcatgaatatattgatgttattgaagaaattataaagaaacataataatcaaccaattgcttttgttgttgaaccaacttctcttccaagtatagctacttttaaaaaaagtactccagcttgtgctgatacagaaaaatattatttagaaggtcattcttatttaattaaaaaacttggtgtattaccaaatgtctttttatatcttgatgttggtcatgctttctggttaggttgggatgatcttcgtgaagaaactgctaaactttatgctaaagttattcaatctggtgctccaggtattgttcgtggttttgctgataatatttcaaattatgttccatgggatgatgctaatcttactaatggtccaaatactgaatataatccatacccagattcaaaaagatatattgaatctttacgtaaagattttgtaagtgttggtattaaaaatgttaatttcatttctgatacttcccttaccactattaataatggttctagtcctgttgaagattggtgttataatgctcctcttggtattggtgctcgtccacaagctaatccagtttcagatatgtcttatcttgatgcttttgtttggattaaaccatt

SEQ ID NO: 14908 - DNA, 1008 bp, Anaeromyces robustus
  Beta_cellobiohydrolase
atcaaatgacgatccagataatttcttcaataataagatttactgtaaccaagaccgtaaagatcgtgttcaatcttctattaatagattaagtggtgaattaaaagctaaagcccaaaaaatccaagacgccccaacagctatttggttatcttgggataaagcaccagaaacagtttcgttccatcttgatgaagctggtaatcaaacagccgttttcattttatattggattccaactcgtgattgtaacagtatcgcctctcaaggtggtgctcaaagcatggatgaatatcacacttatgttaacagaattgttaacggtttcaaaagtcatccaaacagtaagatcgttgttgttgttgaaccagatactcttggtaatatgattacttctcaaagtaatgataattgtaaaaaggttcacaatcttcataaacaagctattgcttacgctattgatacctttggtcaaattgacaatgttcgtacttatattgatgctgctcatggtagatggttaggttcacatgctgatgaagcagctgctattattaaagaaattattgatatggcaccaaacagtaatgttcgtggtttatctactaatgtttctaactaccaaccaactgaagatgaatatgcttaccatcaaaaacttagcgctgagcttgaaaagcttggtgttcataatatgaaatttattgttgatactgcccgtaatggtgtagatgtcgcagaatctttagttaaaactggcacttggtgtaatgttaaaggtacaggttttggtgaacgtccaagaggttccccagacccagttaataaaccattattagatgcttacatgtggttaaaaccaggaggtgattctgatggttcatctactggtgatcatgctgatcctgtttgtgaacatgaagattctttaccaggagctggtgatccaggagattggttccatgaatactttgtacaattactcacaaatgccaacccaccaattga

SEQ ID NO: 14909 - DNA, 117 bp, Piromyces finnis
  Beta_cellobiohydrolase
ttatgatccagtttgtgctagtgaagactcacttactgattcaccaagagctggtcaatggttccacaagcaaattgttgaattagccgtcaacgccaatccatcctttgctgatga

SEQ ID NO: 14910 - DNA, 528 bp, Piromyces finnis
  Beta_cellobiohydrolase
ttatgatgatgctgaagaattctacgttttcccagactaccaaaagcaaatcaagagttcatacgacaagttaattgctgaaggagaaaatgaagttgccgaaattgttgctaaggttgctagatacccaactccaacttggttagctagtactgattccgtcaagcttgttccaaaggttttagcacaagttaccgaacaaatgaagaagaccggtaagaaggttttaacttccttcattatctacaatttaccaaacagagattgttctgctcaagcctccagaggtgaattaggtattgaacatcttggtaagtacaaggaatggattgatgaaattgcaggatactttgcagctcacgaaggaccaattgttgctattgttgaaccagatgccatgggtaacatggttagtcacaatgataatccagtttgtgaagaagcattcgatactcaaatggaagctcttgtctctgccattactaagcttaacatgaagaatgttggtgtttacatggatcttgcaca

SEQ ID NO: 14911 - DNA, 1077 bp, Piromyces finnis
  Beta_cellobiohydrolase
ttatgatgatgctgaagaattctacgttttcccagactaccaaaagcaaatcaagagttcatacgacaagttaattgctgaaggagaaaatgaagttgccgaaattgttgctaaggttgctagatacccaactccaacttggttagctagtactgattccgtcaagcttgttccaaaggttttagcacaagttaccgaacaaatgaagaagaccggtaagaaggttttaacttccttcattatctacaatttaccaaacagagattgttctgctcaagcctccagaggtgaattaggtattgaacatcttggtaagtacaaggaatggattgatgaaattgcaggatactttgcagctcacgaaggaccaattgttgctattgttgaaccagatgccatgggtaacatggttagtcacaatgataatccagtttgtgaagaagcattcgatactcaaatggaagctcttgtctatgccattactaagcttaacatgaagaatgttggtgtttacatggatcttgcacaagttggatggttaggttggagtggtaacatgcgtttccttattccaattcttgaacaactcttaaacaaggttggtactggagttttacgtggtttctcatctaacatttccaacactcaaccattagttagaccagaaactcttgatgttactttagccggtaacccaagtcaaagtgaatacgaatacagtttgaatgtcagagaagaattaaagaagattggtatggttgactttggatgggttgttgatacttcacgtaatggtgtatctaacattaagaccaagggagaatactggtgtaacattaagggatccggtattggtagaagaccagaagccaatccagcagatcttccaggacttgatgctgtttactggttcaagccaccaggtgaatctgatggtagtgacaacaagaacattattggttatgatccagtttgtgctagtgaagactcacttactgattcaccaagagctggtcaatggttccacaagcaaattgttgaattagccgtcaacgccaatccatcctttgctgatga

SEQ ID NO: 14912 - DNA, 1077 bp, Piromyces finnis; identical to SEQ ID NO: 14911
  Beta_cellobiohydrolase

SEQ ID NO: 14913 - DNA, 648 bp, Piromyces finnis
  Beta_cellobiohydrolase
caatgctccaactgaaaacttctttgataatgaactttacattagtccaagatacgttgaagaaattgaatcttccatgccagatatgagcgatgaattaaaggctaaggctaagaatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatga

SEQ ID NO: 14914 - DNA, 987 bp, Piromyces finnis
  Beta_cellobiohydrolase
aagcagccaaaacttcttcttaaacgaaatctatgctaatccaagattcattgaagaaatcgattcttcaattccaaagttaagtggtgatttagctgctaaggccgaaaaggtcaagcaagttccaactgctgtttggttagcttgggatggtgctccaggtgaagttgaaggtcaccttgctgctgctggttctaagactgttgtcttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatccccatt

SEQ ID NO: 14915 - DNA, 990 bp, Piromyces finnis
  Beta_cellobiohydrolase
tgctccaactgaaaacttctttgataatgaactttacattagtccaagatacgttgaagaaattgaatcttccatgccagatatgagcgatgaattaaaggctaaggctaataatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatccccatt

SEQ ID NO: 14916 - DNA, 987 bp, Piromyces finnis
  Beta_cellobiohydrolase
tgctccaactgaaaacttctttgataatgaactttacattagtccaagatacgttgaagaaattgaatcttccatgccagatatgagcgatgaattaaaggctaaggctaataatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaagtctcc

SEQ ID NO: 14917 - DNA, 624 bp, Piromyces finnis
  Beta_cellobiohydrolase
accagatactcttggtaaccttgtaactggtagcagtgaagcctgtaagactgttcacactttacacaaaaacgccttatcttacgctgttaatgtcttcggtgctatgagtaatgtcagtgtttaccttgatgctgctcacggtaaatggttaggtggtgttactgataaggttgccactgttgttaaagaaattttagatggagctccaaacggtaagattcgtggtttaagtactaatgtttctaactaccaaccagttagcgctgaatatggttaccaccaaaagcttgcttcttctctttctgccgttggtgtaagtgatatgcacttcattgttgataccggtcgtaatggtgttgatgtttcatctaccttcagtattaacgaaacctggtgtaactttgttggtactggttttggtgaacgtccacaaggtaacccatctggtatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatccccatt

SEQ ID NO: 14918 - DNA, 1105 bp, Piromyces finnis
  Beta_cellobiohydrolase
atacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 14919 - DNA, 1105 bp, Piromyces finnis
  Beta_cellobiohydrolase
atacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 14920 - DNA, 1105 bp, Piromyces finnis
  Beta_cellobiohydrolase
atacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 14921 - DNA, 1105 bp, Piromyces finnis
  Beta_cellobiohydrolase
atatactcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 14922 - DNA, 1105 bp, Piromyces finnis
  Beta_cellobiohydrolase
atatactcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 14923 - DNA, 1105 bp, Piromyces finnis
  Beta_cellobiohydrolase
atacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 14924 - DNA, 1105 bp, Piromyces finnis
  Beta_cellobiohydrolase
atatactcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 14925 - DNA, 1105 bp, Piromyces finnis
  Beta_cellobiohydrolase
atacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 14926 - DNA, 1105 bp, Piromyces finnis
  Beta_cellobiohydrolase
atacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 14927 - DNA, 1105 bp, Piromyces finnis; identical to SEQ ID NO: 14926
  Beta_cellobiohydrolase

SEQ ID NO: 14928 - DNA, 1105 bp, Piromyces finnis; identical to SEQ ID NO: 14920
  Beta_cellobiohydrolase

SEQ ID NO: 14929 - DNA, 1105 bp, Piromyces finnis; identical to SEQ ID NO: 14919
  Beta_cellobiohydrolase

SEQ ID NO: 14930 - DNA, 1105 bp, Piromyces finnis
  Beta_cellobiohydrolase
atatactcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 14931 - DNA, 1105 bp, Piromyces finnis; identical to SEQ ID NO: 14923
  Beta_cellobiohydrolase

SEQ ID NO: 14932 - DNA, 1105 bp, Piromyces finnis
  Beta_cellobiohydrolase
atatactcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 14933 - DNA, 1105 bp, Piromyces finnis; identical to SEQ ID NO: 14925
  Beta_cellobiohydrolase

SEQ ID NO: 14934 - DNA, 1105 bp, Piromyces finnis; identical to SEQ ID NO: 14918
  Beta_cellobiohydrolase

SEQ ID NO: 14935 - DNA, 1105 bp, Piromyces finnis
  Beta_cellobiohydrolase
atatactcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 14936 - DNA, 991 bp, Piromyces finnis
  Beta_cellobiohydrolase
aactagcgacaacttctttgataatactctctacagtaacttcaagttccaagctgaagttcaatcttctattaacaagttaagtggttccttagctgaaaaggctaagaaggttaagtacgtcccaactgctgcttggttagcttgggaaggtgctccagctgaagttccacaataccttgatgaagctggttccaacactgttgttttcgtcttatatatgattccaactcgtgattgtaacgctaacgcctctgctggtggtagttccaacattgaaaagtacaagggttacgttgacaagatctacaacactattaaccaatatccaaactctagaattgttatgattcttgaaccagatactattggtaaccttgttactgctaacaatgacaactgtagaaacgtccaaaacatgcacaagcaagccctttcttacgctattagtaagttcggtacccaaagtaacgtcagagtttaccttgatgctgctcacggtgcttggttatctagccacgctgacaagactgcccaagttattaaggaaatcttaaacaacgctggtaacggtaaacttcgtggtatcagtactaacgtttctaactaccaaactgttaacgatgaatacaactaccacatgagacttaacagtgccctcgaaaaccttggtgttagaggtatgaaattcattgttgatacttcccgtaacggtgctaacatttctggtgctttcaatgctagtggtacctggtgtaacttcaagggtgctggtttaggtgctcgtccacaaggtagcccagacccaagcaagccattacttgatgcttacatgtggattaagactccaggtgaagctgatggttcttctagcggttctagagctgatccagtctgtgctcgttacgattctcttcaaggtgctccagatgctggttcttggttccatgattacttcgttatgttagtccaaaacgctaacccagccttc

SEQ ID NO: 14937 - DNA, 1105 bp, Piromyces finnis
  Beta_cellobiohydrolase
atacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 14938 - DNA, 1105 bp, Piromyces finnis
  Beta_cellobiohydrolase
atacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacattgaatctactccagcttgtgctaagtctgaaaagtactactacgatggtcacgcttacttaattaagaagttcggtgttcttccacacgtttctatgtaccttgatattggtcacgctttctggttaggttgggatgacaaccgtgaaaaggccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 14939 - DNA, 1105 bp, Piromyces finnis; identical to SEQ ID NO: 14937
  Beta_cellobiohydrolase

SEQ ID NO: 14940 - DNA, 1105 bp, Piromyces finnis; identical to SEQ ID NO: 14938
  Beta_cellobiohydrolase

SEQ ID NO: 14941 - DNA, 1105 bp, Piromyces finnis; identical to SEQ ID NO: 14938
  Beta_cellobiohydrolase

SEQ ID NO: 14942 - DNA, 1107 bp, Piromyces finnis
  Beta_cellobiohydrolase
atacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccacagat

SEQ ID NO: 14943 - DNA, 1107 bp, Piromyces finnis; identical to SEQ ID NO: 14942
  Beta_cellobiohydrolase

SEQ ID NO: 14944 - DNA, 1105 bp, Piromyces finnis; identical to SEQ ID NO: 14937
  Beta_cellobiohydrolase

SEQ ID NO: 14945 - DNA, 1107 bp, Piromyces finnis; identical to SEQ ID NO: 14942
  Beta_cellobiohydrolase

SEQ ID NO: 14946 - DNA, 1105 bp, Piromyces finnis; identical to SEQ ID NO: 14937
  Beta_cellobiohydrolase

SEQ ID NO: 14947 - DNA, 1105 bp, Piromyces finnis; identical to SEQ ID NO: 14938
  Beta_cellobiohydrolase

SEQ ID NO: 14948 - DNA, 1107 bp, Piromyces finnis; identical to SEQ ID NO: 14942
  Beta_cellobiohydrolase

SEQ ID NO: 14949 - DNA, 765 bp, Neocallimastix californiae
  Beta-D-glucan exohydrolase, C-terminal domain
tgttcttttaaagaatgatgaagatattttaccaatttctggtgacaagtacaaaaagattgctatcatcggtgatggtgctcttccaactaagcaatgtactgataatggttgttccgaaggtaagatgtctggtgttgttgctttaggttggggttccggtactaccaacatggaaaacataagtgatccactttctgctcttactgaacgtgctgaaaaggatggtattactatcactagcttcactgatgatgatagtgatacagataaggctgccgaagttgctgctgatgctgatctcgctattgttgttgtagttgctgattctggtgaagagtacattagtgttgaaggtaataagggtgacagaaagaaccttgatttatggcataatggtaatgaattagtttctgctgttgctgctgctaacaagaacactgttgttgttatttactctccaggtgttgttaatttacctttcattgatgaagttaatggtttagtttatgctggtatgccaggtcaagaagctggtcacggtcttgctgatattttatttaatgatgttgctccatctggtaagttaccatttacttggggtaagaaacgtgaagattactgttgtgacgttgttacaggcggtaaaggaaaaactcaagttccatacgaagaaggttattacattggttacaaatggttcgataagaaaaacattgaaccacacttctcctttggtcatggtcttacctatgctaagttcaa

SEQ ID NO: 14950 - DNA, 69 bp, Neocallimastix californiae
  Beta-D-glucan exohydrolase, C-terminal domain
ttggttcgataaaaagggaattgttccaaccttcccattcggtcatggtctttcttacactacttttga

SEQ ID NO: 14951 - DNA, 603 bp, Neocallimastix californiae
  Beta-D-glucan exohydrolase, C-terminal domain
tttattaaagaatgctgattctattttaccattaactaacaaatataagaagattgctattattggtaaggatgctgataaagctcagaaatgtaatgattcagcatgtactaatggtaatattattcaaggatggggttcaggtactactgatttcgttggtgtttctgatccatttagtgcgattaaaaacagagcttctaaagatggtatttctgttgtaagttcactttctgataattctagtgaaggtgctaatgccgcaagaggagctgatgttgctcttgttttcgttagagcttcttctggtgaagaatacattgttgtcgataataacaaaggtgatcgtaacaacttagatttatggcatggaggtaatgatttagtaaagagtgttgctgctgttaataagaataccattgtcgttattcatgctccagctactgttaaccttccattccttgataatgttaaggctgttattcatgctggtatgccaggtgctgaatctggtaatgctattgcctctattttattcggagattctaacccatctggtcatcttccatttacttgggctccaagagaagattactgttgtga

SEQ ID NO: 14952 - DNA, 765 bp, Neocallimastix californiae
  Beta-D-glucan exohydrolase, C-terminal domain
tgttcttttaaaaaatgatgaagaaattttaccaatttctgctgataaatacaagaaaattgctattattggtaacggtgctcttccaacagaagtttgtactgataatggttgtaaaagtcaaatatctggtgtagtcgcgttaggttggggttctggtacaacaaacatggaaaacattagtgacccactttcagctcttactgaacgtgctgaaaaggatggtatcactattactagtttcacagaagatgatagtgatactgaaaaggctgccgaagttgctgctgatgctgatcttgcaattgttgttgttgtcgctgattccggtgaaggatacttaactgttgaaggtaacagtggtgatagaaaagatcttgatttatggcacaatggtaatgatttagttgctgccgtagctgctgcaaataaaaatactgttgttgttatctactctcctggtgttgttaatttaccattccttgatgatatcaatggtttagtttatgctggtatgccaggtcaagaagctggtcatggtcttgctgatgttttattcaatgatgtagcaccatctggtaaactaccattcacctggggtaagaagcgcgaagattactgttgcgatattgttccaggtagaggaaatgaaattacccaagttaaatataccgaaggttactacattggttacaaatggtttgataaagaaaagattgaaccacacttctcatttggtcatggtcttacttatgctaagtttaa

SEQ ID NO: 14953 - DNA, 765 bp, Neocallimastix californiae
  Beta-D-glucan exohydrolase, C-terminal domain
tgttattttaaagaatgatgatgatgttttaccaatttctccaaagaaatacaagaagattgctattattggtgatggtgctcttccaatgaaactttgtgaagataatggttgtaaggataaaatatctggtgttgttgcattaggttggggttctggtactactaatatggaaaatattagtgatccactttctgcaattactgaacgtgctgaaaaggatggtattaccattactagttttactgaagatgatgacgatactgataaagctgctgaagttgctgctgatgctgatcttgctattgttgtcgttgttgctgattctggtgaaggttacttaactgttgaaggtaacagtggtgacagaaaagatcttgatttatggcacaatggtaatgaattagttgctgctgttgctgctgctaacaagaatacagttgttgttatttactcacctggtgttgttaatttacctttcgttgatgatgttaaaactattctttacgctggtatgccaggtcaagaagctggtcatggtcttgctgatattttattcaatgatgttgctccaactggtaaattaccatttacttggggtaagaaacgtgaagattattgttgtgatgttgttaaaggtaaaggtaattctattactcaagttgaatactctgaaggttattacattggttacaagtggttcgataaacaaaatattaaaccactcttcccattcggtcatggtcttacttacgctaaatttaa

SEQ ID NO: 14954 - DNA, 765 bp, Anaeromyces robustus; identical to SEQ ID NO: 14953
  Beta-D-glucan exohydrolase, C-terminal domain

SEQ ID NO: 14955 - DNA, 69 bp, Anaeromyces robustus
  Beta-D-glucan exohydrolase, C-terminal domain
ttggttcgataaaaagggtactaagccaatttacccattcggtcatggtctttcttacactacctttga

SEQ ID NO: 14956 - DNA, 603 bp, Anaeromyces robustus
  Beta-D-glucan exohydrolase, C-terminal domain
tttattaaagaacgatgataatgtattaccattaaccaagaaatacagaaagattgctgttattggtaaagatgctgataaagctgaatcttgtaccgatactgcttgtactaatggtaatattattcaaggttttggttctggtactaccgatttcactggtattactgatccatatagctccattaaaaatagagcttcaaaggaaggaataactgttgttggttccatttctgatagtgctaatgaaggtgctaatgctgctagagatgctgatgttgctattgttttcgttagagccacctctggtgaagaatatattgttgttgataataataaaggtgaccgtaataatttagatttatggcatggtggtaatgatttagttaaaagtgttgctgctgttaataagaatactattgtcgttattcatgctccagctactgttaatcttccattcattaacaatgttaaagctattattcatgctggtatgccaggtgctgaatcaggtaatgctatcgcttccgtcttatttggtgatcataatccatctggtcaccttccatttacatgggctaagagagaagaatactgttgtga

SEQ ID NO: 14957 - DNA, 765 bp, Anaeromyces robustus
  Beta-D-glucan exohydrolase, C-terminal domain
tgttcttttaaagaatgatgaagatattttaccaatttctcctaaaaaatataaaaaaattgctattattggtgatggtgctcgtccaactaaaccttgtactgataatggttgtgctcaaggtaaaatgtctggtgttgttgttttaggttggggttctggtactactaatatggaaaatattagtgatccactttctgctttaactgaacgtgccgaaaaggatggtattacaattactagttttactgaagatgatagtgatactgataaagctgctgaagttgctgctgatgctgatcttgctattgttgttgttactgcttcttcaggtgaagaatatattactgttgaaggtaatcaaggggatagaaaaaatcttgatttatggcataatggtaatgaattagtttcagctgttgctgctgctaataaaaacacagttgttgttatttattctcctggtgttgttaatttacctttccttgatgatattaaaggtttagtttatgctggtatgccaggtcaagaagctggtcatggtcttgctgatattttatttaatgatgtagctccttctggtaaattaccatttacttggggtaaaaaacgtgaagattattgttgtgatattgtctatggtaatgataaaattattgatattccttactctgaaggtttttaccttggttataaatggtttgataaggaaaaaattgaaccacatttctcattcggtcatggtcttacctatgctaaattcaa

SEQ ID NO: 14958 - DNA, 765 bp, Piromyces finnis
  Beta-D-glucan exohydrolase, C-terminal domain
tgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatgttgtctacggtaatgataaaattattgatgttccatacactgaaggtttctaccttggttacaagtggttcgataaggaaaagattgaaccacacttctcattcggtcacggtcttacttatgctaaattcaa

SEQ ID NO: 14959 - DNA, 765 bp, Piromyces finnis
  Beta-D-glucan exohydrolase, C-terminal domain
tgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatattgttagtaacaatgatgtctatccaaagattgaatacagtgaaggtttctaccttggttacaagtggttcgataaggaaaagattgaaccacacttctcattcggtcacggtcttacttatgctaaattcaa

SEQ ID NO: 14960 - DNA, 3042 bp, Neocallimastix californiae
  BETA-GALACTOSIDASE
tgaaaattgggacttggtagttgtacaaaattcaaatcaagctcaatcacatattaattctggttgtttcaaatctgattttagaccatcagctgatcatggttggaaaactgttcaacttccaaaaagctggacttgtcaaggttttgacttttccatctatactaatgtaaatcaaccatggcaatcaagatacgacagttacgtacctgtaccagaggcaccagtaaattataatccagttggtctttaccgtaaaaagttcactttggatagttcaatgcgtaaatctggtagacgtatctatatagaatttgatggtgtagaatcagcttactatgtttatgtcaatggacaagctgtcggatacagtgaagataccttcagtcctcaccgtttcgatattaccgatgtcctttcatcaggagaaaatacacttgccgttgaagttcacaaattctgtgatggaacttggtttgaagatcaagacatgatttatgatggtggtatcttccgtgatgttttcttagttagtgctccagatgttcaaattagggattataccgtccgtacagatcttgatagttctttcacaaacgccaaccttgaaatatcaatggatattcgtaatctttcaggtggtgaaaagagtggttggggtgttattgccgaagcttatgatgaagctggtaataatattctcaaaggagcatcaataaaactcgataggcttaatactaataaagacaacacttttgttttgaaaactagtgttaattcaccaaaactctggtcagccgaaataccaaatctttatgctctcgttcttaaacttaccgataatagtggcaacgtacaagaaatactttccactcagttaggtttccgtaaaattggttttactagagctgaagtaaattgggcatatcaattgaccactaataattggcaaccaattaccatcaatggtaagagacttcttatcaagggtgtcaatcgtcatgattcagatccattcaatggaagggctgttccacaacaaacattacgtgaagatattgctctcatgaaaaagcataatattaatgccataagaacttctcattacagtaatgactcctacctctactggctctgcaataaatatggtatgtatgtcatgggtgaaaccaatttggaatctcatgctttacagaataaccatgacgcaaaagccaaattctatgaacttggaatggacagaacagaaactgcctataagcgtttgaaaaataatccatcaatctttgcatggtctattggaaatgaaatggcctacaccaataatccaaatgatgcaggaggtcttttccgtgatatgatctggtatttcaaaaagaacgattccagtcgtccagtacatagtgaaggacaaggtagtagtatgggtgttgatatgtctagtaatatgtatcctggttctgatggactcggtgttcatgctggtcgaggaaagatgccttacatcatgtgtgaatatgatattgcttcaggtaatgctataggtgctttaaaagaatattgggatgtgataagaagtgctgataatatgttagggggttttatttgggattgggttgatcaatccagagcaaaaactctcaacggcggatgggattactactctcaatcttatgccataactaatctttattctgaagaaattaaaggtaaattctatgcttatggtggtgattggggtgattggccaaatgataatagtttctgtgtcaatggtcttatcaatccagatagaactcctcaaccagaacttgccgaagtcaaattccaatatcaaagtttctggttctccgccgatgcttcacagttagataataaacaagtctcagtgtacaacgaaaacaatttccttaatttaaatgattttgatgtttcttggactcttctcaaaaatggtattgctattaaaactggaaatgtaaagaatgctaatgttgctcctttaacaaagggtactttgaaagtaccatttgaaatacctcaagattctctagctggtgatgaattttatcttgatatgtcagtaaaagtaaaaaatggttcagatttacttccagaaggtacagaaatttcttatggacaattccatctctattctactggaaaaccagtaaaatatgataagggaagcgatagtatcactattgataataattctagttcttattctatttctggaaagaatttcaatttcattattgataaatctactggtactcttaaaaactataaatataagggagaaacactcattaatgaaggtcctactcctaatttcttccgtggttatgttgaaaacgattataatggaagtaactgggcaaaaacatttgatcctaactggcgtaatgctatgaatggtgctcgtgtcaacagtattgatgttaaaaatggtgttggtagtgaaaagatcattgtttctcatctttcacttcctaaagccggtaatactaaagtagatataacatatactattcaaagtaatggtagtattgatgttgaattaaatgttgatggtacaagagctggtcttggaaactaccttcgtgtcggttctataatgatattgccaaagggtgctgaaaagcttagctggtacggaaatggtccagttgaaacctttaatgatcgtaagaccaatggtagaaagggtgtatgggaaaacactgtatcaggtatgttttatcctttcatgaaagcagatgactgtggtaatcttactgacataaaatggattgctgtacaaaataatggaaaaggtgctagtcttcttattgcagctgacggaactgtagaagctagtgcacttcacttcacacctgaagatcttatgcgtgctgatcatcctttcaagcttaagccacgtaaggaaactattcttagtgttgattatggatcaatgggtactggtagtgccacttgtggacaagctacattggataaatacagactcccatctggaaagcaatatagatggaaatt

SEQ ID NO: 14961 - DNA, 3042 bp, Neocallimastix californiae; identical to SEQ ID NO: 14960
  BETA-GALACTOSIDASE

SEQ ID NO: 14962 - DNA, 3090 bp, Neocallimastix californiae
  BETA-GALACTOSIDASE
taatgcccgtgaagattcaagttatttacaaatgcttacaggtaagaatcaaaattgggatcttgttgtagaacaaaatgctcaaaaagcacaaaatcatatcaataatggatgtttcaaaccaaattatcaaccatcatccaacaatggttggaaaactgttcaacttccaaaaagttggacttgtcaaggttttgatttttctatttatactaatgtaggtcaaccatggcaatccaattatgatggatatgttccagttccacaagctccaactaattataatcctgttggtctttatcgtaaaaagtttacagttgatagtactatgcgtcaatcaggtagacgtatttatattgaatttgatggtgtagaatctgcttattatgtttatgttaatggtcaagctattggttacagtgaagatactttcagtcctcaccgtttcgatattactgatgctcttaccaatggtgaaaatactcttgctgttgaagttcataaattctgtgatggtacatggtttgaagatcaagatatgatttatgatggtggtattttccgtgatgttttccttgttagtgccccaagtgttcaaattagagattatactgttcgtactgatcttgatagttctttctcaaatgctagtcttgaaatttctatggatattcgtaatctttcaggaggtgctaagagtggatggagtgttacagctgaagcttatgatgaagctggtaaaaacattcttagtggtgctactgttaaacttgataatcttgctaatggtagagatactacttcagttttaaaaactagtgttaaatctccaaaactttggtctgcagaaactccaaacctttacgctcttgttcttaaacttactgatgataagggtactgttcaagaaattctttctgctcaattaggtttccgtaagattggtttcactaaagctgaagttgatagatcatatagagttactacaagtaattggcaaccaattactattaatggtaaacgtcttcttcttaaaggtgttaaccgtcacgatactgatccattcaatggtaaagctattccacaagccactatggaaatggatattactcttatgaaaactaacaacattaatgctattagaacttctcactacagtaatgattcttacttatactggctttgtaacaaatatggtatgtatgtcatgggtgaaactaatatggaatctcatgctttaatggataataatgatgctaaagctttattctatgaagttggtcttgacagaactgaaactgcttataaacgtttaaagaatcatccatctattgttgcttggtctattggtaatgaaatggcttatactagtaatccaagtgatgctggaggtcttttccgtgatatgatttggtatttcaagaagaatgataacagtcgtccagttcatagtgaaggtcaaggtggtagtatgggtgttgatatgtctagtaatatgtacccaagttcagatggtattcgtggtaacgctggtaaaggtaaaatgccatacgttatgtgtgaatatgaccacgctatgggtaattctgttggtgctttaaaagaatactgggatggtattagaagtgctgataatatgcttggtggtttcatttgggattgggttgatcaatctagagctactccattaaaaggtggttgggattattattctgaatcctatgctaaaacaaatctttacgctgaagaaattaaaggtaaattctatggttatggtggtgattggggagattggccaaatgataacagtttctgtgttaatggtcttattagtcctgatagaactccacaaccagaacttgctgaagttaaataccaataccaaagtttctggttctctgctgatgcttctcaacttgaaaaacaagaagtttctgtttacaatgaaaacaacttccttaatattaatgaatttgatattacatggaccgtacttaaaaacggtattgctattagcaatggtgttgttcaaaatgctaatgtcggacctcttactaagggaacattaaaggttccatttgaagttccagaaaaaccacttgctggagatgaattcttccttgatatgtctgttaaggtaaagaagggtacaaaaatgcttccagaaggtactgaaattgcctatggacaaattccaattactgttattggtacttctgccaaacttaacaaggctgctgatgctgttaatgtttctgaaacttccaatggttttagtgttagtggtaagaacttccaattcactgttgacaaatccactggtactattaaatcttacacttacaatggtgctactcttattactgaaggtccaactccaaacttctggcgtggttatgttgaaaatgataacaacggtggtggttgggtaaaggctttcgatcctagctggcgtagtgctatggaaggtgctcgttgtgatggtgttagtactaagaatggatctgatggtgacaaaattataacctcacgtcttactcttccaaaggctggtagtactaaggttgatataacttatactattcatggtgatggtagtgttgatgttgaattcaatgttgatgcttccagagctggtcttggtaacttccttcgtgttggttccattatgaaattaccaactggtgctgaaaaactttcttggtatggtaatggtccagttgaaactttcaatgatcgtaaaactaatggtagaatgggagtatgggaaagtacagttacagatatgttcttcccttacatgaaggctgatgatactggtaatcttactgatcttaaatggatttctgttcaaaatgaaaagaagagtgctagtatccttattgccgctgaaggtaaggtagaaggtagtgctcttcatttcactccagaagatcttatgcgtgctgatcatccattcaaacttagtccacgtaaggaaacctatcttagtgttgattatggatctatgggtactggtagtgccacttgtggtcaaggtactcttgataaatatcgtcttccatctaacagacaatacaattggaaatt

SEQ ID NO: 14963 - DNA, 3090 bp, Neocallimastix californiae; identical to SEQ ID NO: 14962
  BETA-GALACTOSIDASE

SEQ ID NO: 14964 - DNA, 3090 bp, Piromyces finnis
  BETA-GALACTOSIDASE
taatgcgcgtgaacaatcagattatcttcaaatgctcacaggaaaaaatgaaaattgggatcttgtagttgaacaaaattcaaacaaagctcaaacacatattaactcaggttgtttcaaacctgactataaaccatcttcaagttggaagaccgttcaacttccaaagagttggacctgccaaggatttgatttttctatctatactaatataggtcaaccttggcaatccaattatgatactgatatccctgtcccacatgccccaacaaattataaccctgtaggactttatcgtaaaaagtttatggtggacagtacaatgcgtcaatctggtagacgtatctatattgaatttgatggtgtagaatctgcttattatgtttatgttaatggtcaaggtgttggttacagtgaagatacattcagtcctcaccgttttgatattactgattttcttgttaatggagaaaacactcttgctgttgaagttcataaattctgtgatggaacatggttcgaagatcaagatatgatttatgatggtggtatattccgtgatgttttccttgtaagtgctcctgctgttcaaataagagattatactgttcgtactgaccttgataattctttctcaactgccaaccttgaaatatccatggaaattcgtaatctttcaggtagttcaaaaaatggctggagtgttattgcagaagcttatgatgaagcaggttacaatatccttagtggagcttctgttaaactcggaggactttctaacggtaaagatagtaatgctgttttaaaaacttctgtaaagtcaccaaaactttggtccgctgaaacaccaaatatttacgctcttgttcttaaacttattgatgaaaatggtagaactcaagaaattctctccactcaattaggtttccgtaagataggttttacaagagcagaagtagactggtcatactctgtaactacaaaaaattggcaacctatcactataaatggtaaacgtcttcttcttaagggtgtaaatcgccacgacactgatccattcaatggaaaagctatacctcaagaaactatgcgtgaagatattactttaatgaaaaagaataatattaatgccattagaacttcccactatagtaatgattcctatttatattggctttgtaataaatatggtatgtatgttatgggtgaaacaaatatggaatcacatgctttaatggataataatgatggaaaagctttattctatgaacttggtcttgacagaacagaaacagcatacaaacgtttaaagaataatccttccattgtagcatggtccattggaaatgaaatggcatacacaggtaatccaagtgatgctggaggtcttttccgtgatatgatatggtactacaagaaaaacgataatactcgtccagttcacagtgaaggacaaggtggtggaatgggtgtcgatatgagtagtaatatgtaccctagctcagacggtattcgcggtaatgcaggaaaaggtaaaatgccatatgttatgtgtgaatatgatcacgctatgggtaactcagttggtgctttaaaagaatattgggatgctattagaagtgcggataatatgttaggtggtttcatttgggattgggttgatcaatcaagagcagttccaatcaaaagcggtggatgggattattactctgaatcctatgccaagacaaatctctattctagtgaaattaaaggaaaattctacggttacggtggtgactggggagatagaccaaatgataacagtttctgtgtaaatggacttatcaatcctgatagaactcctcaacctgaacttgctgaagtcaaattccaataccaaagtttctggttctcagcagatgcttcacaactcgataatcaagaagtttctgtatacaatgaaaataacttccttaacattaatcaatttgatgttacatggacacttcttaaaaatggtattgctatagattctggtatcgttagaaatgctaacgtagctcctctttccaagggtactcttaaagtaccatttgtgataccaatggattctcttgctggtgatgaatattatcttgatatgtctgtaaaggtaaagaatggcacagatatgcttccagagggcacagaaattgcttatggacaaattgctcttgcttccaaaggaatgactgcaaagtataataaaggtaatgattccattagtgttactgaaaatcaaaattcatacattttatcaggcaagaattttgaattcctcatcaataaatcatcaggtcttctcagtacctataaatacagaggtgaaaccatcatcactgaaggtccaactcctaacttctggcgtggttatgttgagaatgataataatggtgctggttgggcaaaaacttttgattccaactggcgtaatgctatgaatggtgctcgttgtgataaaatcgaggttaacaatggaagtgatagtagtgaaaaaatcattgtttcacatcttacccttcctaaagttggaagtacaaaggtagacataacctacaccgttcattgtgacggaagtgttgatgttgaattcaatgttgatgctactagatcagatcttggaaacttccttcgtgttggttcaatgatgaaattaccagaaggctttgaaaagcttagttggtatggtaatggtcctgttgaaactttcaatgatcgtaaaacaaatggtagaatgggagtatgggaaagtaccgtaacagatatgttctatccttatatgaaggcagacgattgtggaaatcttacagaccttaagtggatttcagttcaaagtaaaaagagaagtgcaagtatacttgttgtcgctgaaggagcagtagaaggaagtgctcttcattttgctccagaagatcttatgcgtgcagatcatccatataaacttagaccacttaagacgactattctcagtgttgattatggatctatgggtactggaagtgctacttgtggacaagctacacttgataagtatcgtcttccttccgatagaccatataattggaaatt

SEQ ID NO: 14965 - DNA, 3090 bp, Piromyces finnis; identical to SEQ ID NO: 14964
  BETA-GALACTOSIDASE

SEQ ID NO: 14966 - DNA, 345 bp, Neocallimastix californiae
  beta-Galactosidase/glucuronidase domain
tcaaattagggattataccgtccgtacagatcttgatagttctttcacaaacgccaaccttgaaatatcaatggatattcgtaatctttcaggtggtgaaaagagtggttggggtgttattgccgaagcttatgatgaagctggtaataatattctcaaaggagcatcaataaaactcgataggcttaatactaataaagacaacacttttgttttgaaaactagtgttaattcaccaaaactctggtcagccgaaataccaaatctttatgctctcgttcttaaacttaccgataatagtggcaacgtacaagaaatactttccactcagttaggtttccgtaa

SEQ ID NO: 14967 - DNA, 333 bp, Neocallimastix californiae
  beta-Galactosidase/glucuronidase domain
attccaatatcaaagtttctggttctccgccgatgcttcacagttagataataaacaagtctcagtgtacaacgaaaacaatttccttaatttaaatgattttgatgtttcttggactcttctcaaaaatggtattgctattaaaactggaaatgtaaagaatgctaatgttgctcctttaacaaagggtactttgaaagtaccatttgaaatacctcaagattctctagctggtgatgaattttatcttgatatgtcagtaaaagtaaaaaatggttcagatttacttccagaaggtacagaaatttcttatggacaattccatctctattc

SEQ ID NO: 14968 - DNA, 330 bp, Neocallimastix californiae
  beta-Galactosidase/glucuronidase domain
ataccaataccaaagtttctggttctctgctgatgcttctcaacttgaaaaacaagaagtttctgtttacaatgaaaacaacttccttaatattaatgaatttgatattacatggaccgtacttaaaaacggtattgctattagcaatggtgttgttcaaaatgctaatgtcggacctcttactaagggaacattaaaggttccatttgaagttccagaaaaaccacttgctggagatgaattcttccttgatatgtctgttaaggtaaagaagggtacaaaaatgcttccagaaggtactgaaattgcctatggacaaattccaattac

SEQ ID NO: 14969 - DNA, 345 bp, Neocallimastix californiae
  beta-Galactosidase/glucuronidase domain
tcaaattagagattatactgttcgtactgatcttgatagttctttctcaaatgctagtcttgaaatttctatggatattcgtaatctttcaggaggtgctaagagtggatggagtgttacagctgaagcttatgatgaagctggtaaaaacattcttagtggtgctactgttaaacttgataatcttgctaatggtagagatactacttcagttttaaaaactagtgttaaatctccaaaactttggtctgcagaaactccaaacctttacgctcttgttcttaaacttactgatgataagggtactgttcaagaaattctttctgctcaattaggtttccgtaa

SEQ ID NO: 14970 - DNA, 336 bp, Piromyces finnis
  beta-Galactosidase/glucuronidase domain
attccaataccaaagtttctggttctcagcagatgcttcacaactcgataatcaagaagtttctgtatacaatgaaaataacttccttaacattaatcaatttgatgttacatggacacttcttaaaaatggtattgctatagattctggtatcgttagaaatgctaacgtagctcctctttccaagggtactcttaaagtaccatttgtgataccaatggattctcttgctggtgatgaatattatcttgatatgtctgtaaaggtaaagaatggcacagatatgcttccagagggcacagaaattgcttatggacaaattgctcttgcttccaa

SEQ ID NO: 14971 - DNA, 345 bp, Piromyces finnis
  beta-Galactosidase/glucuronidase domain
tcaaataagagattatactgttcgtactgaccttgataattctttctcaactgccaaccttgaaatatccatggaaattcgtaatctttcaggtagttcaaaaaatggctggagtgttattgcagaagcttatgatgaagcaggttacaatatccttagtggagcttctgttaaactcggaggactttctaacggtaaagatagtaatgctgttttaaaaacttctgtaaagtcaccaaaactttggtccgctgaaacaccaaatatttacgctcttgttcttaaacttattgatgaaaatggtagaactcaagaaattctctccactcaattaggtttccgtaa

SEQ ID NO: 14972 - DNA, 237 bp, Neocallimastix californiae
  beta-N-acetylhexosaminidase-like domain
tcttaacactactattggtgaagaagctgcagttattttcggtactgttggaaaatctaatttatttgaaggtgttgatgtttctgctattaaagacaagtatgaatcttacgtattcaatgttcaaggaaatagaatttacattgctggtagtgataagcgtggtactatctatggtcttttccatctttctgaattaatgggtgtttctccatttgttgattggctcgacttaaa

SEQ ID NO: 14973 - DNA, 153 bp, Neocallimastix californiae
  beta-N-acetylhexosaminidase-like domain
taaaggacgttgggaaagttatcaaatgcaagttattaaaaatccaataaacggtgttagtgaagcacttgttattgttggtagtgataaaagaggtaccctttatggtatgttccatatttccgaaatgatgggagtttcaccatgggtatg

SEQ ID NO: 14974 - DNA, 399 bp, Neocallimastix californiae
  BETA/GAMMA CRYSTALLIN
aattaaccgtcgtagtaacaaggctttagctgttcaaaatgactccaaggataacgctgctaacgttgttcaatggactgaaagtaataaaactagtcaacaatggaagattactgaagatggaggttacagaatcttaaatgtcaatgccgataaagcccttgatgttgaaagagattcaactcaaaatggtggtaatattatcatttggcctgataccggtaacctcaatcaacgttggactattgaagatgctggaaatggttatgttgaaatcgttaatcttagtagtggtaaagctcttgacgttgaaaatgaatccactgctgatggtgccaatgtttgtcaatgggatgctcatggtagtcaaaaccaacaatggaaattagttccagtagg

SEQ ID NO: 14975 - DNA, 402 bp, Neocallimastix californiae
  BETA/GAMMA CRYSTALLIN
tattaatcgtaacagtggaaaagcattaggtgttgatggtgattctacttcaaatgctgctaatgttcaccaatggactgataatggtaaaactagtcaacaatggattattactgatgaaggttatggttataagatcatgaatgttaatgctaataaggcacttgatgttaatgaaaattctacaaagaatggtggtaatgttattatttggtctgataatggaaatcttaatcaacgttggtatattgaagaaattggtgatggatatattactttacaaaatattaatagtggattattacttgatgtagaaaagtcatctacctctgatggtggtaatgtattacaatgggaaaataatggtaatagtaatcaacaatggaaattaatacgtcttga

SEQ ID NO: 14976 - DNA, 402 bp, Anaeromyces robustus; identical to SEQ ID NO: 14975
  BETA/GAMMA CRYSTALLIN

SEQ ID NO: 14977 - DNA, 402 bp, Piromyces finnis
  BETA/GAMMA CRYSTALLIN
cattaaccgtcaaagtggaaaagtattaagtgttaataacgattctactgctaacgctgctaatgtcattcaatggtccgaaagcaacaagagtagtcaacaatgggttattagtgaagaaggtgattactttagtttaataaatgttaatgccaagaaagctcttgatgtaaatgaaaattcaactgaaaatggtggtaatgtcattatctggccagatactggagcccttaaccaacgttggagtattcaaagtactggtgatggttattacaccattacaaatgccaacagtggaaagaatctcgatgttgaaaagggatctatgtctgatggtggtaatgttttacaatggggtaataatggtggtgctaatcaacaatggaagttagttcgtacaga

SEQ ID NO: 14978 - DNA, 402 bp, Piromyces finnis; identical to SEQ ID NO: 14977
  BETA/GAMMA CRYSTALLIN

SEQ ID NO: 14979 - DNA, 825 bp, Neocallimastix californiae
  Bgal_small_N
tatttctggaaagaatttcaatttcattattgataaatctactggtactcttaaaaactataaatataagggagaaacactcattaatgaaggtcctactcctaatttcttccgtggttatgttgaaaacgattataatggaagtaactgggcaaaaacatttgatcctaactggcgtaatgctatgaatggtgctcgtgtcaacagtattgatgttaaaaatggtgttggtagtgaaaagatcattgtttctcatctttcacttcctaaagccggtaatactaaagtagatataacatatactattcaaagtaatggtagtattgatgttgaattaaatgttgatggtacaagagctggtcttggaaactaccttcgtgtcggttctataatgatattgccaaagggtgctgaaaagcttagctggtacggaaatggtccagttgaaacctttaatgatcgtaagaccaatggtagaaagggtgtatgggaaaacactgtatcaggtatgttttatcctttcatgaaagcagatgactgtggtaatcttactgacataaaatggattgctgtacaaaataatggaaaaggtgctagtcttcttattgcagctgacggaactgtagaagctagtgcacttcacttcacacctgaagatcttatgcgtgctgatcatcctttcaagcttaagccacgtaaggaaactattcttagtgttgattatggatcaatgggtactggtagtgccacttgtggacaagctacattggataaatacagactcccatctggaaagcaatatagatggaaattcacaatcttccc

SEQ ID NO: 14980 - DNA, 819 bp, Neocallimastix californiae
  Bgal_small_N
ttctggaaagaatttcaatttcattattgataaatctactggtactcttaaaaactataaatataagggagaaacactcattaatgaaggtcctactcctaatttcttccgtggttatgttgaaaacgattataatggaagtaactgggcaaaaacatttgatcctaactggcgtaatgctatgaatggtgctcgtgtcaacagtattgatgttaaaaatggtgttggtagtgaaaagatcattgtttctcatctttcacttcctaaagccggtaatactaaagtagatataacatatactattcaaagtaatggtagtattgatgttgaattaaatgttgatggtacaagagctggtcttggaaactaccttcgtgtcggttctataatgatattgccaaagggtgctgaaaagcttagctggtacggaaatggtccagttgaaacctttaatgatcgtaagaccaatggtagaaagggtgtatgggaaaacactgtatcaggtatgttttatcctttcatgaaagcagatgactgtggtaatcttactgacataaaatggattgctgtacaaaataatggaaaaggtgctagtcttcttattgcagctgacggaactgtagaagctagtgcacttcacttcacacctgaagatcttatgcgtgctgatcatcctttcaagcttaagccacgtaaggaaactattcttagtgttgattatggatcaatgggtactggtagtgccacttgtggacaagctacattggataaatacagactcccatctggaaagcaatatagatggaaattcacaatctt

SEQ ID NO: 14981 - DNA, 825 bp, Neocallimastix californiae
  Bgal_small_N
tgttagtggtaagaacttccaattcactgttgacaaatccactggtactattaaatcttacacttacaatggtgctactcttattactgaaggtccaactccaaacttctggcgtggttatgttgaaaatgataacaacggtggtggttgggtaaaggctttcgatcctagctggcgtagtgctatggaaggtgctcgttgtgatggtgttagtactaagaatggatctgatggtgacaaaattataacctcacgtcttactcttccaaaggctggtagtactaaggttgatataacttatactattcatggtgatggtagtgttgatgttgaattcaatgttgatgcttccagagctggtcttggtaacttccttcgtgttggttccattatgaaattaccaactggtgctgaaaaactttcttggtatggtaatggtccagttgaaactttcaatgatcgtaaaactaatggtagaatgggagtatgggaaagtacagttacagatatgttcttcccttacatgaaggctgatgatactggtaatcttactgatcttaaatggatttctgttcaaaatgaaaagaagagtgctagtatccttattgccgctgaaggtaaggtagaaggtagtgctcttcatttcactccagaagatcttatgcgtgctgatcatccattcaaacttagtccacgtaaggaaacctatcttagtgttgattatggatctatgggtactggtagtgccacttgtggtcaaggtactcttgataaatatcgtcttccatctaacagacaatacaattggaaattcactattattcc

SEQ ID NO: 14982 - DNA, 819 bp, Neocallimastix californiae
  Bgal_small_N
tagtggtaagaacttccaattcactgttgacaaatccactggtactattaaatcttacacttacaatggtgctactcttattactgaaggtccaactccaaacttctggcgtggttatgttgaaaatgataacaacggtggtggttgggtaaaggctttcgatcctagctggcgtagtgctatggaaggtgctcgttgtgatggtgttagtactaagaatggatctgatggtgacaaaattataacctcacgtcttactcttccaaaggctggtagtactaaggttgatataacttatactattcatggtgatggtagtgttgatgttgaattcaatgttgatgcttccagagctggtcttggtaacttccttcgtgttggttccattatgaaattaccaactggtgctgaaaaactttcttggtatggtaatggtccagttgaaactttcaatgatcgtaaaactaatggtagaatgggagtatgggaaagtacagttacagatatgttcttcccttacatgaaggctgatgatactggtaatcttactgatcttaaatggatttctgttcaaaatgaaaagaagagtgctagtatccttattgccgctgaaggtaaggtagaaggtagtgctcttcatttcactccagaagatcttatgcgtgctgatcatccattcaaacttagtccacgtaaggaaacctatcttagtgttgattatggatctatgggtactggtagtgccacttgtggtcaaggtactcttgataaatatcgtcttccatctaacagacaatacaattggaaattcactattat

SEQ ID NO: 14983 - DNA, 828 bp, Piromyces finnis
  Bgal_small_N
tttatcaggcaagaattttgaattcctcatcaataaatcatcaggtcttctcagtacctataaatacagaggtgaaaccatcatcactgaaggtccaactcctaacttctggcgtggttatgttgagaatgataataatggtgctggttgggcaaaaacttttgattccaactggcgtaatgctatgaatggtgctcgttgtgataaaatcgaggttaacaatggaagtgatagtagtgaaaaaatcattgtttcacatcttacccttcctaaagttggaagtacaaaggtagacataacctacaccgttcattgtgacggaagtgttgatgttgaattcaatgttgatgctactagatcagatcttggaaacttccttcgtgttggttcaatgatgaaattaccagaaggctttgaaaagcttagttggtatggtaatggtcctgttgaaactttcaatgatcgtaaaacaaatggtagaatgggagtatgggaaagtaccgtaacagatatgttctatccttatatgaaggcagacgattgtggaaatcttacagaccttaagtggatttcagttcaaagtaaaaagagaagtgcaagtatacttgttgtcgctgaaggagcagtagaaggaagtgctcttcattttgctccagaagatcttatgcgtgcagatcatccatataaacttagaccacttaagacgactattctcagtgttgattatggatctatgggtactggaagtgctacttgtggacaagctacacttgataagtatcgtcttccttccgatagaccatataattggaaattcactattatccc

SEQ ID NO: 14984 - DNA, 822 bp, Piromyces finnis
  Bgal_small_N
atcaggcaagaattttgaattcctcatcaataaatcatcaggtcttctcagtacctataaatacagaggtgaaaccatcatcactgaaggtccaactcctaacttctggcgtggttatgttgagaatgataataatggtgctggttgggcaaaaacttttgattccaactggcgtaatgctatgaatggtgctcgttgtgataaaatcgaggttaacaatggaagtgatagtagtgaaaaaatcattgtttcacatcttacccttcctaaagttggaagtacaaaggtagacataacctacaccgttcattgtgacggaagtgttgatgttgaattcaatgttgatgctactagatcagatcttggaaacttccttcgtgttggttcaatgatgaaattaccagaaggctttgaaaagcttagttggtatggtaatggtcctgttgaaactttcaatgatcgtaaaacaaatggtagaatgggagtatgggaaagtaccgtaacagatatgttctatccttatatgaaggcagacgattgtggaaatcttacagaccttaagtggatttcagttcaaagtaaaaagagaagtgcaagtatacttgttgtcgctgaaggagcagtagaaggaagtgctcttcattttgctccagaagatcttatgcgtgcagatcatccatataaacttagaccacttaagacgactattctcagtgttgattatggatctatgggtactggaagtgctacttgtggacaagctacacttgataagtatcgtcttccttccgatagaccatataattggaaattcactattat

SEQ ID NO: 14985 - DNA, 30 bp, Neocallimastix californiae
  BNR
ctctactgatggtggttacacctggactcc

SEQ ID NO: 14986 - DNA, 33 bp, Neocallimastix californiae
  BNR
ctacactactgataatggtgccacctggactgc

SEQ ID NO: 14987 - DNA, 135 bp, Neocallimastix californiae
  Carb_bind
ttgcggtaaacaatgctattctcctcaaaattatgtttgcttagctaatgatttattatgtcccgttggtttgaaaggctgtaatggtggatgttacgacccagctgtttattcatgtgttaataatgaattagt

SEQ ID NO: 14988 - DNA, 135 bp, Anaeromyces robustus
  Carb_bind
ttgtggcaaacaatgttattcacctcaagagtatgtttgttataaaaacgatttattatgtcctgttggcacaaaaggatgtaacatagcatgttataatccagcaatttattcatgtgttaataatgaattagt

SEQ ID NO: 14989 - DNA, 135 bp, Piromyces finnis
  Carb_bind
atgtggaaaacaatgttattcaccagagaattatatatgttattctaataatttattatgtcctttaggtactaagggttgtaatgatgcttgctacgatcctttactttattcgtgtgtgaacaattcattagt

SEQ ID NO: 14990 - DNA, 282 bp, Neocallimastix californiae
  Carbohydrate-binding domain
cacaaagacatggactggtgatactactacatattctgaatgtactggtgaaattattaatgctagtaaattaaaaattaacaattggtatattgaagttccatttgatagtgctgatcatcaattttatggaagttggggttgtgaagttgatgttcaatctgataaattagttcttactggtgaagttactaatgctgttcttaaagttttaactaacaccacttttggattcattgtttcaagtaatggtaaaaagtttgatgttgaacaagctgtttt

SEQ ID NO: 14991 - DNA, 258 bp, Neocallimastix californiae
  Carbohydrate-binding domain
aattaaaattggtaaatcatgggaaacagataacgtttcatacgttcaatatgacggtgaaattaataatgccagtaaattgaagattaataattggtatattgaaattccatataataaaggtaaaaataagttacatggtaattggggttgtgaaattgaggaacaagctgataaaataattcttactggtggagacgttaatggtgttattaaagtttctactgttgcaacatttggtttcattgtttctgatcc

SEQ ID NO: 14992 - DNA, 237 bp, Neocallimastix californiae
  Carbohydrate-binding domain
tgaatgtactggtgaaattattaatgccagtaaattgaaacttaataattggtatatcgaagttccatttagtggtgataaaaataaattccttggtagttggggttgtgttgtcgatgttcaatcagataaattagttcttaccggtgaagttacaaatgctgttcttaaagttttaacaaacaccacttttggtttcattgtttctagtgaaggttccaagtttgatgttgaaaa

SEQ ID NO: 14993 - DNA, 297 bp, Anaeromyces robustus
  Carbohydrate-binding domain
ttttgaaattaaagttggaaaaagttggtctggagatggaactacatacactcaagcagaaggtgaaattattaatgctagtaaattaaagattaataattggtatattgaagttccattcgatggatctgaccaacgtttccttggtagttggggttgtgtagttgaagaaaaagatgataaattaattcttactggtgaagttactaatcaagttattaaagttttaactaacaccacttttggtttcattgttgctagtactaatacaaaattcgatgttgaaacagctgtttt

SEQ ID NO: 14994 - DNA, 288 bp, Anaeromyces robustus
  Carbohydrate-binding domain
tgagattaaagttgctaaatcttggactagtgattcaatttcattcactcaatttgatggtataattgataattctagtaaattaaagattaatagttggtatattgaaattccatacgataaaaaagtcaatgatttacatggtaattggggttgtgaaattgaagttaaagatgataaaatagttcttactggtggagaaaccaatcaagttattaaggtttatacttctgcttcttttggctttattgtttccagtccaggtaaaaactttgatgttgaaaatgc

SEQ ID NO: 14995 - DNA, 273 bp, Piromyces finnis
  Carbohydrate-binding domain
tattagtaaatcatggactggtgatactactacttattcacaagcagaaggtaaaattgtaaatgctagtaaattaaagcttaataattggtatattgaagtaccatttgacccagaccaccaaaaattccaaggcagttggggttgtgaagttgaagaaaaagaagataaattagttcttactggtgaagttaccaataaaacacttaaagttttaactgaaacaactttcggatttattattgctagtactggtgttaagtttgatgtcga

SEQ ID NO: 14996 - DNA, 312 bp, Neocallimastix californiae
  CarboxyPept_regulatory_dom
acaacgtggaaaagtcactggtaaattaactattaagaatcagttagataattctgttttcaagttagatgatgccgtcgtaactttagttcaaccggaatctaacagtgaatccattccaaatcaacaatggcgtcattactccttctggactcatagtatttctggtgtcagtccaaacttcactattaataatgttattccaggtacctatcaattacgtgcttggtctaagggtgttgttggtgaatttatcttaaacaaaactattactgtaactgctggtcaaaccactaatcttggtgaaattgt

SEQ ID NO: 14997 - DNA, 306 bp, Anaeromyces robustus
  CarboxyPept_regulatory_dom
tccaaaagctaaacgtggttccgtatctggtaaattagttattaaagatccattatatggtagtcttaaaatttctgatgcaacagttactttagttcaaccagaaagtagtacagaaccaattcatccacaacaatggcataaaatgtctcactgggttactcatgtcactggtgatttcaaaattgaaaatgtagtaccaggtacttatcaacttagagcttggtctaaaggtattgttggagaattttatactactaataccatcacagtaactagtggacaagaaacaaaacttggtgaagt

SEQ ID NO: 14998 - DNA, 303 bp, Piromyces finnis
  CarboxyPept_regulatory_dom
tccaaagaataagcgtggttcagtttctggtaaattagttatcaatgatccattatatggtaatcttaaattaagtgatgcaactgttactttagttcaaccagaaagtagcaatgaaccaattcacccacaacaatggcacaagatgtctcattgggttactcatattactggcgatttcaagattgaaaatgttgttccaggtacttatgaattaagagcttggtgtaagggtattgttggtgaattctacaccaccaatacaattactgttactagtggtcaagaaaccagacttggtga

SEQ ID NO: 14999 - DNA, 303 bp, Piromyces finnis
  CarboxyPept_regulatory_dom
ggaacgtggaaaggttacaggtactttagctattaataatccattaactaatactcgtttaccacttgaagatgctgttgttactttagttcaaccacaatcagcaaccgaaccaattccaaaccaacaatggcgtcatatgtcattctggactcacagtttatctggtgctacaccaaactttgtaatttacaacgttattccaggtacatatgaattacatgcttgggcaaagggtgttgttggtgaatttgttttagataagttagttaccgttaaagctggtgaagttgttaatcttgg

SEQ ID NO: 15000 - DNA, 231 bp, Neocallimastix californiae
  CBD_carb-bd_dom
attctctattgcaactggttccggtatgcgttgttcaggttggtgtctttctttcacttccagtacctacaagattgatcaatctagtgactgtactccattaaagttagaatcaccaaattacactctttgtaacaagcgtgaaaacaattcacttgatggtgaaggtactgtaagaactgttaaattccaaggttctggtagtggacttccaactgaattcactgtttt

SEQ ID NO: 15001 - DNA, 246 bp, Anaeromyces robustus
  CBD_carb-bd_dom
tgaaaagagttggatggatgtttacagaattatcgctgatgttgaaactaaattacctactccagcttgggaagttgaattcactttaccagaaggtcatatatttgatgatttttctgctactaactgttatgttgttaactatgatgaaaaaactcgtgttcttagattcaaaaatactccatggaatggtccattaacagctaatcttacacaatcatttggtttccaatgtcatggtgctga

SEQ ID NO: 15002 - DNA, 279 bp, Anaeromyces robustus
  CBD_carb-bd_dom
agttgctaaatcttggactagtgattcaatttcattcactcaatttgatggtataattgataattctagtaaattaaagattaatagttggtatattgaaattccatacgataaaaaagtcaatgatttacatggtaattggggttgtgaaattgaagttaaagatgataaaatagttcttactggtggagaaaccaatcaagttattaaggtttatacttctgcttcttttggctttattgtttccagtccaggtaaaaactttgatgttgaaaatgc

SEQ ID NO: 15003 - DNA, 270 bp, Piromyces finnis
  CBD_carb-bd_dom
cagtattagtaaatcatggactggtgatactactacttattcacaagcagaaggtaaaattgtaaatgctagtaaattaaagcttaataattggtatattgaagtaccatttgacccagaccaccaaaaattccaaggcagttggggttgtgaagttgaagaaaaagaagataaattagttcttactggtgaagttaccaataaaacacttaaagttttaactgaaacaactttcggatttattattgctagtactggtgttaagtttga

SEQ ID NO: 15004 - DNA, 231 bp, Piromyces finnis
  CBD_carb-bd_dom
tgaattatctattgctactggctctggtatgcgttgctcaggttggtgtgtatcattcacatcttcatcatacaaaattacacaaactagtgatggtaatattgtaaattctggtccagaatatactatttgtaacaagcgtgaaaataatgctcttgatggtaagggtactgctcatattgttactttccaagcttctggttcttctcttccaactgaatttactgtttt

SEQ ID NO: 15005 - DNA, 231 bp, Piromyces finnis; identical to SEQ ID NO: 15004
  CBD_carb-bd_dom

SEQ ID NO: 15006 - DNA, 231 bp, Piromyces finnis; identical to SEQ ID NO: 15004
  CBD_carb-bd_dom

SEQ ID NO: 15007 - DNA, 357 bp, Neocallimastix californiae
  CBD_IV
tgttaatggttctgctcttaactacgctgctagtatggcttggcaaagtggtattagtgttaagggacaaggtgctgttactcaagttaattatggacgtggttcctggactggtgtttctaatgttgctttaggtaatgctaagaccattactcttagagcctcttcctctagtggtgctactgttaagatttgtgccggtagtgaaaatggtacagttcttggttatgttgatattccagctggtggttccttacaaaatgttactggaaatctttctggtgcttctggtaccaagaatctcttcttcattgcttctggtaatcttactattgaatcatggcaattagatggtaa

SEQ ID NO: 15008 - DNA, 357 bp, Neocallimastix californiae; identical to SEQ ID NO: 15007
  CBD_IV

SEQ ID NO: 15009 - DNA, 366 bp, Neocallimastix californiae
  CBD_IV
ggttaatgcttacaatactaactatgcttcaatgatggcatggcaaggtggtgtttctacaaatggtttaggtcatactactgttacctacaacagaggtgaatggactggtgtttctaatgttgattttggagaagctgctacctccgttaagataacagccgcttctaacaatggtgctgttattagaattactactggaagtccaaatggtgatgttgttggttatgtttctattccagctactggtggtaactccaactttaagactgttactgctgatattaacactgttagtggaactaagcacgttttctttgttgcttctggtgatgttgttgtcgatacctggcaattcattggatc

SEQ ID NO: 15010 - DNA, 357 bp, Neocallimastix californiae
  CBD_IV
tgttgatggttctgctcttaactacgctgctagtttcgcctggcaaagtggtattagtgttaagggtcaaggtgctgttacacaagttaactatggacgtggtgcttggactggtgtttctaatgttaatttaggtaatgctaaatccattactcttaaggcttcatcatctggtggtgctactgttaaaatctgtgctggtagtgaaaatggtactgttcttggttatgttgatattccagctggtggttccttacaaaatgtttctggtaatctttctggagcttctggtaccaagaatcttttcttcattgcttccggtaatcttactattgaatcatggcaattaggtggtag

SEQ ID NO: 15011 - DNA, 357 bp, Neocallimastix californiae
  CBD_IV
tgtagatggcagtaaggttaataacgcttctagttttgcttggcaatatggtattactattaagggtcaagataatgttcttcctgtcaattatgttaaaggagcatggacaggtatttccaatgtcgatttaggtaatgctaaatctattactcttaaagcttatgctccaaatggtgctactattaaggtttgtgttggaagtgaaaatggaactgttcttggttatgttgatattccaaagggtaacagtttacaaaatgttacaggaaatcttgataatgcttcaggaacaaagaatcttttcttagtttcttctggtgatgctaccattgagtcatggcaacttactggagg

SEQ ID NO: 15012 - DNA, 357 bp, Neocallimastix californiae
  CBD_IV
tgttgatggttctgcccttaactatgccgctagtttcgcttggcaaagtggtattagtgttaagggacaaggtgctgttactcaagttaattatggacgtggtgcctggactggtgtttctaatgttgctttaggtaatgccaagtctattactcttaaggcctcttcctctagtggtgctactgttaagatttgtgccggtagtgaaaatggtacagttcttggttatgttgatattccagctggtggttccttacaaaatgttactggaaatctttctggtgcttctggtaccaagagtcttttcttcattgcttctggtaatcttactattgaatcatggcaattaggtggtgg

SEQ ID NO: 15013 - DNA, 366 bp, Neocallimastix californiae
  CBD_IV
tgttgatgcctttaaaacttactatgcctctatgatggcttgggaaggtggtgtctctattaacggtttaggtcacactactgttacttataataagggtgactggactggtgtttcaaatgttgatttcggtaatggcgcttacggtattaaggtctcagctgcctctagaaatggtgctgttattaagattgctgctggtagtgaaactggtaatgctcttggttacattaacattccagccactggtggtacaaactctttcaaaaccgttactgcttctcttagcaagattactggtgttaagaacattttcttcattgcatccggtgatgttgttcttgatacatggcaattcactgatga

SEQ ID NO: 15014 - DNA, 324 bp, Neocallimastix californiae
  CBD_IV
tatggcatggcaaagtggtatttctgtcgaaggtcatggtgctgttactcaagttaaatacggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaagtggtgg

SEQ ID NO: 15015 - DNA, 366 bp, Anaeromyces robustus; identical to SEQ ID NO: 15013
  CBD_IV

SEQ ID NO: 15016 - DNA, 357 bp, Anaeromyces robustus
  CBD_IV
tgttgatggttccaaacttaactatgctgcttctatggcatggcaaagtggtatttctgtcgaaggtcatggtgctgttactcaagttaaatacggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaagtggtgg

SEQ ID NO: 15017 - DNA, 345 bp, Anaeromyces robustus
  CBD_IV
agctgttaacccagctgctaatatggcttggcaaaacggtattagtgttaagggtcaaggtgctgtacttccagttagttacactcgtggtgcttggactggtgtttctaatgttgctttaggtggtgctagttctattactcttaaagcatcttctcaatcaggtgctactattaagatttgtactgaaagtgaaaatggtcaagctattggttatgttgatattccagctggtggatccttacaaaatgttagtggtactctttcaggtgctactggtactaaaaatcttttcttcgtttcctctggtgatgctaccattgaatcatggcaattaggtggtgg

SEQ ID NO: 15018 - DNA, 357 bp, Anaeromyces robustus
  CBD_IV
tgtagatggttttgctgttaatccagctgctaatatggcttggcaatatggtattagtgtcaatggtcaaggtgctgtagttccagttaattataaccgtggtgcttggactggtgtttctaatgttgctttaggtggtgctacttctattactcttaaggcttcttcaaagtctggtgctactattaagatttgtactgaaagtgaaaatggtcaagctcttggttacgttgatattccagctggtggatccttacaaaatgttagtggtactctttcaggagctactggtactaaaaatcttttcttcgtttcctctggtgatgctaccattgaatcatggcaattaggcggtgg

SEQ ID NO: 15019 - DNA, 357 bp, Piromyces finnis
  CBD_IV
tgttgatgcctacagtaccaactacgcctcaatgatggcttggcaagctggtgtttccgtttatggtttaggtcacaccactgttacctacagaaagggtacctggactggtgtttctggtgttgaatttggtgacaatgccacttccgttaagatttcagctgcctctgccaatggtgctactattagaatcacctctggaagtgaaaacggtgaagttattggttacgttaccgttccagctactggtgatgaattcgtcactgttactgctgatgttagtgtttctggtgttaaggacatcttctttgttgcctctgacgaagttgttgtcgatacctggcaatttgttgctga

SEQ ID NO: 15020 - DNA, 357 bp, Piromyces finnis
  CBD_IV
tgttgatggtactagtcttaatttagctgcttcatttgcttggcaaagtggtatcaagattaagggacaaggtgcagttactaccgttgaaattccacgtggtggatggactggtgtatctcacgttgctcttggtaatgctaaatctattactattaaggctagctcctcttctggtgccaccattaaggtttgtactggtaatgaaaagggtgatgtcctcggttatgttgaaattccagcaggtggttctttacaagaagttactgctgaaatttctaatgcttcaggtactaaggatctcttctttgttgcttctaattctgtttctatggaatcatggcaattaaagggtaa

SEQ ID NO: 15021 - DNA, 357 bp, Piromyces finnis; identical to SEQ ID NO: 15019
  CBD_IV

SEQ ID NO: 15022 - DNA, 357 bp, Piromyces finnis; identical to SEQ ID NO: 15020
  CBD_IV

SEQ ID NO: 15023 - DNA, 363 bp, Piromyces finnis
  CBD_IV
tgttgatgcctacagtaccaactacgcctcaatgatggcttggcaagctggtgtttcagttaatggtttaggacacaccactgtttcttacaacagaggtgattggactggtgtttctaacgttgactttggagacagtgccacttccgtaaagatatccgccgcttccagcaatggagccaccattagaattacttcaggcagtgaaaatggtgatgttattggatacgttactattccagctacaggtggtgataagaacttcaagaccgttacagctaatgttaaggcttctggtactaagaacatcttctttgttgcctctggtgatgttactattgatacctggcaattcattggatc

SEQ ID NO: 15024 - DNA, 357 bp, Piromyces finnis; identical to SEQ ID NO: 15020
  CBD_IV

SEQ ID NO: 15025 - DNA, 363 bp, Piromyces finnis; identical to SEQ ID NO: 15023
  CBD_IV

SEQ ID NO: 15026 - DNA, 363 bp, Piromyces finnis; identical to SEQ ID NO: 15023
  CBD_IV

SEQ ID NO: 15027 - DNA, 357 bp, Piromyces finnis; identical to SEQ ID NO: 15020
  CBD_IV

SEQ ID NO: 15028 - DNA, 357 bp, Piromyces finnis
  CBD_IV
tgttgatggttcagctcttaattatgctgctagtttcgcttggcaatatggtattagtgttaagggacaagctgcagttaccactgttaattattctcgtggtggttggactggtgtttccaatgttgctttaggtaatgctcaatctattactcttaaggcttcatctaaatcaggtgctactgttaagatttgtactggtagtgaaaatggtcaagctattggttatgttgatattccagctggtggttctttacaaaatgttactggtagtattagtggtgcttccggtactaaaaatcttttctttgttgcatctggtgatttaagtattgaatcatggcaattaggaggtgg

SEQ ID NO: 15029 - DNA, 363 bp, Piromyces finnis; identical to SEQ ID NO: 15023
  CBD_IV

SEQ ID NO: 15030 - DNA, 357 bp, Piromyces finnis; identical to SEQ ID NO: 15019
  CBD_IV

SEQ ID NO: 15031 - DNA, 357 bp, Piromyces finnis; identical to SEQ ID NO: 15019
  CBD_IV

SEQ ID NO: 15032 - DNA, 357 bp, Piromyces finnis; identical to SEQ ID NO: 15028
  CBD_IV

SEQ ID NO: 15033 - DNA, 84 bp, Neocallimastix californiae
  CBM_1
gcaacaatgtggtggtcaaaattataatggaccaacttgttgtgaagcaggtactacttgtgtaaaattaagtgattactacta

SEQ ID NO: 15034 - DNA, 84 bp, Neocallimastix californiae
  CBM_1
atatgatcaatgtggtggtgaaggttacttcggtccaactaaatgctgtaagggaaaatgtatttctcaaggaccatactattc

SEQ ID NO: 15035 - DNA, 84 bp, Neocallimastix californiae
  CBM_1
tgctcaatgtggtggtttaggttatgaaggatcaacttgttgtcaagctggtaccatttgtactgttgttaatgaacactattc

SEQ ID NO: 15036 - DNA, 84 bp, Neocallimastix californiae
  CBM_1
atacgatcaatgtggtggtgatggttacttcggtccaactgaatgttgtaagggaaaatgtatttctcaaggaccatactattc

SEQ ID NO: 15037 - DNA, 81 bp, Neocallimastix californiae
  CBM_1
tggtaaatgtggaggtaatgattggactggttcaacttgttgtatggttggtactagttgtcaaaaaattaatgaatgggt

SEQ ID NO: 15038 - DNA, 87 bp, Neocallimastix californiae
  CBM_1
cgatcaatgtggtggtgttggttacaatggtccaactaattgttgtaatccagattataaatgtaaggaatacggtacttactattt

SEQ ID NO: 15039 - DNA, 84 bp, Neocallimastix californiae
  CBM_1
cgctcaatgtggtggtattggttatgaaggtccaaattgttgtcaagccggtactgtttgtacagaaattaatgagcattattc

SEQ ID NO: 15040 - DNA, 87 bp, Neocallimastix californiae
  CBM_1
tgaaatgtgtggaggtacattgttcccaaatcaaccaacttgttgtgaacctggtaatacttgtgttattatgaatccaagatatca

SEQ ID NO: 15041 - DNA, 84 bp, Neocallimastix californiae
  CBM_1
gggtcaatgtggtggtgaaggatggaatggtccaacctgttgtaattcaggtagtgtttgtgttgtaacaaatcaatactatca

SEQ ID NO: 15042 - DNA, 87 bp, Neocallimastix californiae
  CBM_1
ggcacaatgtggaggtattgatttcaatggtcctacaacttgttgtgatccttccgctgtatgcaaatatttaaatgattattatta

SEQ ID NO: 15043 - DNA, 87 bp, Neocallimastix californiae
  CBM_1
atgggatcaatgtggtggtatgaattgggctggaccgaattgctgtgttgaaggaacatattgtacctttgttaatccatattattc

SEQ ID NO: 15044 - DNA, 87 bp, Neocallimastix californiae
  CBM_1
atggactcaatgtggtggacaaggatatacaggaccaacttgttgtaaatcaggatcaacttgtcatgaaattaataaatattattc

SEQ ID NO: 15045 - DNA, 72 bp, Neocallimastix californiae
  CBM_1
tggaggttccgaatatccagatgcctctccatgttgtgaagaaggttttacttgtagagcctataatgatct

SEQ ID NO: 15046 - DNA, 87 bp, Neocallimastix californiae
  CBM_1
tcaaccatgtggtggtaatgattatccaaatgctccaacttgttgtgaagctggatttgcttgtttaatgaagaatccaaattacca

SEQ ID NO: 15047 - DNA, 81 bp, Neocallimastix californiae
  CBM_1
tcgtccatgtggtggttcttatttccaagatggtccaaattgttgtgaaccaggttttatttgtgttgatgcaaatcctct

SEQ ID NO: 15048 - DNA, 87 bp, Neocallimastix californiae
  CBM_1
ctatgcccaatgtggtggtgtcaattatcatggttcaacaaagtgttgtggtaatttaacatgtgtatatcgtggtgaatattattc

SEQ ID NO: 15049 - DNA, 87 bp, Neocallimastix californiae
  CBM_1
atatggacaatgtggtggtataaattataatggtccaacatgttgtccaagcggttacacttgtaaatttattagtgattattatta

SEQ ID NO: 15050 - DNA, 81 bp, Neocallimastix californiae
  CBM_1
tgatcaatgtgatggtattaattataatggtccaaaatgttgttctgtaggtaaatgcgttagacttaatgattattatta

SEQ ID NO: 15051 - DNA, 84 bp, Neocallimastix californiae
  CBM_1
atgggctcaatgtggtggtatcggttttaacggtccaacctgttgttcctctggaaaatgtgttaaactcaatgattggtattc

SEQ ID NO: 15052 - DNA, 87 bp, Neocallimastix californiae
  CBM_1
ttgggatcaatgtggtggtgtaaatcaccggggtccattctgttgtgaatcaggtttaacttgtgtatttgtgaatgattattattc

SEQ ID NO: 15053 - DNA, 81 bp, Neocallimastix californiae
  CBM_1
tgaaatttgtggtggtaaaaactatccaaatgctccaaaatgttgtgaacctggttctaaatgtgttcacttcagtgaaga

SEQ ID NO: 15054 - DNA, 82 bp, Neocallimastix californiae
  CBM_1
tggacaatgtggcggtaccgactaccgtggttcaaccaagtgttgtgaaaatttaagatgtgtttatttaaatgattactat

SEQ ID NO: 15055 - DNA, 84 bp, Neocallimastix californiae
  CBM_1
tgaatattgtggaggtattaattatccaaaagcaccaaagtgttgtaagccaggttcaaaatgtgttaaatttaatgaatatca

SEQ ID NO: 15056 - DNA, 84 bp, Anaeromyces robustus
  CBM_1
tgcccaatgtggtggtaaagaatacacaggtccaaactgttgtcaagctggtactatttgtactgaaattaatgaacactactc

SEQ ID NO: 15057 - DNA, 84 bp, Anaeromyces robustus
  CBM_1
atatgatcaatgtggtggtgaaggttacttcggtccaactgaatgttgtaagggaaaatgtactagccaaggaccatactattc

SEQ ID NO: 15058 - DNA, 75 bp, Anaeromyces robustus
  CBM_1
tggtggtaaaagttatccagatgcatctccatgttgtgaagaaggttacagatgtgaagctgttaacgaatatat

SEQ ID NO: 15059 - DNA, 84 bp, Anaeromyces robustus
  CBM_1
ggatcaatgtggtggtgctacttattatggtccaacttgctgtgaaagcaatagtagatgtatcgtacataatgaatattattc

SEQ ID NO: 15060 - DNA, 78 bp, Anaeromyces robustus
  CBM_1
ttgtggtggttcaagtttccctgatgcttcaccatgttgtgaagaaggctatgtatgtgaattccaaaatgaatatgt

SEQ ID NO: 15061 - DNA, 81 bp, Anaeromyces robustus
  CBM_1
taatccatgtggtggtataaattatccagatgcttcaccatgttgtgaagaaggttacagatgtgaagtttataatgaact

SEQ ID NO: 15062 - DNA, 78 bp, Anaeromyces robustus
  CBM_1
taatgtttgtggtggtaccaattatccaaatgctccaaaatgttgtgaatctggttctacctgtgtagctttcagttc

SEQ ID NO: 15063 - DNA, 81 bp, Anaeromyces robustus
  CBM_1
ctatcaaccatgtggtggtatatactatcaaaattcaccaaaatgttgtaaatctggttctacctgtgtcaaaaatgatcc

SEQ ID NO: 15064 - DNA, 84 bp, Anaeromyces robustus
  CBM_1
gaaccaatgtggtggtaaagaatatactggaccaacatgttgtaatgaaaattatcattgtatttatgttaatgagtattactc

SEQ ID NO: 15065 - DNA, 84 bp, Anaeromyces robustus
  CBM_1
tgatcaatgtggtggtattggtttccgtggtccaacatgttgtgaaccaggtactacttgtgaatttgttgtagattattattc

SEQ ID NO: 15066 - DNA, 75 bp, Anaeromyces robustus
  CBM_1
tgatgcttgtggtggttcaaattatccaaattctccaagatgttgtattgaaggattaacttgtgtttatgaatc

SEQ ID NO: 15067 - DNA, 84 bp, Anaeromyces robustus
  CBM_1
tggtcaatgtggtggtattaattatacaggtccaacatgttgtccatctggatattcatgtaaaaaacataatgattattattc

SEQ ID NO: 15068 - DNA, 87 bp, Anaeromyces robustus
  CBM_1
tgaaaaatgtggtggtataggttataatggaccaacatgttgtgaaaaccctaactttaaatgtgaagtcattaacgaatatttcca

SEQ ID NO: 15069 - DNA, 84 bp, Anaeromyces robustus
  CBM_1
gcaacaatgtggtggtgttggatacaacggtccaacatgttgtaaaggtgattactattgtaaatcatatagtgattactactc

SEQ ID NO: 15070 - DNA, 99 bp, Anaeromyces robustus
  CBM_1
atggggtcaatgtggtggtaccgttaatggaaagaaatataatggttcaacttgttgtgtaagtggttataaatgtaaagaatacaataccaattatgc

SEQ ID NO: 15071 - DNA, 87 bp, Anaeromyces robustus
  CBM_1
tcaacaatgtggaggtcttaattataaaggtacaattagttgttgtgaagaaggttatttctgtcataaaaatgatgaacattacca

SEQ ID NO: 15072 - DNA, 72 bp, Anaeromyces robustus
  CBM_1
tggtggtactaattatcctaatgctccaaaatgttgtgaatctggttctacttgtgtagcctttagtgaaat

SEQ ID NO: 15073 - DNA, 45 bp, Anaeromyces robustus
  CBM_1
gggtcaatgtggtggtattaattacaatggtctaacttgctgttt

SEQ ID NO: 15074 - DNA, 63 bp, Anaeromyces robustus
  CBM_1
ttgtggtggtaaacttttcccagatgcaccaacttgttgtgaacaaggttctaaatgtattat

SEQ ID NO: 15075 - DNA, 81 bp, Anaeromyces robustus
  CBM_1
tgcacaatgtgatggtgatggttataatggtccaaaatgttgtcaatctggtcaatgtgttaaagttaataattggtattc

SEQ ID NO: 15076 - DNA, 84 bp, Anaeromyces robustus
  CBM_1
tgaacaatgtggtggtttttacttttccggtccaaattgctgtgaagagggtagtagatgtatttatcaaaatgattattattc

SEQ ID NO: 15077 - DNA, 87 bp, Piromyces finnis
  CBM_1
atggcaacaatgtggtggtattggctacagtggtccaacacaatgtgaatcaggtagtgaatgtgttgctaccaatgaattttattc

SEQ ID NO: 15078 - DNA, 84 bp, Piromyces finnis
  CBM_1
tgctcaatgtggtggtcttggttatgaaggttcaacctgttgtcaagctggtactatctgtactgtagttaatgaacattactc

SEQ ID NO: 15079 - DNA, 81 bp, Piromyces finnis
  CBM_1
tggtaagtgtggtggtaaggattggactggttctacctgttgtatggttggtactagttgtaaggaagttaacgaatgggt

SEQ ID NO: 15080 - DNA, 84 bp, Piromyces finnis
  CBM_1
atatgatcaatgtggtggtgatggctactttggtccaactgaatgttgtaagggaaaatgtatttctcaaggaccatactattc

SEQ ID NO: 15081 - DNA, 84 bp, Piromyces finnis
  CBM_1
ctatggtaagtgtggtggtaaggattggactggttctacctgttgtatggttggtactagttgtaaggaagttaacgaatgggt

SEQ ID NO: 15082 - DNA, 87 bp, Neocallimastix californiae
  CBM_10
atgttgttcttctccaaatgctgaagtttattacactgataacgatggtaagtggagtgtcgaaaacaacgattggtgtggtattcc

SEQ ID NO: 15083 - DNA, 111 bp, Neocallimastix californiae
  CBM_10
atgctgggctaagaagttaggatattcttgctgtacttcaacctctagagttgaatacactgataatgatggtaagtggggtattgaaaatggtaactggtgtggtattgt

SEQ ID NO: 15084 - DNA, 102 bp, Neocallimastix californiae
  CBM_10
tactggtaatggcgcttaccaatgctgtaactcttgtactactacctacactgataatgatggtagatggggttatgaaaatggtgactggtgtggtattaa

SEQ ID NO: 15085 - DNA, 114 bp, Neocallimastix californiae
  CBM_10
ttgggctcaaagccaaggttacaaatgttgtgataacccaggtagcactaaagttgaattctctgatggcagtggtcaatggggtattcaaaatggtgattggtgtggtattga

SEQ ID NO: 15086 - DNA, 102 bp, Neocallimastix californiae
  CBM_10
taccggtaatggtaattacccatgctgtaatacttgtactgctacttataccgatggtgaaggtaagtgggccattgaaaatggtaactggtgtggtattaa

SEQ ID NO: 15087 - DNA, 99 bp, Neocallimastix californiae
  CBM_10
tgctcaaggttacaattgctgtaaatcttgtggtactgtttacttcgaagatggtgatggcaaatggggtgttgaaaacaataactggtgtggtatgcc

SEQ ID NO: 15088 - DNA, 114 bp, Neocallimastix californiae
  CBM_10
tccagcctctatcactcgtcaaggttacaaatgttgtagagttggatgtactgttgaatacactgataatgatggtgaatggggtgttgaagatggtgactggtgtggttgtgg

SEQ ID NO: 15089 - DNA, 96 bp, Neocallimastix californiae
  CBM_10
ccaaggttacaaatgctgttcaacctgtggtaccgtttactacactgatgctgatggtgattggggtgttgaaaacaacgactggtgtggtatgcc

SEQ ID NO: 15090 - DNA, 114 bp, Neocallimastix californiae
  CBM_10
ttccgctgctattactgctcaaggttacaagtgctgttctaacaactgtgaagttgtttactctgatgatgatggtgactggggtgttgaaaacaaccaatggtgtggttgtgg

SEQ ID NO: 15091 - DNA, 114 bp, Neocallimastix californiae
  CBM_10
ttctgctgctattactgctcaaggttacaagtgctgttctgccaactgtgttgttgaatacaccgatgctgacggtgactggggtgttgaaaacggtcaatggtgtggttgtgg

SEQ ID NO: 15092 - DNA, 114 bp, Neocallimastix californiae
  CBM_10
tccagcttctatcaccaaccaaggttacccatgctgttcatcctgtggtaccgtctactacactgataatgatggtttatggggtgttgaaaacaatgactggtgtggtatgcc

SEQ ID NO: 15093 - DNA, 114 bp, Neocallimastix californiae
  CBM_10
ttcagcagctatcactaaccaaggttacaagtgctgttcagctaactgtgaagttgtttacaccgatggtgatggtgactggggtgttgaaaacaatgaatggtgtggttgtgg

SEQ ID NO: 15094 - DNA, 96 bp, Neocallimastix californiae
  CBM_10
ccaaggttacaagtgctgttcttcatgttccactgtttactacagcgataatgatggtgattggggtgttgaaaacaatgactggtgtggtatgcc

SEQ ID NO: 15095 - DNA, 114 bp, Neocallimastix californiae
  CBM_10
tccagcttctatcaccaatcaaggctataagtgctgttcttcatgttccactgtttactacaccgataatgatggtgcttggggtgttgaaaataatgactggtgtggtatgcc

SEQ ID NO: 15096 - DNA, 96 bp, Neocallimastix californiae
  CBM_10
tcaaggttacaaatgttgctctgctaactgtgaagttgtttacactgataatgatggtgattggggtgttgaaaatggtcaatggtgtggttgtgg

SEQ ID NO: 15097 - DNA, 114 bp, Neocallimastix californiae; identical to SEQ ID NO: 15093
  CBM_10

SEQ ID NO: 15098 - DNA, 96 bp, Neocallimastix californiae; identical to SEQ ID NO: 15094
  CBM_10

SEQ ID NO: 15099 - DNA, 76 bp, Neocallimastix californiae
  CBM_10
ttggtctgaaaaacttggatatccatgctgtcaaaatacctcttctgttgtttacacagataatgatggtaattgg

SEQ ID NO: 15100 - DNA, 108 bp, Neocallimastix californiae
  CBM_10
ctgtttcagtgtaaaccttggctacagttgttgtaacggttgtgaagttgcttacactgattctgatggtaaatggggtgttgaaaatggtaattggtgtggaataaa

SEQ ID NO: 15101 - DNA, 111 bp, Neocallimastix californiae
  CBM_10
tgctgatatggctccaaatggtttcccatactgtcaatattgtgaagttggtgctactggtggtgatggttctctttggggatgggaaaatgaacaatcttgtgttgttga

SEQ ID NO: 15102 - DNA, 96 bp, Neocallimastix californiae
  CBM_10
tccaaatggtttcccatactgtcaatattgtgaagttggtgctactggtggtgatggttctctttggggatgggaaaatgaacaatcttgtgttgt

SEQ ID NO: 15103 - DNA, 111 bp, Neocallimastix californiae
  CBM_10
ctgttggtctgaaagccttggttttccatgctgccaaaacaccaaagaagtttactacactgataatgatggtaattggggtgttgaaaataataactggtgtggtatcat

SEQ ID NO: 15104 - DNA, 105 bp, Neocallimastix californiae
  CBM_10
ttttagcataaaccttggttacaaatgttgttctggttgtgatattgtatatgttgatcaagatggtaattggggtgttgaaaatgatcaatggtgtggaattaa

SEQ ID NO: 15105 - DNA, 114 bp, Neocallimastix californiae
  CBM_10
taatgccaatattattgctcaaggttacaagtgctgtaaatcttgtggtactgtttactacgaagatggtgatggtcaatggggtgttgaaaacaatgactggtgtggtatgcc

SEQ ID NO: 15106 - DNA, 114 bp, Neocallimastix californiae; identical to SEQ ID NO: 15088
  CBM_10

SEQ ID NO: 15107 - DNA, 108 bp, Neocallimastix californiae
  CBM_10
ttgttttgctgaaagattaggttacccatgttgtaaaggaaacactgttgcttacactgataatgatggtaaatggggtgtcgaaaatggtaactggtgtggtattgc

SEQ ID NO: 15108 - DNA, 114 bp, Neocallimastix californiae
  CBM_10
ttgttggtctacaagtttaggttatccatgttgttcatcttccagtgctcaagtttattacactgataatgatggtaaatggggtgttgaaaatggtgactggtgtggtattcc

SEQ ID NO: 15109 - DNA, 114 bp, Neocallimastix californiae
  CBM_10
ttgttgggcagaagctttaggttacaagtgttgtactccaggtgcctacactccagttcttttaactgatgaaagtggtgattggagtgctgaaaatggtgaatggtgtggtct

SEQ ID NO: 15110 - DNA, 108 bp, Neocallimastix californiae
  CBM_10
ttttgccaaatctgatggatacgactgttgtttcgataatgaagttgtttatgaagatgaaacaggtaaatggggtattaatgatgaaggtgaatggtgtggtgttga

SEQ ID NO: 15111 - DNA, 114 bp, Neocallimastix californiae
  CBM_10
atgttgggctaatgcctatggttatgactgctgtgttgatggtactcttacatacttagaagatgaaactggaaaatggggtgttacctctgactaccaatggtgtggtattaa

SEQ ID NO: 15112 - DNA, 114 bp, Neocallimastix californiae
  CBM_10
ttgctggtccctttctcaaggttacccatgctgttcctcttcaaatgctgaagtttggtacactgatgcctcaggtaaatggggtgttgaaaatggagactggtgtggtattcc

SEQ ID NO: 15113 - DNA, 81 bp, Neocallimastix californiae
  CBM_10
atgttgttctggaaatgacgttgtttacaccgacaatgatggtaaatggggtgtagaaaatggtaactggtgtggtattgc

SEQ ID NO: 15114 - DNA, 117 bp, Neocallimastix californiae
  CBM_10
tatctccgaatttctcggttatccatgttgtagtagcagtaatactcctgtttattacaaagatgatgatggtgattggggtattgattcagctactggtgattggtgtggtattac

SEQ ID NO: 15115 - DNA, 111 bp, Neocallimastix californiae
  CBM_10
ctgttggtcaactaaatttggttatccatgttgtaaaaagacatgtactgctatagaaaaagataaagatggttcatgggctattgaaggatcacactggtgtggtattcc

SEQ ID NO: 15116 - DNA, 111 bp, Neocallimastix californiae
  CBM_10
ctgttggtcaactaaattaggttatccatgttgtaaaaagacatgtactgctattgaaaaagataacgatggtgcatgggctattgaaggatcacactggtgtggtattcc

SEQ ID NO: 15117 - DNA, 120 bp, Neocallimastix californiae
  CBM_10
atgtgtctccgaatttctcggttatccatgttgtagtagcagtaacactcttgtttattacaaagatgatgatggtgattggggtgttgatccagctactggtgattggtgtggtattac

SEQ ID NO: 15118 - DNA, 108 bp, Neocallimastix californiae
  CBM_10
ctgtaaattcgaagctcttggttacaagtgctgttctcactgtgttagttaccttgaagatgaagatggtttatggggtgttgaaaatggtgaatggtgtggaattac

SEQ ID NO: 15119 - DNA, 108 bp, Neocallimastix californiae
  CBM_10
atgttggtctaataaattcggttacccatgctgtgatacctgtgacgttttcttaactgatgaatctggtgattggggtgttaaagaccttgattggtgtggtgttcc

SEQ ID NO: 15120 - DNA, 111 bp, Neocallimastix californiae
  CBM_10
ttgttggtctgaaagcttaggttacccatgctgttcttccaatactggtgttgcatacattgataatgatggtgaatggggtgttgaaaatggtggctggtgtggtattcc

SEQ ID NO: 15121 - DNA, 111 bp, Neocallimastix californiae
  CBM_10
ttgttggtctgaaagcttaggttacccatgctgttcttccaatactggtgttgcatacattgataatgatggtgaatggggtgttgaaaatggtggctggtgtggtattaa

SEQ ID NO: 15122 - DNA, 114 bp, Neocallimastix californiae
  CBM_10
ttgttggtctcaaaaacttggttacccatgttgttcttcttctagtgctgaagtttggtacaccgacaatgatggtaaatggggtgttgaaaacaatgactggtgtggtattcc

SEQ ID NO: 15123 - DNA, 111 bp, Neocallimastix californiae
  CBM_10
ttgctgggctgaagctttaggattcaagtgttgtgaaactactaatgaagtagttttcactgacgatagtggtaaatggggtgttgaaaatggtgaatggtgtggtataaa

SEQ ID NO: 15124 - DNA, 111 bp, Neocallimastix californiae
  CBM_10
atgtttttctgaaaaaatgggtattcaatgctgtccagaaggaactgaaatatattataccgataatgatggtaactggggtatttacaaaaatgattggtgtggtattgc

SEQ ID NO: 15125 - DNA, 114 bp, Neocallimastix californiae
  CBM_10
ctgttggtctgaatctcaaggctacaaatgctgtaagaattctaacacaaaggttgaattcactgatgatagtggagaatggggtattgaaaataatgattggtgtggaattcc

SEQ ID NO: 15126 - DNA, 61 bp, Neocallimastix californiae
  CBM_10
ttgggctactaaattaggttacccttgctgtaaaactaccaccactactgaatacactgat

SEQ ID NO: 15127 - DNA, 120 bp, Neocallimastix californiae
  CBM_10
atgttggtcaatgaaattaaatccacctattccatgttgtacaggaaaagatttaaaagttatcgaagaagattcaaatggaaaatggtctgaagaaaatggggaaaagtgtggtattcc

SEQ ID NO: 15128 - DNA, 120 bp, Neocallimastix californiae
  CBM_10
atgttggtcattggaattagctaatcctttcccatgttgttctgatccaaatgcaactgttgaatatactaatgataaaggagattggggtgttgaaaatggtcaatggtgtggtataat

SEQ ID NO: 15129 - DNA, 111 bp, Neocallimastix californiae
  CBM_10
ttgttggtcattaccagactatccatgctgtagtgatccaaatactactcctatagaaattgatggtagtggtgaatggggtgttgaaaatggtgaatggtgtggtattcg

SEQ ID NO: 15130 - DNA, 123 bp, Neocallimastix californiae
  CBM_10
atgttggtcagaaaaatatggatatccttgttgtgaaagattaaatcattcttatattgaacaaggtactgaagaagaaaatgcatattgggcaattgaaaatggaaattattgtggtgtacc

SEQ ID NO: 15131 - DNA, 108 bp, Neocallimastix californiae
  CBM_10
ttggtcattaccagactatccatgctgtagtgatccaaatactactcctatagaaactgatgatagtggtgaatggggattagaaaatggtgattggtgtggtattat

SEQ ID NO: 15132 - DNA, 111 bp, Neocallimastix californiae
  CBM_10
gtgttggtctgaagctgaaggctacccatgctgtagttcaaatactgctgttgttctcactgacagcaaaggaaaatggggtatagaaaacggtgattggtgtggtattat

SEQ ID NO: 15133 - DNA, 114 bp, Neocallimastix californiae
  CBM_10
ctgttgggcttcaggtttaggttacaaatgctgttctggctgtgatgtcattttatctgacagtaatggaaagtggggatttgattttgaaactaatgattggtgtggtattat

SEQ ID NO: 15134 - DNA, 99 bp, Neocallimastix californiae
  CBM_10
tacaaaggatggtttcagctgctgtaaaaagtgtgatgtcgtcttagttgatgacaatggtaaatggggtgttgaagacaatcaatggtgtggtattga

SEQ ID NO: 15135 - DNA, 111 bp, Neocallimastix californiae
  CBM_10
ttgttggtctgaagctgaaggctacccatgctgtagttcaaatactgctgttgttctcactgacagcaaaggaaaatggggtatagaaaacggtgattggtgtggtattat

SEQ ID NO: 15136 - DNA, 81 bp, Neocallimastix californiae
  CBM_10
ctgttgggcttcaggtttaggttacaaatgctgttctggctgtgatgtcattttatctgacagtaatggaaagtgggcagc

SEQ ID NO: 15137 - DNA, 108 bp, Neocallimastix californiae
  CBM_10
ctgttgggcttcaggtttaggttacaaatgctgttctggctgtgatgtcattttatctgacagtaatggaaaatggggtatagaaaacggtgattggtgtggtattat

SEQ ID NO: 15138 - DNA, 114 bp, Neocallimastix californiae
  CBM_10
ttgctggtcaacaagtttaggttatccatgttgttcatcttctagtgcccaagtttactacactgataatgacggaaagtggggtgttgaaaataatgactggtgtggtattcc

SEQ ID NO: 15139 - DNA, 108 bp, Neocallimastix californiae
  CBM_10
atgcttctctcaaagtttaggttatccatgttgttctggaaatgacgttgtttacatcgataatgatggtaaatggggtgttgaaaatggtaactggtgtggtattgc

SEQ ID NO: 15140 - DNA, 114 bp, Neocallimastix californiae
  CBM_10
ttgttggtcacaacctctcggatatccatgttgttcttctccaaatgctgaagtttattacactgataacgatggtaagtggagtgtcgaaaacaacgattggtgtggtattcc

SEQ ID NO: 15141 - DNA, 99 bp, Neocallimastix californiae
  CBM_10
ttcaaaggacggttacccatgctgtaagggttgttccgttgttgatcaagatggttccggtaaatggggtattgaaaatggtaattggtgtggtattga

SEQ ID NO: 15142 - DNA, 108 bp, Neocallimastix californiae
  CBM_10
ctgttgggcttcatctcaaggttataattgttgttctggttgtgacccaattctcactgatggtagtggaaagtggggttttgaaaatggtaactggtgtggtattat

SEQ ID NO: 15143 - DNA, 111 bp, Neocallimastix californiae
  CBM_10
ttgttgggctgctgctgaaggttacccatgttgtactagtaccactactgttgaaattgttgacagtaaaggtaaatggggtattgaaaatggaaactggtgtggtattgt

SEQ ID NO: 15144 - DNA, 111 bp, Neocallimastix californiae
  CBM_10
ttgggctacttctttgggctacaagtgttgtagtaatccaaacactgaaagtgtttatgaagatgaaagtggtgaatggggtgttgaaaataatgactggtgtggtattgt

SEQ ID NO: 15145 - DNA, 108 bp, Neocallimastix californiae
  CBM_10
ttggtctgaaaagttaggatataaatgttgttcaacatgtacccaagtttattataatgatcaagatggtagttggggtgttgaaaacaatgactggtgtggtattcc

SEQ ID NO: 15146 - DNA, 111 bp, Neocallimastix californiae
  CBM_10
atgttggtctattgcattaggctacccatgttgtgaggttaatgattttgttgttcaaactgatgaaaatggtgactggagtgttgaaaacaacgattggtgtggtattaa

SEQ ID NO: 15147 - DNA, 117 bp, Neocallimastix californiae
  CBM_10
atgtttctcacttaatcttggttatccatgctgtgaaaatgatagtgacgataatattattttcaccgatgaaaatggtgattggggtattgaaaacaataattggtgtggcattgg

SEQ ID NO: 15148 - DNA, 111 bp, Neocallimastix californiae
  CBM_10
ttgttggtctactgctttaggtttcccatgttgtgaagtaaataagtttattgtattttcagatgaaaacggtgattggagtgttgaaaacaataattggtgtggaatctt

SEQ ID NO: 15149 - DNA, 108 bp, Neocallimastix californiae
  CBM_10
ttggtctactgtattgggttacccatgttgtgaagttaacgattttattgttaacactgatgaatacggaagttggagtgttgaaaataacgattggtgcggtattaa

SEQ ID NO: 15150 - DNA, 111 bp, Neocallimastix californiae
  CBM_10
atgttggtctactgctttaggcttcccatgttgtgaagttaatgataatgttgttcactctgatgaatatggagattggggtgttgaaaacaatgattggtgtggtattaa

SEQ ID NO: 15151 - DNA, 108 bp, Neocallimastix californiae
  CBM_10
ttgttggtctcaagcccttggatatccatgttgtaaatcaacatccgatgtttattacactgatgatgatggtaactggggtgtagaaaatggaaattggtgtggtct

SEQ ID NO: 15152 - DNA, 108 bp, Neocallimastix californiae
  CBM_10
atgtttctctattgctcttggttatccatgttgtaaaggtaatgacattgtttatacagatgatgacggtaattggggtgttgaaaacaacgaatggtgtggtattaa

SEQ ID NO: 15153 - DNA, 105 bp, Neocallimastix californiae
  CBM_10
ttgggctactaaattaggttacccttgctgtaaaactaccaccactactgaatacactgatgctgatggtgaatggggtattgaaaacggaaactggtgtggtct

SEQ ID NO: 15154 - DNA, 117 bp, Neocallimastix californiae
  CBM_10
ctgctgggctaagaatcttggctacccatgttgttctactaacacctgtagaaccgtttactatactgatgctgatggtaagtgggatgtcgaaaacaatgactggtgtggtattac

SEQ ID NO: 15155 - DNA, 111 bp, Neocallimastix californiae
  CBM_10
ttgctggtctcaaagacttggatatccatgttgtaccaataattcagcagtttactttactgataatgatggtaaatggggtattcaaaatgacgactggtgtggtataaa

SEQ ID NO: 15156 - DNA, 114 bp, Neocallimastix californiae
  CBM_10
ttgttggtctaagaaacttggttatccatgctgttcaaataagaatgcctcagttgaatacactgatggtgatggtcaatggggtattgaaaatggtgattggtgtggtattgt

SEQ ID NO: 15157 - DNA, 105 bp, Neocallimastix californiae
  CBM_10
ttgggctaaagctttaggttacccatgttgtactcaagctactgaagttgtttacactgattctaatggtcaatggggtatccaaaataacgactggtgtggtaa

SEQ ID NO: 15158 - DNA, 114 bp, Neocallimastix californiae
  CBM_10
ttgggctagatctcttggttacaactgttgtagcacttctacttgtagaaatgctcaattctctgataatgatggtcaatgggatattgaaaacggtaactggtgtggtatcgc

SEQ ID NO: 15159 - DNA, 108 bp, Neocallimastix californiae
  CBM_10
atgtttcagtgttgccttaggttacccatgttgtaagggtagtgaagttgtttacactgataacgatggtaagtggggatttgaaaatggtcaatggtgtggtattgc

SEQ ID NO: 15160 - DNA, 96 bp, Neocallimastix californiae
  CBM_10
tggttacaagtgctgtactcaatctaaccctaccgttgtatacactgatgcttctggagaatgggctgttgaaaacggagattggtgtattattaa

SEQ ID NO: 15161 - DNA, 105 bp, Neocallimastix californiae
  CBM_10
tccagattacaagaatggttacccagtttgtaagaaaaccactaccgttgtttacaccgattctgaaaagtggggtgttgaaaacaatgactggtgtatcatgtg

SEQ ID NO: 15162 - DNA, 87 bp, Neocallimastix californiae
  CBM_10
tgattacccatgctgtaatgaatgtgacgttgtttatacagatgattctggtgactggggtattgaaaacaatgattggtgtttact

SEQ ID NO: 15163 - DNA, 90 bp, Neocallimastix californiae
  CBM_10
aggttacagtaaatgtagtaactgtgatgttcaatactctgatggatccggtgattggggtgttgaaaatggtgactggtgtggtatcag

SEQ ID NO: 15164 - DNA, 105 bp, Neocallimastix californiae
  CBM_10
tttcgctaaagctttaggttatgaatgttgtaatgataatgaaattgttacatctgatgaatctggtgattggggtgttaaggatggtgaatggtgtggtattgg

SEQ ID NO: 15165 - DNA, 111 bp, Neocallimastix californiae
  CBM_10
ttgttggtctgaaagacttggatatccatgctgtcaaagtacctcttctgttgtttacacagataatgatggtaaatggggtgttgaaaatggcaattggtgtggtattta

SEQ ID NO: 15166 - DNA, 108 bp, Neocallimastix californiae
  CBM_10
ttgtttcagtgtaaaccttggctacagttgttgtaacggttgtgaagttgtttacactgattctgatggtaaatggggagttgaaaatggaaattggtgtggaataaa

SEQ ID NO: 15167 - DNA, 108 bp, Neocallimastix californiae
  CBM_10
ttgtttcagtgtaaaccttggctacagttgttgtaacggttgtgaagttgtttacactgattctgatggtaaatggggagttgaaaatggtaattggtgtggaataaa

SEQ ID NO: 15168 - DNA, 111 bp, Neocallimastix californiae; identical to SEQ ID NO: 15165
  CBM_10

SEQ ID NO: 15169 - DNA, 102 bp, Neocallimastix californiae
  CBM_10
ttggtcacttccagaatatccatgctgtgtcggtagtaaggtaattgaaacagacaaacaaggtgattggggttatgaagataatcactggtgtggtatagt

SEQ ID NO: 15170 - DNA, 102 bp, Neocallimastix californiae
  CBM_10
ttggtctcttccagattatccatgttgtaaaggtaatgatattataacaacagatagtcaaggagattggggttatgaagataaacattggtgtggtataat

SEQ ID NO: 15171 - DNA, 105 bp, Neocallimastix californiae
  CBM_10
ctggtcaacagtcctgggatatgactgttgtaaaggatgtcatgtttatgaagaagatactgacggaaaatggggttatgaaaataaaaaatggtgtggtattga

SEQ ID NO: 15172 - DNA, 102 bp, Neocallimastix californiae; identical to SEQ ID NO: 15169
  CBM_10

SEQ ID NO: 15173 - DNA, 102 bp, Neocallimastix californiae; identical to SEQ ID NO: 15170
  CBM_10

SEQ ID NO: 15174 - DNA, 105 bp, Neocallimastix californiae
  CBM_10
ctggtcgacagtcttgggatatgactgttgtaaaggatgtcatgtttatgaagaagatactgacggaaaatggggttatgaaaataaaaaatggtgtggtattga

SEQ ID NO: 15175 - DNA, 108 bp, Neocallimastix californiae
  CBM_10
ttgggctttagctgaaggttataattgttgtagtcctggtaccccagtatcaattactgatagcaaaggtaaatggggtattgaaaatgaagaatggtgtggtattat

SEQ ID NO: 15176 - DNA, 108 bp, Neocallimastix californiae
  CBM_10
ttgctgggcagaagctgaaggtttcagatgctgtaaaggttgcgaagctatctatattgatggtgataaaagatggggtgttgaaaatatggaatggtgtggtattat

SEQ ID NO: 15177 - DNA, 93 bp, Neocallimastix californiae
  CBM_10
agatggttataattgttgtagtggttgttctgtttcttatgaagatgaaactggtaaatggggtattgaaaatggtcaatggtgtggtattga

SEQ ID NO: 15178 - DNA, 114 bp, Neocallimastix californiae
  CBM_10
atgttggtccgaaaagtatggttatgaatgttgttcaccaaacaatactaaggttgtagtcagtgatgaaagtggtaaatggggtgttgaaaatggtaactggtgtggtgttct

SEQ ID NO: 15179 - DNA, 108 bp, Neocallimastix californiae
  CBM_10
ttgttggtcacttccatttggatacccatgttgtccacattgtaaggctcttactaaggatgagaatggtaaatggggagaattaaatggagaatggtgtggtattgt

SEQ ID NO: 15180 - DNA, 108 bp, Neocallimastix californiae
  CBM_10
ttgttggtcacttccatttggatacccatgttgtccacattgtaattctcttactaaggatgagaatggtaaatggggagaattaaatggagaatggtgtggtattgt

SEQ ID NO: 15181 - DNA, 114 bp, Neocallimastix californiae
  CBM_10
atgttggtccgaaaagtatggttatgaatgctgctcaccaaacaatactaaggttgtagtcagtgatgaaaatggtaaatggggtgttgaaaatggtaactggtgtggtgtttt

SEQ ID NO: 15182 - DNA, 111 bp, Neocallimastix californiae
  CBM_10
atgcaatgaacaaccagatgatgattacccaacatgttcagctaatattgaaattgcttacgttgatgacagaatttggggtattgaaaatggcgactggtgtattattaa

SEQ ID NO: 15183 - DNA, 87 bp, Neocallimastix californiae
  CBM_10
ctacaagtgctgtgaaacatgtgaagttcaatactctgatgatactggatcttggggtattgaaaataatgattggtgtggtattcc

SEQ ID NO: 15184 - DNA, 108 bp, Neocallimastix californiae
  CBM_10
ttgtttcgctgaaagattaggttacccatgttgttctggtaacgaagttgtttacaccgataacgatggaaagtggggtgtagaaaatggtaattggtgtggtattgc

SEQ ID NO: 15185 - DNA, 114 bp, Neocallimastix californiae
  CBM_10
ttgctggtctctttctcaaggttatccatgctgttcttcttcaaatgctgaagtttggtacaccgatgcctcaggtaaatggggtgttgaaaatggagactggtgtggtattcc

SEQ ID NO: 15186 - DNA, 96 bp, Neocallimastix californiae
  CBM_10
tggctatccatgttgtgataaaacaactgaagttgtttatgaagatgaagatggtaaatggggtgttcaaaatggtgatgaatggtgtttaataaa

SEQ ID NO: 15187 - DNA, 114 bp, Neocallimastix californiae
  CBM_10
atgttggagtaaagcccttggatatccatgctgtactactacaaaggaagttgtatataccgatgaaagcggtaaatggggtcttgaaggaaatgatgaatggtgtggtattgt

SEQ ID NO: 15188 - DNA, 90 bp, Neocallimastix californiae
  CBM_10
agaatatggtgaatgtacttcttgtgttgttcaatataaggatcaagatggtaactggggttatgaaaatgatgactggtgcttaattaa

SEQ ID NO: 15189 - DNA, 108 bp, Neocallimastix californiae
  CBM_10
ttgtactggaaagagtgaaggttataagtgctgtgacaactgtgatgtagtttacactgatgactctggtgcttggggtattatgaatggagattggtgtggtattaa

SEQ ID NO: 15190 - DNA, 81 bp, Neocallimastix californiae
  CBM_10
tccatgttgtagctcttgtactgttgtctacaatgacagtgatggtgattggggtgttgaaaatggtaactggtgtaagat

SEQ ID NO: 15191 - DNA, 105 bp, Neocallimastix californiae
  CBM_10
tttctcattagcattaggttacccatgttgttctggaactactgttgaatattcagataatgatggtgactggggtttcgaaaatggtgattggtgtggtattgg

SEQ ID NO: 15192 - DNA, 90 bp, Neocallimastix californiae
  CBM_10
actttacccatgttgtacttcttgtaatagcgtttacgaagatgatgatggtaaatggggtgttgaaaatgatgactggtgtttaattaa

SEQ ID NO: 15193 - DNA, 111 bp, Neocallimastix californiae
  CBM_10
atgttggagtaaagctttaggttatgactgttgtaaggaaggtaccgaagttgtttatactgatgaaagtggtaaatggggtgttactggtgacaactggtgtggtataat

SEQ ID NO: 15194 - DNA, 90 bp, Neocallimastix californiae
  CBM_10
cggttatgaatgttgtaaatcttgtgatgttgaattaactgacgatgatggtgaatggggtattgaaaataatcaatggtgtggtattga

SEQ ID NO: 15195 - DNA, 111 bp, Neocallimastix californiae
  CBM_10
ctgttggtctcttaagttaggttacccatgttgtcaaaacactaatgtcgtctattacacagatgatgatggtgattggagtgttgaaaataatgactggtgtggtattgt

SEQ ID NO: 15196 - DNA, 108 bp, Neocallimastix californiae
  CBM_10
tttctctacaaagttaggttatccatgttgtacctccacttctgatgttgtttacactgatgatgatggtgactggggtattgaaaacaataattggtgtggtattga

SEQ ID NO: 15197 - DNA, 108 bp, Neocallimastix californiae
  CBM_10
ttgtttttcagaaaaacttggttataaatgttgtaaaagaaatgaagttgtttataccgataatgatggtgattggggtgttgaagataatgaatggtgtggtatttc

SEQ ID NO: 15198 - DNA, 108 bp, Neocallimastix californiae
  CBM_10
ctggtctactgcattaggttacccatgttgtaaaaactctagtattgtttatttcactgataatgatggtaaatggagtgttgaaaataatgattggtgtggtattat

SEQ ID NO: 15199 - DNA, 108 bp, Neocallimastix californiae
  CBM_10
tttttctgaagcattaggttatccttgttgtagtagtggtgtagcagtcgtatacactgataatgatggaccatggggtgtggaaaacaatgattggtgtggtattac

SEQ ID NO: 15200 - DNA, 111 bp, Neocallimastix californiae
  CBM_10
ttgtttctctgttgcacttggttacaattgttgtcaacatacaacagaggttatttatgttgataatgatggatcatggggtattgaaaacaatgattggtgtggaatagg

SEQ ID NO: 15201 - DNA, 102 bp, Neocallimastix californiae
  CBM_10
tttcgcccttgatttaggtttcaaatgttgtaataataatgaagttgtctataccgatcaagatggtaagtggggatataccgatgactggtgtggtattgg

SEQ ID NO: 15202 - DNA, 90 bp, Neocallimastix californiae
  CBM_10
tggtgattacccatgttgtagtacttgtgaagcttcctatgttgataatgaaggtggttggaatgttgaaaataatgactggtgtaagat

SEQ ID NO: 15203 - DNA, 108 bp, Neocallimastix californiae
  CBM_10
atgtttcgccactaaactcggttatggttgctgtactggttgtgaagttaactacactgatgatgatggtgcttggggtattgaaaatggtaactggtgtggaattcc

SEQ ID NO: 15204 - DNA, 108 bp, Neocallimastix californiae
  CBM_10
atgtttcgccacaaagcttggttatgattgttgttcaggttgtgatgttaactacactgatggcgatggtgcctggggtattgaaaatggtaactggtgtggaattaa

SEQ ID NO: 15205 - DNA, 114 bp, Neocallimastix californiae
  CBM_10
ttgttggtcagaagcattaggatattcatgttgtactaattcatcttctccagtagtttatactgatgatgatggtcaatggagtgttgaaaataatgaatggtgtggtatttt

SEQ ID NO: 15206 - DNA, 117 bp, Neocallimastix californiae
  CBM_10
atgttgggctaatactcttggttatcaatgttgtaatacctctaattgtagaaatattatatatgaagataatgatggtcaatgggatgttgataataatcaatggtgtggtattac

SEQ ID NO: 15207 - DNA, 73 bp, Neocallimastix californiae
  CBM_10
ttgttggtcacaacctctcggatatccatgttgttcttctccaaatgctgaagtttattacactgataacgat

SEQ ID NO: 15208 - DNA, 111 bp, Neocallimastix californiae
  CBM_10
ttggtcacaatctctcggatatccatgttgttcttctccaaatgctgaagtttattacactgataacgatggtaagtggagtgtcgaaaacaacgattggtgtggtattcc

SEQ ID NO: 15209 - DNA, 96 bp, Neocallimastix californiae
  CBM_10
tcaaggatatccatgctgccaaaattcttgtattgtatactctaccgatgctgacggtagatggagtattgaaaatggtgactggtgtttaataaa

SEQ ID NO: 15210 - DNA, 108 bp, Neocallimastix californiae
  CBM_10
ttgctggtcttctagattaggttatccatgttgtaagagctgcaatgttgttttcactgataatgatggaaaatggggtgttgaaaatgatgactggtgtggtatttc

SEQ ID NO: 15211 - DNA, 108 bp, Neocallimastix californiae
  CBM_10
ttgggcttctgctttaggtttcaactgttgtaagactactaagactgttgtctttgaagatcaagatggtagttggggtgttgaagatgatttctggtgtggtatcgt

SEQ ID NO: 15212 - DNA, 96 bp, Neocallimastix californiae
  CBM_10
ccaaggttatccatgttgtaagactgcaactgaagttttctacactgataatgatggtaaatggagtgttgaaaacgatgattggtgtttaattcc

SEQ ID NO: 15213 - DNA, 96 bp, Neocallimastix californiae
  CBM_10
tcaaggttataaatgctgttcttctaattgtgaagtagtttatgtagatgatgatggtaactggggtgttgaaaatggacaatggtgtggttgtgg

SEQ ID NO: 15214 - DNA, 70 bp, Neocallimastix californiae
  CBM_10
ttgttggtcacaacctctcggatatccatgttgttcttctccaaatgctgaagtttattacactgataac

SEQ ID NO: 15215 - DNA, 93 bp, Neocallimastix californiae
  CBM_10
aaattctggttaccaatgttgtgataattgtgacgttgtttatgaagatgaatctggaaaatggggtattaaggataatgattggtgtgttct

SEQ ID NO: 15216 - DNA, 93 bp, Neocallimastix californiae
  CBM_10
tgatggatatgaatgttgtagtggatgcagtgttgttgataactcagatggaatcaaatggggtgttgaaaatgacaactggtgtattatcaa

SEQ ID NO: 15217 - DNA, 108 bp, Neocallimastix californiae
  CBM_10
ttgctggtcttcaagattaggttatagctgttgtactggttgtgaagtctcatatactgataatgatggtgattggggatatgaaaacaatgattggtgtggtattcc

SEQ ID NO: 15218 - DNA, 99 bp, Neocallimastix californiae
  CBM_10
atgtcacccacaatacaattgctgtaattcttgtgacgttgtatacactgataatgaaggtgaatggggtgtcgaaaataacaattggtgttttataaa

SEQ ID NO: 15219 - DNA, 108 bp, Neocallimastix californiae
  CBM_10
atgtaaatttgaagctcttggttacccatgttgtagtcattgtaactctatttaccatgatgaaagtggtgattggggtgttgaaaatggtgattggtgtggtattca

SEQ ID NO: 15220 - DNA, 108 bp, Neocallimastix californiae
  CBM_10
ttgctggtctcaagcattaggttacccatgctgtagtcacaagaatgttgtttacactgataatgatggtgactggggtgttgaaaatggtgattggtgtggtattat

SEQ ID NO: 15221 - DNA, 108 bp, Neocallimastix californiae
  CBM_10
ctgtttctcagaaagattaggttacccatgttgtaaaggtaacactgtcgtttacaccgataatgatggaaagtggggtgttgaaaataataattggtgtggtatcgg

SEQ ID NO: 15222 - DNA, 105 bp, Neocallimastix californiae
  CBM_10
ggcttctgctttaggtttcaactgttgtaagactactaagactgttgtctttgaagatcaagatggtagttggggtgttgaagatgatttctggtgtggtatcgt

SEQ ID NO: 15223 - DNA, 108 bp, Neocallimastix californiae
  CBM_10
atgtaaattcagtagcttaggttacacttgctgtccagacagtgaagttatctttgaagatgatcacaaatggggagctaccagtgatggacaatggtgtggtgttgc

SEQ ID NO: 15224 - DNA, 108 bp, Neocallimastix californiae
  CBM_10
ttgctggtctgttaagttaggttacccatgttgtgaagtttctaatgccatttactctgttgatgacaatggtagttggggttatgaaaatgatcactggtgtggtct

SEQ ID NO: 15225 - DNA, 108 bp, Neocallimastix californiae
  CBM_10
ttgtttctctgaaagattaggttatccatgttgttctggtgacgaagttgtttacactgataatgatggtaagtggggtgttgaaaatggtaattggtgtggtattgc

SEQ ID NO: 15226 - DNA, 114 bp, Neocallimastix californiae
  CBM_10
ttgctggtctactagcttaggttatccatgttgttcttcttcaaatgctgaagtttggtacactgatgactctggtaaatggggtgttgaaaatggtgactggtgtggtattcc

SEQ ID NO: 15227 - DNA, 114 bp, Neocallimastix californiae
  CBM_10
ttgctggtctactagcttaggctacccatgttgttcttcttcaagtgctgaagtttggtacactgatgactctggtaaatggggtgttgaaaatggtgactggtgtggtattcc

SEQ ID NO: 15228 - DNA, 108 bp, Neocallimastix californiae
  CBM_10
ttgtttctctgaaagattaggttatccatgttgttctggtaacgaagttgtttacactgataatgatggtaaatggggtgttgaaaatggtaattggtgtggtattgc

SEQ ID NO: 15229 - DNA, 108 bp, Neocallimastix californiae
  CBM_10
ttgtttctctgaaagattaggttatccatgttgttctggtaacgaagttgtttacactgataatgatggtaagtggggtgttgaaaatggtaactggtgtggtattgc

SEQ ID NO: 15230 - DNA, 114 bp, Neocallimastix californiae
  CBM_10
ttgctggtctactagcttaggttacccatgttgttcttcttcaagtgctgaagtttggtacactgatgactctggtaaatggggtgttgaaaatggtgactggtgtggtattcc

SEQ ID NO: 15231 - DNA, 108 bp, Neocallimastix californiae
  CBM_10
ttgtttctcagaaagattaggttacccatgctgttctggtgatgaagttgtttacaccgataacgatggaaagtggggtgtagaaaacggtaattggtgtggtattgc

SEQ ID NO: 15232 - DNA, 114 bp, Neocallimastix californiae
  CBM_10
ttgctggtctctttctcaaggttatccatgctgttcttcttcaaatgctgaagtttggtacactgatgcctcaggtaaatggggtgttgaaaatggtgactggtgtggtattcc

SEQ ID NO: 15233 - DNA, 76 bp, Neocallimastix californiae
  CBM_10
ttgctggtctctttctcaaggttatccatgctgttcttcttcaaatgctgaagtttggtacactgatgcctcaggt

SEQ ID NO: 15234 - DNA, 108 bp, Neocallimastix californiae; identical to SEQ ID NO: 15231
  CBM_10

SEQ ID NO: 15235 - DNA, 114 bp, Neocallimastix californiae
  CBM_10
atgttgggctaaggcattaggatttgagtgttgtacttcagaagatattgaagttcaatacactgacaaagatggaaaatggggaattgaaaattatgaatggtgtggtattat

SEQ ID NO: 15236 - DNA, 111 bp, Neocallimastix californiae
  CBM_10
ttgggcagaagaattaggttttaaatgctgttcttcaagtgatgccaaggtagaatatacagataatgatggtgaatggtctatagaagatggtagttggtgtggtatttt

SEQ ID NO: 15237 - DNA, 108 bp, Neocallimastix californiae
  CBM_10
ttgttggtcctccgctttaggatacccatgctgtaaaggatgtgatataacatctaccgatagcgatggagattggggtgttgaaaataatgaatggtgtggtatttt

SEQ ID NO: 15238 - DNA, 108 bp, Neocallimastix californiae
  CBM_10
ttgctggtctcttgcttatggttacgattgctgtaaaggttgtgaagtttctttcattgataatgatggtaaatggggttttgaaaatgaagaatggtgtggtattaa

SEQ ID NO: 15239 - DNA, 84 bp, Neocallimastix californiae
  CBM_10
atacagtacttgtaaaaacacttgcgaaattgaatatgaagatgataataaatggggtattgaaaataatgaatggtgtattct

SEQ ID NO: 15240 - DNA, 99 bp, Neocallimastix californiae
  CBM_10
ctggtctgatccatatccatgctgtgaaggaactacagttgaatatgttgatgatcaaggagaatggggtgttgaaaatggtgaatggtgtggtattgt

SEQ ID NO: 15241 - DNA, 96 bp, Neocallimastix californiae
  CBM_10
tccagattatccatgttgtagttcaggtattgaagttgcatatgttgatgatcaaggtgaatggggtgttgaaaacggtgaatggtgtggtattga

SEQ ID NO: 15242 - DNA, 108 bp, Neocallimastix californiae
  CBM_10
ttggagtatgccagattatccatgttgtaaaaatactagatattcttactacactgatagtgcaggtaatgaatggggtgttgaaaatggtgattggtgtggtattat

SEQ ID NO: 15243 - DNA, 93 bp, Neocallimastix californiae
  CBM_10
gggttacaactgttgtagaaatacttgtgatatctcttacgtagatgaggatggtaactggggtgttgaaaatggtaattggtgtggtgtacc

SEQ ID NO: 15244 - DNA, 105 bp, Neocallimastix californiae
  CBM_10
atgcttctctgaaccagattatccatgctgtacctcatgtgatgttgttgaatcggatggtgatcaaagatggggtattgaaaataatgaatggtgtggtatacc

SEQ ID NO: 15245 - DNA, 105 bp, Neocallimastix californiae
  CBM_10
atgtactggttatccagattacccatgttgtaatagttgtgatgtttcttactcagacagtattggtgattggggtattgaaaataatgattggtgcggtatcaa

SEQ ID NO: 15246 - DNA, 108 bp, Neocallimastix californiae
  CBM_10
ttgttgggctaaaaaactcggttataattgttgtactggttgcaattccatttactctgataaagatggaatgtggggatatgaaaatgaagaatggtgtggtattac

SEQ ID NO: 15247 - DNA, 105 bp, Neocallimastix californiae
  CBM_10
tactggagctcaaggttatccatgttgtaagagtagttgtgccatttacagtagcgatagtgatggtgactggagtattgaaaatggtgattggtgtttaattga

SEQ ID NO: 15248 - DNA, 108 bp, Neocallimastix californiae
  CBM_10
ttgctgggctaaggctttaggttatgaatgttgtaagtcttgtcttccagttgttaccactgatggtgatggttcatggagtgttgtaaatgatgactggtgtggtct

SEQ ID NO: 15249 - DNA, 105 bp, Neocallimastix californiae; identical to SEQ ID NO: 15247
  CBM_10

SEQ ID NO: 15250 - DNA, 108 bp, Neocallimastix californiae; identical to SEQ ID NO: 15248
  CBM_10

SEQ ID NO: 15251 - DNA, 96 bp, Neocallimastix californiae
  CBM_10
tcaaggttacccatgttgtgaaaatagtactatagtatattacactgatgacgatggtgactggagtgttgaaaataatgattggtgtatcattag

SEQ ID NO: 15252 - DNA, 114 bp, Neocallimastix californiae
  CBM_10
ttcctctaagattacttctcaaggttacagttgctgttctgctagctgtgaaattgtctacactgatgatgatggtacttggggtgtcgaaaatggtgactggtgtggatgtgg

SEQ ID NO: 15253 - DNA, 114 bp, Neocallimastix californiae
  CBM_10
ttctagtgctattcttgctcaaggatattcatgctgttcttcatgtggtaccgtttactacaccgatgctgatggtgactggggtgttgaaaacaatgactggtgtggtatgcc

SEQ ID NO: 15254 - DNA, 114 bp, Neocallimastix californiae
  CBM_10
tccagcttcaattaccaaccaaggatatgcttgctgtgctgttggttgtgaagttgtttacactgataatgatggtgaatggggagttgaaaacaatgaatggtgtggatgtgg

SEQ ID NO: 15255 - DNA, 82 bp, Neocallimastix californiae
  CBM_10
ttgttggtcacaacctctcggatatccatgttgttcttctccaaatgctgaagtttattacactgataacgatggtaagtgg

SEQ ID NO: 15256 - DNA, 111 bp, Neocallimastix californiae
  CBM_10
ttgttggtcaaaagcattaggttacacatgttgttctacttgtacatccgttattgacagtgatgccagtggtgattggggaattgagaatggtgaatggtgtggtattcc

SEQ ID NO: 15257 - DNA, 105 bp, Neocallimastix californiae
  CBM_10
taaaggagctcaaggatatccatgctgtcaaaaaacatgtgaagtatattccacagatagtgatggtagttggaatattgaaaataatgactggtgtttaattga

SEQ ID NO: 15258 - DNA, 111 bp, Neocallimastix californiae
  CBM_10
ctgttggtctgaaacttacggttacccatgctgtcaatctacttgtgcccgtcttattgaagatgaaagtggtgcctggggtgctgaaaatggtgaatggtgtggtattca

SEQ ID NO: 15259 - DNA, 111 bp, Neocallimastix californiae
  CBM_10
atgttgggctagcatcatcggttacccatgttgtcaaaagtcaactatagtctatgatgaagatgaatatggtacctggagttatgaagatgatcactggtgtggtattct

SEQ ID NO: 15260 - DNA, 111 bp, Neocallimastix californiae; identical to SEQ ID NO: 15258
  CBM_10

SEQ ID NO: 15261 - DNA, 111 bp, Neocallimastix californiae; identical to SEQ ID NO: 15259
  CBM_10

SEQ ID NO: 15262 - DNA, 111 bp, Neocallimastix californiae
  CBM_10
ctgctggtcgacttcacttggttatccatgttgtaaaactaattgtgaagttcttgatacagatgataatggtaattggggtgttgaaaatgatgaatggtgtggtatttc

SEQ ID NO: 15263 - DNA, 111 bp, Neocallimastix californiae
  CBM_10
ctgctggtcaatagatttaggttatccatgttgtgaaccaggtactgaagttatctatgctgacgaatctggtgaatggggtgttttaaatgatgattggtgtggtattcc

SEQ ID NO: 15264 - DNA, 108 bp, Neocallimastix californiae
  CBM_10
gtgtaaatttgaagcaattggttatccatgttgttctcattgtgatgtaattttaactgatgatgatggaaactggggtgctgaaaatggtcaatggtgtggtattcc

SEQ ID NO: 15265 - DNA, 93 bp, Neocallimastix californiae
  CBM_10
ccatccttattacgattgttgtaaaggatgtcaaaccattttaactgatgaagaaggcaattggggttctgaaaatggtcagtggtgttttgt

SEQ ID NO: 15266 - DNA, 108 bp, Neocallimastix californiae
  CBM_10
ttgctggtccgagccagattatccatgctgtaaggataatagtaacattgtatactctgatggtcaaggtgattggggttatgaaaatgaaaactggtgtggaattgt

SEQ ID NO: 15267 - DNA, 108 bp, Neocallimastix californiae
  CBM_10
ttgctggtctcttccaagttatccatgttgtacagaagaacaagaaccagtttatgttgatgatcttggtaaatggggtattgaaaataatgactggtgtggtattaa

SEQ ID NO: 15268 - DNA, 108 bp, Neocallimastix californiae
  CBM_10
ttgtttttctgaagatcttggatacaaatgttgtcaaggatgtactgtagttagtactgatgaatctggtgaatggggtatcgaagacaatgaatggtgtggtattcc

SEQ ID NO: 15269 - DNA, 108 bp, Neocallimastix californiae
  CBM_10
ttgctggtctgaagctagtggttaccattgctgtaagttgtgcaatatttcttattcagatgacagtggtgattggggtgttgaaaacaatgaatggtgtggtattcc

SEQ ID NO: 15270 - DNA, 84 bp, Neocallimastix californiae
  CBM_10
tttatgttgtaaggaaggaacagaagttatttatactgatgaggaaggtgattggggcttagatggaaagaactggtgtaaaat

SEQ ID NO: 15271 - DNA, 108 bp, Neocallimastix californiae
  CBM_10
ttgtacaggttcaaatgatggttactcatgttgtaaaacctgtaatgttgcttacactgatgatcaaggtgattggggttttgaaaatgatgaatggtgtggtatcaa

SEQ ID NO: 15272 - DNA, 108 bp, Neocallimastix californiae
  CBM_10
ttgctgggctaagaaattaggttatgactgctgtactggatgtaactctgtttacagtgatgaaagtggagaatggggatttgaaaacgataaatggtgtggtattgt

SEQ ID NO: 15273 - DNA, 105 bp, Neocallimastix californiae
  CBM_10
ttgtactggttatccagatttcccatgctgtaagggttgcgatgttgcattctctgacactactggtgattggggtgttgaaaataatgaatggtgtggtattaa

SEQ ID NO: 15274 - DNA, 105 bp, Neocallimastix californiae
  CBM_10
ttgcttctcggaaccagattacccatgttgtacttcatgtaatgttgtagaaactgatggtaatcaaagatggggtattgaaaataatgaatggtgtggtattcc

SEQ ID NO: 15275 - DNA, 102 bp, Neocallimastix californiae
  CBM_10
ccattctttacctttctacccatgttgcgcatcttgtgatgttgttcgtgaaacagacgaaggagaatggggtattgaaaatgatgaatggtgtggtattaa

SEQ ID NO: 15276 - DNA, 108 bp, Neocallimastix californiae
  CBM_10
ctgggctaaggctttaggttatgaatgttgtaaaacttgccaagcttctcaattaaaggatgaaagtggtgattggggtattgaaaatggtgaatggtgtggtattac

SEQ ID NO: 15277 - DNA, 90 bp, Neocallimastix californiae
  CBM_10
tcttggttatccatgttgtaaagaaactttcgaagctacttacaccgatgaaaatggtaagtgggctattgaaaacgatgagtggtgtga

SEQ ID NO: 15278 - DNA, 108 bp, Neocallimastix californiae
  CBM_10
ctggtcagaatctcttggttatccttgttgtacaaaaactactgaagtagtatctgaagatagtgatggtcaatggggcttagaaaatgataattggtgtggaattgt

SEQ ID NO: 15279 - DNA, 108 bp, Neocallimastix californiae
  CBM_10
ttgttgggctgaaaaattaggatataaatgttgtaaggaatgtactgttacatataatgatgaaaatggtgattggggttttgaaaatggtgattggtgtggtatttt

SEQ ID NO: 15280 - DNA, 105 bp, Neocallimastix californiae
  CBM_10
atgtttttctactcctgattatccatgctgttcaagctgtcaaactatatacagtgataatgatggagattggggatacgaagacgataaatggtgtggtattaa

SEQ ID NO: 15281 - DNA, 108 bp, Neocallimastix californiae
  CBM_10
atgctggtctcttccagactatccatgttgtgaagaaagtaccgatgtagtatattcagatgaaagtggtgattggagtgttgaaaatgatgattggtgtggtatcat

SEQ ID NO: 15282 - DNA, 108 bp, Neocallimastix californiae
  CBM_10
ttgctggtcagaaagtcaaggctacaattgctgttctggctgtgaagttgtttatgaagacgattctggtaagtggggtgttgaaaatgatgattggtgtggtattga

SEQ ID NO: 15283 - DNA, 111 bp, Neocallimastix californiae
  CBM_10
ttcttctattcaaagacaaggttacaaatgttgtaagcctggatgtgaaattatttatgttgataatgatggaaattggggtgttgaaaatggtcaatggtgtggatgtgg

SEQ ID NO: 15284 - DNA, 96 bp, Neocallimastix californiae
  CBM_10
ccaaggatacaattgttgctcatcttgttccttcgtgtactacaccgatagtgatggtaactggggtgttgaaaacaacgactggtgtggtatgcc

SEQ ID NO: 15285 - DNA, 108 bp, Neocallimastix californiae
  CBM_10
ctgctggtcattatctcaaggatatccatgctgtcaatcatgtaatgttacctatgaagatgaatccggtaagtggggtgttgaaaatggtaactggtgtggtattgc

SEQ ID NO: 15286 - DNA, 93 bp, Neocallimastix californiae
  CBM_10
tggttacccatgctgtgccagatcctgcattgttgtcactaaagatgatgatggctactggggtattgaaaataataactggtgtctcattga

SEQ ID NO: 15287 - DNA, 112 bp, Neocallimastix californiae
  CBM_10
ttgttggtcacaatctcttggttatccatgttgttcttctccaaatgctgaagtttattacactgataacgacggtaaatggagtgtcgaaaacaacgattggtgtggtatt

SEQ ID NO: 15288 - DNA, 105 bp, Neocallimastix californiae
  CBM_10
atgtttttcctatccaacttatccatgttgtaaaggaaatactgtaatttatactgatgagcaaggtgcatggggtattgaaaatgataactggtgtggaataga

SEQ ID NO: 15289 - DNA, 108 bp, Neocallimastix californiae
  CBM_10
atgctgggcaaagtcattaggttataattgctgttctcattgttcagtatcctatactgatgaaaatggaaaatggggtgttgaaaataatgagtggtgtggtattac

SEQ ID NO: 15290 - DNA, 111 bp, Neocallimastix californiae
  CBM_10
atgttggtcagaaaaattgggctatccatgctgtaaatcaacaaatgatgtttattacgaagatgatgatggtcaatggggtgttgaaaacaatgattggtgcggcatcca

SEQ ID NO: 15291 - DNA, 111 bp, Neocallimastix californiae
  CBM_10
atgctggtctgaaaaattaggttatccatgttgcaattcaactaatgaagttgtttatgaagataatgatggaccatggggagttgaaaacaataattggtgtggtattat

SEQ ID NO: 15292 - DNA, 102 bp, Neocallimastix californiae
  CBM_10
ttggtctcttccagaatatccatgttgtgaaggtaattctattgttacttcagacagtcaaggagattggggatatgaaaataatcattggtgtggtattat

SEQ ID NO: 15293 - DNA, 102 bp, Neocallimastix californiae
  CBM_10
ttggtcacttccagattatccatgttgtgaaggtaataccatcgttactacagatagtcatggagattggggttatgaaaataaccattggtgtggtatact

SEQ ID NO: 15294 - DNA, 105 bp, Neocallimastix californiae
  CBM_10
ctggtcagctgccatgggatataattgttgtaaaggatgtacagtttatattgaagatcagagtggtcaatggggttatgaaaaccatcagtggtgtggtataga

SEQ ID NO: 15295 - DNA, 105 bp, Neocallimastix californiae
  CBM_10
atgtggagctgctgctatcggttacccatgttgtgaaaatacctgtactgaagtctacactgatgaatacagatggggtgttgaaaacaatgactggtgtggtct

SEQ ID NO: 15296 - DNA, 102 bp, Neocallimastix californiae
  CBM_10
ttgctggtctgaaccagattacaaatgctgttctacttgtgatattgtttacactgatgatcataattggggtgttgaagatgatgaatggtgtggtattga

SEQ ID NO: 15297 - DNA, 102 bp, Neocallimastix californiae
  CBM_10
tccaggttcaaatcaaggttattcatgctgtaaaacctgtgaagtttatatgacggatgaaactggaccatggaatattgaaaatgatgagtggtgtagtgt

SEQ ID NO: 15298 - DNA, 117 bp, Neocallimastix californiae
  CBM_10
ttgttggtctgaatcccttggttatccatgctgttccatgggatgtaacgccataaattattatacagatgatgatggcttctggggtgttgaaaatgatgattggtgtggtattcc

SEQ ID NO: 15299 - DNA, 96 bp, Neocallimastix californiae
  CBM_10
acaaggttacaagtgttgtggtaacaactgtattgttgtttaccaagataatgatggttactggggtgttgaaaacaaccaatggtgtggatgtgg

SEQ ID NO: 15300 - DNA, 96 bp, Neocallimastix californiae
  CBM_10
acaaggttatccatgctgtaagaacaccaaagcagttgtcttcagagacaatgatggtaactggggtattgaaaacaacgattggtgttacattaa

SEQ ID NO: 15301 - DNA, 111 bp, Neocallimastix californiae
  CBM_10
taaagcctctttaattggctatgcctgttgttcaccagaaaacactacgattcaatatcatgatgaagatggtgattggggtgttgaaaatggtgaatggtgtggtattac

SEQ ID NO: 15302 - DNA, 108 bp, Neocallimastix californiae
  CBM_10
tttctcaaaatttttaggatatccatgttgttcttcagttgttgaagtcgcttatattgatgaagatggaaaatggggaatagaaaatgatgcttggtgtggaattag

SEQ ID NO: 15303 - DNA, 111 bp, Neocallimastix californiae
  CBM_10
tgtcgtcgcttctttgggttatgcctgttgttctccaggtaacactgtagtctactaccaagatgaaaatggtgattggggtgttgaaaatgatgactggtgtggtattac

SEQ ID NO: 15304 - DNA, 111 bp, Neocallimastix californiae
  CBM_10
atgttggtctgataaattaggttatccatgttgtagcggatgtactgaaaatgtttatgaagataatgatggcaaatggggtgttgaaaatggcgattggtgtggtattcc

SEQ ID NO: 15305 - DNA, 108 bp, Neocallimastix californiae
  CBM_10
ctggtctgaaagattaggttatccatgttgtacttcaactaatggaatctatttttctgataacgatggagattggggtattgaaaatgatgattggtgtggtattcc

SEQ ID NO: 15306 - DNA, 111 bp, Neocallimastix californiae
  CBM_10
ctgctggtctaaggctttaggatataactgctgtacctcaacttcagatgtaatcttcgaagacagtgatggtcaatggggtattgaaaacgacgattggtgtggtattgt

SEQ ID NO: 15307 - DNA, 120 bp, Neocallimastix californiae
  CBM_10
ttggagtgaaagtctcggttacagatgttgtaaagatgatgaaagcattgttgaatatattgatgaagatggatggtggggtgttaccaatgatgaaaaaccagactggtgtggtattat

SEQ ID NO: 15308 - DNA, 117 bp, Neocallimastix californiae
  CBM_10
atgttcttccaagattcttgctcaaggttacaagtgctgttcttctaactgtagtgttgtttacactgatgctgatggaacttggggtgttgaaaataaccaatggtgtggttgtgg

SEQ ID NO: 15309 - DNA, 96 bp, Neocallimastix californiae
  CBM_10
tcaaggttacccatgttgtaaaaaggaaactactgtttactacactgattctgatggtaaatggagtgttgaaaacaacgactggtgtttaattcc

SEQ ID NO: 15310 - DNA, 102 bp, Neocallimastix californiae
  CBM_10
tgaagcaactaatggatacccaaaatgtagttcttgtgtagtatattacactgatgagaatggcgattggggtgtagaaaacaatgattggtgtcttattca

SEQ ID NO: 15311 - DNA, 99 bp, Neocallimastix californiae
  CBM_10
atgtcatagtcaatatgaatgttgcagtaactgtgaagttatatattcagatgatgaaggtgattggggtgtagaaaattatgattggtgttttattga

SEQ ID NO: 15312 - DNA, 108 bp, Neocallimastix californiae
  CBM_10
ttgctggtcaagttcattaggatatgattgttgtgatgattgtaatacattatatactgatgaatctggtgattggggtgttaaaaataatgattggtgtggtattcc

SEQ ID NO: 15313 - DNA, 108 bp, Neocallimastix californiae
  CBM_10
ttgttggtctaaagcattaggttatgattgttgtgatgattgtaatactttatatactgacgatagtggtgattggggtgttaaaaataatgattggtgtggtattcc

SEQ ID NO: 15314 - DNA, 96 bp, Neocallimastix californiae
  CBM_10
tcaaggttacaaatgttgttcaacttgtggtaccgtttactacactgatgacgatggtgattggggtgttgaaaacaatgaatggtgtggtatgcc

SEQ ID NO: 15315 - DNA, 96 bp, Neocallimastix californiae
  CBM_10
tcaaggttacaaatgttgttctgatagatgtgaagttgtctaccaagatggtgatggtgactggggtgtagaaaacggcgaatggtgtggttgtag

SEQ ID NO: 15316 - DNA, 96 bp, Neocallimastix californiae
  CBM_10
tcaaggttacagttgttgttcagtttgtggtaccgtttactacactgatggcgatggtgattggggtgttgaaaacaatcaatggtgtggtatgcc

SEQ ID NO: 15317 - DNA, 114 bp, Neocallimastix californiae
  CBM_10
ttctgcttctattcttgcccaaggttacgaatgttgttctgatagatgtgaagttgtctaccaagatggtgatggtgactggggtgtagaaaacggcgaatggtgtggttgtgg

SEQ ID NO: 15318 - DNA, 105 bp, Neocallimastix californiae
  CBM_10
ttggtctgaacagttaggttatccatgttgtcaaggatgtaccgtttttgaaactgatgctgatggctcttggggttacgaaagtaatcactggtgtggtattca

SEQ ID NO: 15319 - DNA, 120 bp, Neocallimastix californiae
  CBM_10
ttgttgggctgaacgtcttggttatccatgttgttctgccaataatcaaaaaatttatgctcatgataatgatggtgattggggttataactggaaaaccaatgaatggtgtggtatttc

SEQ ID NO: 15320 - DNA, 114 bp, Neocallimastix californiae
  CBM_10
ttgttggtctctttctcaaggttatccatgctgttcttcttcaaatgctgaagtttggtacaccgatgcctcaggtaaatggggtgttgaaaatggagactggtgtggtattcc

SEQ ID NO: 15321 - DNA, 108 bp, Neocallimastix californiae
  CBM_10
ttgtttctcagaaagattaggttatccatgttgttctggtaatgaagttgtttacaccgataacgatggaaagtggggtgtagaaaatggtaattggtgtggtattgc

SEQ ID NO: 15322 - DNA, 108 bp, Neocallimastix californiae
  CBM_10
ttgctggtctactaagttaggttacccatgttgtgaagtttctaatgtcatttactctgttgatgacaatggtagttggggttatgaagatgatcactggtgtggtct

SEQ ID NO: 15323 - DNA, 108 bp, Neocallimastix californiae
  CBM_10
atgtaaatttagtggcttaggttacacttgctgtccagacagtgaagttatctttgaagatgatcacaaatggggagctaccagtgatggacaatggtgtggtgttgc

SEQ ID NO: 15324 - DNA, 108 bp, Neocallimastix californiae; identical to SEQ ID NO: 15211
  CBM_10

SEQ ID NO: 15325 - DNA, 114 bp, Neocallimastix californiae
  CBM_10
ttgctggtctactagcttaggttatccatgttgttcttcttcaaatgctgaagtttggttcactgatgactctggtaaatggggtgttgaaaatggtgactggtgtggtattcc

SEQ ID NO: 15326 - DNA, 108 bp, Neocallimastix californiae
  CBM_10
ttgtttctctgaaagattaggttatccatgttgttctggtaatgaagttgtttacactgataatgatggtaagtggggtgttgaaaatggtaattggtgtggtattgc

SEQ ID NO: 15327 - DNA, 108 bp, Neocallimastix californiae
  CBM_10
atgttttgctgaaaaattaggttacccatgttgtagttcatgtgatgttctttacactgataatgatggtgaatggggtgttgaaaatgataattggtgtggtattaa

SEQ ID NO: 15328 - DNA, 105 bp, Neocallimastix californiae
  CBM_10
tttctcaatttctttaggtttcccatgttgtaaaggaaatacagttgtttactccgataatgatggggactggggtgtagaaaacaatgaatggtgtggtattag

SEQ ID NO: 15329 - DNA, 96 bp, Neocallimastix californiae
  CBM_10
tcaaggttacaagtgttgttcctctaactgtgaagttgtttatactgatgatgatggaacatggggtgttgaaaatgaagaatggtgtggatgtgg

SEQ ID NO: 15330 - DNA, 114 bp, Neocallimastix californiae
  CBM_10
ctctgctaaaattcttaagcaaggttacgaatgttgtccaagtggctgtgatgttatttacactgacgatgatggtgattggggtgttaacaatggtgattggtgtggatgtgg

SEQ ID NO: 15331 - DNA, 114 bp, Neocallimastix californiae
  CBM_10
ttcatcaaagattactgatctcggttacaagtgttgttcctctggttgtcaagttgtttacactgatgatgatggaacatggggtgttgaaaatgaagaatggtgtggatgtgg

SEQ ID NO: 15332 - DNA, 108 bp, Neocallimastix californiae
  CBM_10
atgttggtctcttccaagttatccatgttgttctagtggaattgaatctgcttatgaagatgatcttggtaagtggggtatagaaaatggtgattggtgtggtattaa

SEQ ID NO: 15333 - DNA, 108 bp, Neocallimastix californiae
  CBM_10
atgtgctgctgaggcctttggctacaattgctgtaatggatgtacagtagttactacagatgaaactggtgattggggtgttgaaaatgatgaatggtgtggtattcc

SEQ ID NO: 15334 - DNA, 108 bp, Neocallimastix californiae
  CBM_10
atgttggtctgaaccagattacccatgttgttctggtaatactgaaattatttattctgatgcttctggcgattggggttatgaaaataacaattggtgtggtattat

SEQ ID NO: 15335 - DNA, 108 bp, Neocallimastix californiae; identical to SEQ ID NO: 15333
  CBM_10

SEQ ID NO: 15336 - DNA, 108 bp, Neocallimastix californiae; identical to SEQ ID NO: 15334
  CBM_10

SEQ ID NO: 15337 - DNA, 108 bp, Neocallimastix californiae; identical to SEQ ID NO: 15332
  CBM_10

SEQ ID NO: 15338 - DNA, 111 bp, Neocallimastix californiae
  CBM_10
ctgttgggcaagtactattggattcccatgttgtaagagtagttgtgaagttgcttacactgataatgacggtgattgggctattgaaaatgatgaatggtgtggaattga

SEQ ID NO: 15339 - DNA, 108 bp, Neocallimastix californiae
  CBM_10
atgtttctctaaagatatgggttatccatgctgtagtacttgtgaagttgcctatactgatagtgatggtggatggggtgttgaaaatggtgaatggtgtggtattaa

SEQ ID NO: 15340 - DNA, 102 bp, Neocallimastix californiae
  CBM_10
ctggactttagatcaaagttatccatgttgttcaagtttgagcgcaaaggttgatggatacagtgataaatggggttatgaaaacggagattggtgtggttt

SEQ ID NO: 15341 - DNA, 108 bp, Neocallimastix californiae
  CBM_10
gtgttgggcctataagttaggttatccatgttgtgaaggtaatactataatagaaattaatgaagatggaaaatggggtattgaaaatgatgaatggtgtggtgtcat

SEQ ID NO: 15342 - DNA, 111 bp, Neocallimastix californiae
  CBM_10
atgttggtccactagtttaggttatccatgttgtgaaactacaaaggatattatatataatagtaataaaggttcttggggttatgaaaatgatagttggtgtggtattaa

SEQ ID NO: 15343 - DNA, 108 bp, Neocallimastix californiae
  CBM_10
ttggtctctaaaacaaaactacccatgttgtaagattaccaaaaaagttcaatttacagatgaaaatggtaaatggggtgttgaaaaaggaaattggtgtggtattat

SEQ ID NO: 15344 - DNA, 108 bp, Neocallimastix californiae
  CBM_10
ttggtctgaaccacttggttatccatgttgtaaagaaacaaagaaaatcgaatactatgatgataatggaccatggggaatggaaaatgatgattggtgtggtattga

SEQ ID NO: 15345 - DNA, 111 bp, Neocallimastix californiae
  CBM_10
ctgctggtcgacttcacttggttacccatgttgtaaaactaattgtgacgtcgttgttactgatggagatggtgattggggtgttgaaaatgatgaatggtgcggtatttc

SEQ ID NO: 15346 - DNA, 111 bp, Neocallimastix californiae
  CBM_10
ttgctggtctttagctttaggttatccatgttgtgaaccaggtacaactgcaatttataccgatgattctggtgattggggtgttttaaatgatgattggtgtggtattca

SEQ ID NO: 15347 - DNA, 111 bp, Neocallimastix californiae
  CBM_10
ctggtcagaaaaattaggttggccatgttgtagtaagggtaacactgaagtttactatgttgatgatgatggtgattggggtgttgaaaatgacgattggtgtggtatgga

SEQ ID NO: 15348 - DNA, 114 bp, Neocallimastix californiae
  CBM_10
atgtttcactgaagaaaagggaatggacttcccttgttgtcaaggttgtgaagtttactacactgatgatgatggtgaatggggattcgaaaataatcaatggtgtggtattaa

SEQ ID NO: 15349 - DNA, 111 bp, Neocallimastix californiae
  CBM_10
ctttactgaagaaaagggattaggcttcccttgttgtcaagaatgtacggtagtcaccagtgatgatgatggtgattggggtgttgaaaacaacgaatggtgtggtatccc

SEQ ID NO: 15350 - DNA, 108 bp, Neocallimastix californiae
  CBM_10
atgttgggctaaagatttaggcttctcctgttgtcaagcctgtgaagttacctatacagataatgatggtgattggggtttcgaaaatggcgattggtgtggtattat

SEQ ID NO: 15351 - DNA, 108 bp, Neocallimastix californiae
  CBM_10
ctgctggtctactgccttaggctatccatgttgtgatacctgcgttagtgtttctttcgaagacggtgatggtaaatggggtattcaaaatgatgactggtgtggttt

SEQ ID NO: 15352 - DNA, 105 bp, Neocallimastix californiae
  CBM_10
ctctggagctcaaggttatccatgttgtaaatcatcatgcgatgtttattcttctgacaatgatggaaactggagtattgaaaacgacgattggtgtttaattga

SEQ ID NO: 15353 - DNA, 105 bp, Neocallimastix californiae; identical to SEQ ID NO: 15352
  CBM_10

SEQ ID NO: 15354 - DNA, 108 bp, Neocallimastix californiae; identical to SEQ ID NO: 15351
  CBM_10

SEQ ID NO: 15355 - DNA, 114 bp, Neocallimastix californiae
  CBM_10
ttcttcaaaaatcacagcccaaggttacaaatgctgttcagccaactgtgaagttgtttacactgatgatgatggtaactggggtgtagaaaacaacaactggtgtggatgtgg

SEQ ID NO: 15356 - DNA, 96 bp, Neocallimastix californiae
  CBM_10
gcaaggttatccatgctgtaagactgaaaccaccgtatacttcactgatgatgatggtaactggagtgttgaaaacggtgactggtgtttaattcc

SEQ ID NO: 15357 - DNA, 108 bp, Neocallimastix californiae
  CBM_10
ttgctggtctgaaccattaggttatccatgttgttcttcttgttcctatgtatactatgttgatgatgatggtaactggggtgttgaaaatgatgattggtgtggttt

SEQ ID NO: 15358 - DNA, 105 bp, Neocallimastix californiae
  CBM_10
gataactagtcaaggttattcatgctgtccagctaattgtcaaatcgtttatacagattctgatggtacttggggtgttcataatgatcaatggtgtggatgtgg

SEQ ID NO: 15359 - DNA, 102 bp, Neocallimastix californiae
  CBM_10
cttcacatctcaaggttatggatgctgctccagatgtggtgaagtttactttaccgatgaatctggtaattggggaattgaaaatggtgactggtgtggatt

SEQ ID NO: 15360 - DNA, 111 bp, Neocallimastix californiae
  CBM_10
atgctggagtaaagctttaggttatgactgttgtaaggaaggtactgatgttatttacacagatgaaagtggaaagtggggaatggacggcgatgattggtgtggtattat

SEQ ID NO: 15361 - DNA, 90 bp, Neocallimastix californiae
  CBM_10
tctttacccatgttgttcaacttgtacttctgtcttcgaagataaagatggtaagtggggtgttgaaaatgaagaatggtgtttaattaa

SEQ ID NO: 15362 - DNA, 93 bp, Neocallimastix californiae
  CBM_10
aaatggttacgaatgttgtaaatcatgtgatgttgtatttactgatgatgatggtgaatggggtgtagaagacggtcaatggtgtggtattga

SEQ ID NO: 15363 - DNA, 106 bp, Neocallimastix californiae
  CBM_10
ttgttggtctcaaaaacttggttacccatgttgttcttcttctagtgctgaagtttggtacaccgacaatgatggtaaatggggtgttgaaaacaatgactggtgt

SEQ ID NO: 15364 - DNA, 108 bp, Neocallimastix californiae
  CBM_10
atgttggtctaataaatctggttacccatgctgtgatagctgtgacatctatttagatgatgaaaccggtaaatggggtgttatgaatggtgattggtgtggtatccc

SEQ ID NO: 15365 - DNA, 108 bp, Neocallimastix californiae
  CBM_10
ctgcaagtttgaagctcttggttacaaatgctgttctaattgtattgccgtatttgaagatgatgatggttactggggttctgaaaacaatgaatggtgtggtattac

SEQ ID NO: 15366 - DNA, 96 bp, Neocallimastix californiae
  CBM_10
ccaaggatatccatgttgtaagtcaacttgtgatgtttactctactgataatgatggaaaatggggtattgaaaacaatgactggtgtttaattga

SEQ ID NO: 15367 - DNA, 108 bp, Neocallimastix californiae
  CBM_10
ttgctggtctgttggtttaggttaccaatgttgtaaatcttgtaatgtcgaatacaaagataatgatggtgaatggggtattgaaaacaataaatggtgtggtatttc

SEQ ID NO: 15368 - DNA, 96 bp, Neocallimastix californiae
  CBM_10
tcaaggttatccatgttgtaaatcaacttgtgatgtttattctactgataatgatggaaagtggggtattgaaaacaatgactggtgtttaattga

SEQ ID NO: 15369 - DNA, 108 bp, Neocallimastix californiae
  CBM_10
ttgctggtctgttggtttaggttaccaatgttgtaaatcctgtgatgttgtcttcaaggataatgatggtgaatggggtgttgaaaatgaaaagtggtgtggtatttc

SEQ ID NO: 15370 - DNA, 96 bp, Neocallimastix californiae
  CBM_10
aagggatggttatccaccatgtcaagaaactactgaagttctctacactgatgatagtgaatggggtgttgaaaatgacggttggtgcgtcatttg

SEQ ID NO: 15371 - DNA, 108 bp, Neocallimastix californiae
  CBM_10
ctgtttcagtgaacgtctaggttatccatgttgtaagggtaatgaagtactctatactgacaatgatggaaaatggggtgttgaaaatgatgaatggtgtggtattaa

SEQ ID NO: 15372 - DNA, 108 bp, Neocallimastix californiae
  CBM_10
ctgtttcagtgaacgtttaggttatccatgttgtaaggataataaagtgctctatactaacgatattggaaattggggtattgaaaatggtaattggtgtggtattaa

SEQ ID NO: 15373 - DNA, 114 bp, Neocallimastix californiae
  CBM_10
atgctggtcagaaagattaggttggccttgttgtagtaaggaaaacactgatgtctactatgtggatgacgatggtgaatggggggttgaaaatgatgactggtgtggtatgag

SEQ ID NO: 15374 - DNA, 96 bp, Neocallimastix californiae
  CBM_10
tcaaggttatccatgttgtcaatcctcatgtaatgttatatccactgatagtgatggtaaatggagtgttgaaaatgatgactggtgtttaattga

SEQ ID NO: 15375 - DNA, 108 bp, Neocallimastix californiae
  CBM_10
ctgttggtctattggtaaaggttacaactgttgtaaatcttgtaatgttgtctacaaggataatgatggtgaatggggtgttgaaaatgacaaatggtgtggtatctc

SEQ ID NO: 15376 - DNA, 117 bp, Neocallimastix californiae
  CBM_10
atgttgggcaaacaaagtaggatatccatgttgtgattttgataataataatgtaatatataaagataaagatggttcatggggtttaacaaatgaaaatgaatggtgtggtattat

SEQ ID NO: 15377 - DNA, 111 bp, Neocallimastix californiae
  CBM_10
ttggtcagaaaaattaggttacccttgctgtacttccgaaaaagctaaagtttcttattctgatgaaaatggtcactggggcattgagaataatcaatggtgtggtattat

SEQ ID NO: 15378 - DNA, 117 bp, Neocallimastix californiae
  CBM_10
atgctgggcaaacaaagtaggatatccatgctgtgattttgataataataatgtaatatataaagataaagatggttcatggggtttaacaaatgaaaatgaatggtgtggtattat

SEQ ID NO: 15379 - DNA, 117 bp, Neocallimastix californiae
  CBM_10
ttgttcagctaaaattcttgctcagggatacagttgctgtccaaaaggatgtagagtttatgtaactgatgatgatggtgattggggttatgtaaacaatgaatggtgtggttgcaa

SEQ ID NO: 15380 - DNA, 93 bp, Neocallimastix californiae
  CBM_10
tcaaggttacccatgttgtaagggtaaatctgaaatctattttgttgataaagatggtaactggggatatgaaaacggagattggtgtttact

SEQ ID NO: 15381 - DNA, 114 bp, Neocallimastix californiae
  CBM_10
tccagcttctattactagtcaaggttatgaatgctgctctgaaaattgtgaaattgtttatactgatgatgatggtaattggggtgttgaaaataaccaatggtgtggttgtgg

SEQ ID NO: 15382 - DNA, 99 bp, Neocallimastix californiae
  CBM_10
tgatcaaggctacccatgctgttcaacaggatgtactgtttattacactgataatgatggtgattggggtgttgaaaacaaccaatggtgtggttgtgg

SEQ ID NO: 15383 - DNA, 108 bp, Neocallimastix californiae
  CBM_10
atgttgggctaagtctttaggttactcttgctgtaaatcatgtaaggtttacactgtcgataaacatggttcttggggtgttgaagacggtaaatggtgtggtattga

SEQ ID NO: 15384 - DNA, 108 bp, Neocallimastix californiae
  CBM_10
ttgttggtctagtttctacggttatgattgctgtaagggttgtaaggttagatatgttgataatttaggttcttggggttatgaaggtaacaaatggtgtggtattga

SEQ ID NO: 15385 - DNA, 105 bp, Neocallimastix californiae
  CBM_10
ttggtcagaatctaagggttatccatgttgtaaatcttgtgatgttgtaaccgtcgatagacatggttcatggggtattgaaaatggtcaatggtgtggtgtaaa

SEQ ID NO: 15386 - DNA, 108 bp, Neocallimastix californiae
  CBM_10
ctgttgggctagtttctatggttacagttgctgtaagggttgtaaggttagatatgttgataatttaggttcttggggttatgaaggaaaccaatggtgtggaattga

SEQ ID NO: 15387 - DNA, 108 bp, Neocallimastix californiae
  CBM_10
ttgttggtctgaatcaaaaggttacaaatgttgtaaatattgtgatgttataagtgttgatagatttggttcttggggtgttgaaaatggtgaatggtgtggaattga

SEQ ID NO: 15388 - DNA, 108 bp, Neocallimastix californiae
  CBM_10
atgttggtctagtggttacggttatccatgttgtaacaattgtaaggtttacttcattgatgaaactggagaatggggtattcaagatggtaactggtgtggtattgt

SEQ ID NO: 15389 - DNA, 114 bp, Neocallimastix californiae
  CBM_10
ttctgcttccatcactgctcaaggttacaagtgttgttctgctaattgtgaagtcgtttacactgataatgatggtgactggggtgttgaaaacaatgaatggtgtggttgtgg

SEQ ID NO: 15390 - DNA, 114 bp, Neocallimastix californiae
  CBM_10
ctcttcttccattaccgctcaaggttacaagtgctgttcttcctgcggtaccgtctactacactgatggtgatggtgattggggtgttgaaaacggtaactggtgtggtatgcc

SEQ ID NO: 15391 - DNA, 111 bp, Neocallimastix californiae
  CBM_10
ttgttgggctactaaaataggttactcatgttgtaagagtaccactcaagttgaatacactgatgatgatggtaagtggggtattgaaaacgatgattggtgtggtattgt

SEQ ID NO: 15392 - DNA, 114 bp, Neocallimastix californiae
  CBM_10
ctgttgggctactaagcttggttataagtgttgtaccgctgaatgtccagttgtctactacactgatgatgatggtaagtggagtgttgaaaatgatgactggtgtggtattat

SEQ ID NO: 15393 - DNA, 114 bp, Neocallimastix californiae
  CBM_10
ttcctctaatattactagacaaggttacaaatgttgttccaagaattgtgtagtcgtttacactgataatgatggtacttggggtgttgaaaatgaagaatggtgtggttgtag

SEQ ID NO: 15394 - DNA, 96 bp, Neocallimastix californiae
  CBM_10
tcaaggttatccatgctgtaaatcaaccaagcaagtttactacactgatgatgatggtagttggggtattgaagatggtgactggtgtattattag

SEQ ID NO: 15395 - DNA, 108 bp, Neocallimastix californiae
  CBM_10
ttggtcaattaaatttggttatccttgctgtattacttcatctgaagctttagtcactgatgataatggtcaatggggttctgaaaatggtcaatggtgtggtattgt

SEQ ID NO: 15396 - DNA, 108 bp, Neocallimastix californiae
  CBM_10
ttttgctacaaaattaggttatccatgctgtagtattggttatccatctattttaactgataaagatggtgactggagtgtggaaaatggtcaatggtgtggtatacc

SEQ ID NO: 15397 - DNA, 87 bp, Neocallimastix californiae
  CBM_10
ttacagcgaatgcaggggttgcgctgtatattatgttgaggatggtgttaattggggtgttgaaaacgacgactggtgtttaatacc

SEQ ID NO: 15398 - DNA, 105 bp, Neocallimastix californiae
  CBM_10
atgtttttcttatccagaatacacttgctgtgaaggctgtaatgttattgaagaagatggatctggtaagtggggtattgaaaataaccaatggtgtggtattaa

SEQ ID NO: 15399 - DNA, 99 bp, Neocallimastix californiae
  CBM_10
gggtaccggttatggttgctgtgtcttcaaaaataccattgttgaaaccgtggatgaaagtggtaaatggggacatgaaggtaatgaatggtgtcttgt

SEQ ID NO: 15400 - DNA, 117 bp, Neocallimastix californiae
  CBM_10
ttggtctcttgccgatggttatccatgttgtagaaaggaaaccactaaaattgaatatgtcagtaagagttccggtaaggaatggggtcttgaaaatggtgactggtgtggtatcac

SEQ ID NO: 15401 - DNA, 90 bp, Neocallimastix californiae
  CBM_10
cgaaagttactcttgctgtaagaaatgtgatgttatctacactgatgaatacaaatggggtgttgaaggtggagattggtgtattattcc

SEQ ID NO: 15402 - DNA, 96 bp, Neocallimastix californiae
  CBM_10
ccaaggttacccatgctgtaagaagagttgtgctatttacagtactgatggtgatggtgattggagtattgaaaataatgattggtgtttaattga

SEQ ID NO: 15403 - DNA, 111 bp, Neocallimastix californiae
  CBM_10
ttgttggtcaaaagcattaggttatgaatgctgtaaatcatgctctccagtttactttactgatgaagatggtgaatggggtgttgtaggtaatgattggtgtggtatacc

SEQ ID NO: 15404 - DNA, 114 bp, Neocallimastix californiae; identical to SEQ ID NO: 15140
  CBM_10

SEQ ID NO: 15405 - DNA, 111 bp, Neocallimastix californiae
  CBM_10
tgtagttgcttctatgggttatgcctgctgttctccaaacaatactgaagtctacttccaagatgaaaatggtgactggggagttgaaaataacgattggtgtggtattac

SEQ ID NO: 15406 - DNA, 111 bp, Neocallimastix californiae
  CBM_10
atgttggtctgataaattaggtttcccatgttgtagcggttgtattgatactgtttacactgataatgatggtaaatggggtgttcaaaatgatgactggtgtggtattcc

SEQ ID NO: 15407 - DNA, 123 bp, Neocallimastix californiae
  CBM_10
ttgctggagtgaaacccttggctacagatgttgtaaggataatgaaaacattgttcaatacatcgatgaagatggatggtggggtgttactaatgatgaacaaccagattggtgtggtatcgt

SEQ ID NO: 15408 - DNA, 111 bp, Neocallimastix californiae
  CBM_10
atgttggtctacttctttaggatactcctgttgtaaaacttgtactgatgttgtctttgtcgattcaagtggtaaatggggtgttgaaggagatgactggtgtggtattcc

SEQ ID NO: 15409 - DNA, 96 bp, Neocallimastix californiae
  CBM_10
tcaaggttattcctgttgtaaatctaattgcaatgtttatgaagaagattcagatggaaaatggagtattgagaatgacgaatggtgcctaattga

SEQ ID NO: 15410 - DNA, 108 bp, Neocallimastix californiae
  CBM_10
ttgctttgctgaaagattaggttacccatgttgttctggtaacgaagttgtttacaccgataacgatggaaagtggggtgtagaaaacggtaattggtgtggtattgc

SEQ ID NO: 15411 - DNA, 96 bp, Neocallimastix californiae
  CBM_10
gcaaggatacaagtgctgtgcctccggttgttctgttatctatactgatgatgatggtacttggggtgttgaaaatggtgaatggtgtggatgttc

SEQ ID NO: 15412 - DNA, 102 bp, Neocallimastix californiae
  CBM_10
ctcccaaggttacaagtgctgtagtgctaacaattgtaatgtctacttcactgatgatgctggtaagtggggtattgaaaacgacgattggtgtggtatttc

SEQ ID NO: 15413 - DNA, 111 bp, Neocallimastix californiae
  CBM_10
ctggtctgaaagtttaggttttccatgttgtccttctagttattgcgaaattgttaaaactgatagtcatggttcatggggtttccgtaacaatgaatggtgtggaattag

SEQ ID NO: 15414 - DNA, 108 bp, Neocallimastix californiae
  CBM_10
ctgtttctcagaaagattaggttacccatgttgtaagggtaacaatgtggtctacactgataatgatggaaagtggggtgttgaaaataataattggtgtggtattgg

SEQ ID NO: 15415 - DNA, 108 bp, Neocallimastix californiae
  CBM_10
ttgctggtctcaagctttaggttacccatgttgtactcacaaaaatgctgtttacactgatggtgatggtgattggggtgttgaaaatggtgattggtgtggtattat

SEQ ID NO: 15416 - DNA, 105 bp, Neocallimastix californiae
  CBM_10
taagggtgctcaaggatacccatgttgtaaatccaataagactgtttactacactgatgatgatggtgattggagtgttgaaaatgatgattggtgtttaattgc

SEQ ID NO: 15417 - DNA, 96 bp, Neocallimastix californiae
  CBM_10
tcaaggttacaagtgctgttctagtggttgtgaggttgtttacactgatgatgatggtacatggggtgttgaaaatgatgaatggtgtggatgtaa

SEQ ID NO: 15418 - DNA, 75 bp, Neocallimastix californiae
  CBM_10
ttctacctgtagagcagttacagtagaagatggtattagttggggtgtagaaaacaatgactggtgcattgttcc

SEQ ID NO: 15419 - DNA, 105 bp, Neocallimastix californiae
  CBM_10
atgtttctcttaccccgaatattcatgttgtaaaagttgtactgtaattgccgaagatgataatggtcaatggggtattgaagatgatgaatggtgtggtattag

SEQ ID NO: 15420 - DNA, 93 bp, Neocallimastix californiae
  CBM_10
cggatatacatgttgtgaaggttgtaaagtatctgaaatagatggtgatggtattagttggggtatagaaaacggtgaatggtgtattgtacc

SEQ ID NO: 15421 - DNA, 108 bp, Neocallimastix californiae
  CBM_10
atgtaccggttccaaccaaggttaccaatgttgtaacggttgtaaggttgaatacactgatggcgatggtccatggggtgttgaaaacggtcaatggtgtggtattaa

SEQ ID NO: 15422 - DNA, 111 bp, Neocallimastix californiae
  CBM_10
tttctctactagacttggcttcccatgctgtagtagctggaacaagaaagtcgaatttagcgatggtgatggtaactggggtattgaaaatggtagttggtgtggtattgg

SEQ ID NO: 15423 - DNA, 111 bp, Neocallimastix californiae
  CBM_10
ttgctggtcaacttcattaggatatccatgttgtagttcatgtgttaatgccgcttatcaagataatgatggttactggggtgtagaaaatgatgattggtgtggaattcc

SEQ ID NO: 15424 - DNA, 96 bp, Neocallimastix californiae
  CBM_10
tcaaggttatccatgttgtaaatctacttgtttagtttactctgaagatggtgatggtcaatggagtattgaaaacaatgactggtgtttaattga

SEQ ID NO: 15425 - DNA, 117 bp, Neocallimastix californiae
  CBM_10
gtgttggtctttagctgaaggttatccatgttgtgaaaagaagggaactaaagttagacatgtttctaagaatggtaatgaatggggtgttgaacatggtgactggtgtggtattac

SEQ ID NO: 15426 - DNA, 114 bp, Neocallimastix californiae
  CBM_10
atgttgggctaaggaattaggatttgagtgttgtacttcaaaagatattgaagttcaatacactgacaaagatggaaattggggaattgaaaatgatacatggtgtggtattat

SEQ ID NO: 15427 - DNA, 111 bp, Neocallimastix californiae
  CBM_10
ttgggcagaagaattaggttttaaatgctgttcttcgagtgatgccaaggtagaatatacagataatgatggtgaatggtctatagaagatggtaattggtgtggtatttt

SEQ ID NO: 15428 - DNA, 105 bp, Neocallimastix californiae
  CBM_10
ttgttggtctcttccagaatacccatgttgtaatggtgacactgttgtttatactgatggtcaaggagactggggttatgaaaatggagactggtgtggtattaa

SEQ ID NO: 15429 - DNA, 105 bp, Neocallimastix californiae
  CBM_10
atgttggtctcttccagattttccatgctgtaacggaaacactgttgtttatactgatatccaaggtgattggggttatgaaaacgataattggtgtggtattgt

SEQ ID NO: 15430 - DNA, 105 bp, Neocallimastix californiae
  CBM_10
ctggtcaactgctatgggatacaattgttgtagtggttgtaacgttgaaatagaagatgactccggtaaatggggtattgaaaataatcaatggtgtggtattga

SEQ ID NO: 15431 - DNA, 111 bp, Neocallimastix californiae
  CBM_10
atgttttggcgagatatctggagaatataaatgttgtgaaagttgtaaagtttggtacactgatgaacaaggcgattggggtgttgaaaataatgattggtgttccattaa

SEQ ID NO: 15432 - DNA, 108 bp, Neocallimastix californiae
  CBM_10
ttggtctgagaaattaggatatagttgttgtcaaaaaacatgtaagattaagtacactggtacagatggtaaatggggtattgaaaataatcagtggtgtggtattat

SEQ ID NO: 15433 - DNA, 114 bp, Neocallimastix californiae; identical to SEQ ID NO: 15140
  CBM_10

SEQ ID NO: 15434 - DNA, 111 bp, Neocallimastix californiae
  CBM_10
ctggtctgaagttcttggctatccatgttgtaaaggttgtactatttttgaggaggatgaagatggtcaatggggttatgatttcaaggaagctacctggtgtggtattca

SEQ ID NO: 15435 - DNA, 117 bp, Neocallimastix californiae
  CBM_10
ttgggtggctcaatttggttatccatgttgtagtagtaataacagagtagtttatgcctcagataatgaaggggactggggttacaattttgtaacaaaagaatggtgtggtattac

SEQ ID NO: 15436 - DNA, 109 bp, Neocallimastix californiae
  CBM_10
ttgttggtcacaacctctcggatatccatgttgttcttctccaaatgctgaagtttattacactgataacgatggtaagtggagtgtcgaaaacaacgattggtgtggc

SEQ ID NO: 15437 - DNA, 96 bp, Neocallimastix californiae
  CBM_10
caccgggtataattgttgtcttttcacaaccaccgttataacatcagattcggttggtgattggggtgttgaaaatgatgattggtgtctcattga

SEQ ID NO: 15438 - DNA, 87 bp, Neocallimastix californiae
  CBM_10
agaatatccatgttgtaaagaatgtaacgtttattacacggataccgaagattggggtattgaaaatggagaatggtgttccattcc

SEQ ID NO: 15439 - DNA, 108 bp, Neocallimastix californiae
  CBM_10
tccagatggtggtgataagtacagatgttgtcttaagacttgtaaggcctcttatactgattctactggtgattgggctgtcgaaagtaataattggtgtttaattcc

SEQ ID NO: 15440 - DNA, 117 bp, Neocallimastix californiae
  CBM_10
cccatcctctattacctctcaaggctataaatgctgtagtagtgataactgtaatgtatatgctactgatgatgatggtaaatggggtattgaagatggtgattggtgtggtatttc

SEQ ID NO: 15441 - DNA, 111 bp, Neocallimastix californiae
  CBM_10
tgatgccatcttaaagcaaggttacaagtgttgttcaaaggattgtaccatcatttatactgatgatgatggttcatggggtgtagaaaatgatgaatggtgtggatgttc

SEQ ID NO: 15442 - DNA, 109 bp, Neocallimastix californiae
  CBM_10
ttgttggtcacaacctctcggatatccatgttgttcttctccaaatgctgaagtttattacactgataacgatggtaagtggagtgtcgaaaacaacgattggtgtggt

SEQ ID NO: 15443 - DNA, 114 bp, Neocallimastix californiae
  CBM_10
ttgctggtccctttctcaaggttacccatgctgttcctcttcaaatgctgaagtttggtacactgatgcctcaggtaaatggggtgttgaaaatggagattggtgtggtattcc

SEQ ID NO: 15444 - DNA, 57 bp, Neocallimastix californiae
  CBM_10
ttacaccgacaatgatggtaaatggggtgtagaaaatggtaactggtgtggtattga

SEQ ID NO: 15445 - DNA, 99 bp, Neocallimastix californiae
  CBM_10
ttgggctgctccatatccatgttgtaagggaaatgaagttgtatatactgatgatcaaggtgattggggagttgaagatggtgattggtgtggtattgt

SEQ ID NO: 15446 - DNA, 96 bp, Neocallimastix californiae
  CBM_10
tccagattatccatgttgtagtgctggagcggaagtagtttatgaagatgatcaaggccaatggggtgttgaaaatggtgaatggtgtggtattga

SEQ ID NO: 15447 - DNA, 108 bp, Neocallimastix californiae
  CBM_10
ttgtaaatttgaagctcttggttacaagtgctgttctcactgtattagttacattgaagatgaggatggttcatggggtgttgaaaacggtaaatggtgtggtatctc

SEQ ID NO: 15448 - DNA, 108 bp, Neocallimastix californiae
  CBM_10
atgttggtctaagaagtatggttatccatgctgtgatacctgtaatgtattcatcattgataaatatggtgaatggggtatcaaggacaatgattggtgtggtattcc

SEQ ID NO: 15449 - DNA, 111 bp, Neocallimastix californiae
  CBM_10
ttgttggtctgaaacttatggttatccatgttgtaaaactacaaataaggttgtatacaccgatgaggatggtaaatggggtgttgaagataaaaaatggtgtggtattat

SEQ ID NO: 15450 - DNA, 114 bp, Neocallimastix californiae
  CBM_10
ttgctggtctgaaaaacttggttatccatgttgttcatcttcagatgccgaaattatatataccgataaagatggtaattggagtattgagaattatgaatggtgtggtattcc

SEQ ID NO: 15451 - DNA, 117 bp, Neocallimastix californiae
  CBM_10
ttgctgggctgaagcattaggatacaagtgttgtagtgctgatgccttcaccccagttattttcactgatagtgatggtgattggagtgctgaaaatggtgaatggtgtggtatttt

SEQ ID NO: 15452 - DNA, 114 bp, Neocallimastix californiae
  CBM_10
ttgttggtctaagacatatggttatgattgttgtgctgaaggaactgctgtatatctcgaagatgaaagtggtaaatggggtgtcaccgatgattaccaatggtgtggtattaa

SEQ ID NO: 15453 - DNA, 108 bp, Neocallimastix californiae
  CBM_10
tttcgcaaagtctgatggttatgactgttgtttcgataatgaagttgtttatgaagatgatagtggtaaatggggtataaatgatgaaggtgaatggtgcggtgttga

SEQ ID NO: 15454 - DNA, 117 bp, Neocallimastix californiae
  CBM_10
atgtagagctcaagtgaaaggatttccatgctgtaaaccaaatactgaaattttttcagttgatgctgacggttactggggatataatgaggaaactggtgaatggtgtggtatatc

SEQ ID NO: 15455 - DNA, 105 bp, Neocallimastix californiae
  CBM_10
ctgttggtcagaaccagattacccatgctgtaagtatagttgtgaagtttacttcactgatgatcataaatggggtattgaaaatggtgaatggtgtggtatttc

SEQ ID NO: 15456 - DNA, 102 bp, Neocallimastix californiae
  CBM_10
taaaaatgtcggtttatacaactgttgtgaatcttgtaacatttacactgaagaagaaggtgataaatggggtgttgaaaatgatgaatggtgtagtattaa

SEQ ID NO: 15457 - DNA, 106 bp, Neocallimastix californiae
  CBM_10
ttgttggtcacaacctctcggatatccatgttgttcttctccaaatgctgaagtttattacactgataacgatggtaagtggagtgtcgaaaacaacgattggtgt

SEQ ID NO: 15458 - DNA, 111 bp, Neocallimastix californiae
  CBM_10
atgctgggctaatgaattaggttacgcatgttgtaagtcagcaaaaactgtttatgcaacagataaggatggcaaatggagtgtagaaaataatgaatggtgtggtatcgt

SEQ ID NO: 15459 - DNA, 108 bp, Neocallimastix californiae
  CBM_10
atgtttttctgaaaagcttggttataaatgttgttatggaacaagagttgttttaactgattctgatggtaaatggggagttgaaaataatcaatggtgtggtatatc

SEQ ID NO: 15460 - DNA, 108 bp, Neocallimastix californiae
  CBM_10
ttggtcacacagatacggttatccttgttgtactaaaacaaatgaagtattgtatagtgattcggatggtgattggggtatagaaaatggtgaatggtgtggtgttgc

SEQ ID NO: 15461 - DNA, 111 bp, Neocallimastix californiae
  CBM_10
tttcacctctattaacaatttaggttatccatgttgtgaaggttgtgaaattctgtatacagatgatgatggtgattggggggttgaaaatgaagattggtgtggcattcc

SEQ ID NO: 15462 - DNA, 87 bp, Neocallimastix californiae
  CBM_10
cgctgaatatccatattgtaataattgtgtgactgtttacgaagacgatcaaaaatggggtattttaaataatcaatggtgtagaat

SEQ ID NO: 15463 - DNA, 108 bp, Neocallimastix californiae
  CBM_10
ttgggctgaagaatatggttattcatgttgtagtggatgcggtattgtcgtcgaagaacctggtaatgttaattggggtattgaatacgataagtggtgtggtatcat

SEQ ID NO: 15464 - DNA, 111 bp, Neocallimastix californiae
  CBM_10
tttttctactagacttggttatccatgttgtagtagttggaataagcaagttgcatacacagataatgacggaaattggggtgttgaaaatggtaattggtgtggtataag

SEQ ID NO: 15465 - DNA, 108 bp, Neocallimastix californiae
  CBM_10
atgcactggtcaaaaccaaggatatcaatgttgtaatggttgtaaggtagaatataccgataatgatggtaaatggggtattgaaaataatcaatggtgtggtatcaa

SEQ ID NO: 15466 - DNA, 108 bp, Neocallimastix californiae
  CBM_10
atgtttttcagaaaaacttggatacaagtgttgtgaaggtaatgttgtagaatatatagatgaagatggtaagtggggaatagaaaatgatcaatggtgtggtatttc

SEQ ID NO: 15467 - DNA, 111 bp, Neocallimastix californiae
  CBM_10
ctctgctaatataaagaatcaaggatattcatgctgttcaaattgtattgtatattatacagataatgatggtaaatggggtatagaaaatgaatcatggtgtggtattcc

SEQ ID NO: 15468 - DNA, 96 bp, Neocallimastix californiae
  CBM_10
ggatcaaggttatccttgctgtaaatcatgtaacgttattcttactgatgaaagtggtgattggggtgttgaaaataatgattggtgtggcatttc

SEQ ID NO: 15469 - DNA, 108 bp, Neocallimastix californiae
  CBM_10
atgctggtctactcaatttggttatccatgttgtgacacttgtgatgtattcttatctgatgaatctggtgattggggtgttaaagatttagattggtgtggtattcc

SEQ ID NO: 15470 - DNA, 105 bp, Neocallimastix californiae
  CBM_10
taaggcagaagctcttggttacaagtgttgctccacctgtgtcagtattcttgaagacgaaaatggcttatggggtgctgaaaatggtgaatggtgtggaattac

SEQ ID NO: 15471 - DNA, 102 bp, Neocallimastix californiae
  CBM_10
tttctcattcccaaattacaaatgttgtaaagattgtcaagttgtatatgaagacgaagatggcaaatggggatatgaaaatgatgaatggtgtggtatgaa

SEQ ID NO: 15472 - DNA, 114 bp, Neocallimastix californiae
  CBM_10
atgctggtctgaaagtttaggttttccatgttgtccatctgactactgtgaagttgcaaaaaccgatagtagtggttcttggggtatctttgacaataattggtgtggtattag

SEQ ID NO: 15473 - DNA, 102 bp, Neocallimastix californiae
  CBM_10
tttatctgctggtgaatatccttgctgtgaaagttgtaacatttattctgaagaagaaggtgataagtggggtattgaaaacaacgattggtgtagtataaa

SEQ ID NO: 15474 - DNA, 105 bp, Neocallimastix californiae
  CBM_10
ttgttggtctgaaccagattacccatgttgtaaatctagctgtgaagtttactatactgatgaacataagtggggtgttgaaaatggagattggtgtggtattac

SEQ ID NO: 15475 - DNA, 114 bp, Neocallimastix californiae
  CBM_10
atgttggtcaattgcagttggttatccatgctgtagtaatgctaacgctgaaattataatgaccgatgaaagtggtaactggggtattgaaaatgatgattggtgtggtatttt

SEQ ID NO: 15476 - DNA, 108 bp, Neocallimastix californiae
  CBM_10
ctggtcagaagaatttggatatccatgctgtaaaaataaagatactaaagtttcatcaactgaccaaagtggaacatggggtattgaaaatggtaaatggtgtggtct

SEQ ID NO: 15477 - DNA, 111 bp, Neocallimastix californiae
  CBM_10
ttggtcaatcgcatttggttatccatgttgtactaacacttacactcaagttgtaatgaatgatgaatctggtgaatggggtgttgaaaatgatgattggtgtggtattgt

SEQ ID NO: 15478 - DNA, 111 bp, Neocallimastix californiae
  CBM_10
atgctggtctaaaaaatacggttacccatgttgtgaaaatactgaacagaaacctattacatatgatgcaacaggttcatggggatatgaaaataatagcttttgtggtct

SEQ ID NO: 15479 - DNA, 102 bp, Neocallimastix californiae
  CBM_10
atgtttttcatacccattatatccttgctgtaatggttgtgatgttattgaagaaactgaagaaggtaaatggggtgttgaaaatgacgaatggtgtggttt

SEQ ID NO: 15480 - DNA, 84 bp, Neocallimastix californiae
  CBM_10
ttacgaagaatgtaaaggttgtggagtagtttatgaagatgatatgaaatggggtgttgaaaatgatgattggtgtattatacc

SEQ ID NO: 15481 - DNA, 108 bp, Neocallimastix californiae
  CBM_10
ttgtttttctattgttcaaggctatccatgttgtgaaacttgtcatattgactatactgatgaaagtggagattggggtgtagaagatgataaatggtgtggtataag

SEQ ID NO: 15482 - DNA, 114 bp, Neocallimastix californiae
  CBM_10
atgcttttcacaaaaattaaatccatcttatccatgttgtaaaggaaatgaagtcgtctatactgatgaaagtggtgattggggtgtagaaaataatagctggtgtggtattag

SEQ ID NO: 15483 - DNA, 108 bp, Neocallimastix californiae
  CBM_10
atgtttttctatagaattaggatatccatgttgtaaagataataaagtcatatataccgatgaaagaggtgattggggtaaagaaaatcatcaatggtgtggtattgg

SEQ ID NO: 15484 - DNA, 105 bp, Neocallimastix californiae
  CBM_10
ttggtcaaatgaacttggttatccaagttgccaatctactaaagagattaaattttatgctgaacaaggaggctttggttatgaaaatggttcatggtgtggttt

SEQ ID NO: 15485 - DNA, 96 bp, Neocallimastix californiae
  CBM_10
ttggtcattagaccaaggctatccatgttgtgaaggtcaataccaaaagtatgatgatgattggggttatcaaaataatgaatggtgtggtattat

SEQ ID NO: 15486 - DNA, 114 bp, Neocallimastix californiae
  CBM_10
atgttgggctaaagcattaggttatgaatgttgtaaaagtgaaaatccaaaagtttatactgttgatggtgatggtgaatgggctattgaaaatagtgaatggtgtggaataat

SEQ ID NO: 15487 - DNA, 114 bp, Neocallimastix californiae
  CBM_10
atgttggtcattagatctaggttatccatgttgtaatcctaaaaataccaatgtagtatacacggatggaactggtaaatggggtgttgaaaatggtgattggtgtggtattat

SEQ ID NO: 15488 - DNA, 117 bp, Neocallimastix californiae
  CBM_10
ttggtccgaattattatctaatccattcccttgttgtaaaaatgatgacgtcaaagaaattggaaaggatatggatggagcatggggtgaagaaaatggaacgaaatgcggtattag

SEQ ID NO: 15489 - DNA, 111 bp, Neocallimastix californiae
  CBM_10
atgctttgctaaaagattaggatattcttgctgtactactactaaagaggtagtttccattgatcctaacggtaaatggggaatagaaaatggacacatttgcggaattga

SEQ ID NO: 15490 - DNA, 114 bp, Neocallimastix californiae
  CBM_10
tttatctgaatttattggatatccatgttgttcacctgaatttactaccatttatgcacaagatgaatatggagattggagctatgatttcgttaagaatgaatggtgtggttt

SEQ ID NO: 15491 - DNA, 108 bp, Neocallimastix californiae
  CBM_10
atgttggtcagaagaattaggatatccatgttgtaaaggatgcagagtctatgaaacggattctgatggatcctggggatatgagtttaatcaatggtgtggtattat

SEQ ID NO: 15492 - DNA, 108 bp, Neocallimastix californiae
  CBM_10
atgttggtcagaagaattaggatatccatgttgtaaaggatgcagagtctatgaaacggattctgatggatcctggggatatgaatttaatcaatggtgtggtattat

SEQ ID NO: 15493 - DNA, 100 bp, Neocallimastix californiae
  CBM_10
ttgttggtcacaacctctcggatatccatgttgttcttctccaaatgctgaagtttattacactgataacgatggtaagtggagtgtcgaaaacaacgat

SEQ ID NO: 15494 - DNA, 114 bp, Neocallimastix californiae
  CBM_10
atgcttttcacaaaaattaaatccatcttatccatgttgtacaggaaatgaagtcgtctatactgatgaaaatggagattggggtgtagaaaataatagctggtgtggtattag

SEQ ID NO: 15495 - DNA, 108 bp, Neocallimastix californiae
  CBM_10
ttgtttttctatagaattaggatatccatgttgtacagataataaagttatctataccgatgaaagaggtgattggggtaaagaaaatcatcaatggtgtggtattgg

SEQ ID NO: 15496 - DNA, 108 bp, Neocallimastix californiae; identical to SEQ ID NO: 15495
  CBM_10

SEQ ID NO: 15497 - DNA, 108 bp, Neocallimastix californiae
  CBM_10
ttgtttttctattgttcaaggctatccatgttgtaaaacttgtcatattgactatactgatgaaagtggagattggggtgtagaagatgataaatggtgtggtataaa

SEQ ID NO: 15498 - DNA, 114 bp, Neocallimastix californiae
  CBM_10
atgcttttcacaaaaattaaatccatcttatccatgttgtacaggaaatgaagtcgtctatactgatgaaagtggagattggggtgtagaaaataatagctggtgtggtattag

SEQ ID NO: 15499 - DNA, 114 bp, Neocallimastix californiae; identical to SEQ ID NO: 15494
  CBM_10

SEQ ID NO: 15500 - DNA, 108 bp, Neocallimastix californiae; identical to SEQ ID NO: 15497
  CBM_10

SEQ ID NO: 15501 - DNA, 108 bp, Neocallimastix californiae; identical to SEQ ID NO: 15495
  CBM_10

SEQ ID NO: 15502 - DNA, 108 bp, Neocallimastix californiae
  CBM_10
atgctctgctgaagcgtatggatacaagtgttgtaaaggatgtacagtagttacttctgatgaaacaggtgattggggtgttgaaaataatgaatggtgtggtattcc

SEQ ID NO: 15503 - DNA, 108 bp, Neocallimastix californiae
  CBM_10
ctgttggtctcttccaagttatccatgttgttctactagtaccagtgtggtttatgaagatgaacttggtaagtggggtattgaaaatgatgattggtgtggtattaa

SEQ ID NO: 15504 - DNA, 108 bp, Neocallimastix californiae
  CBM_10
ttgttggtctgctccagattatccatgttgttcaaataatgctaatattatttattccgatggacaaggagattggggatatgaaaatgataattggtgtggaattgt

SEQ ID NO: 15505 - DNA, 111 bp, Neocallimastix californiae
  CBM_10
ttgctggtctgaaaagttagattacccatgctgtacttctacctgttatgtttactcaactgatgtagatggtgaatggggttacgaagacaatcattggtgtggtgttcc

SEQ ID NO: 15506 - DNA, 108 bp, Neocallimastix californiae
  CBM_10
atgctggtccactaagcttggttatggatgttgtgaaggatgtcatacttatgaagttgatgacaatggaaaatggggttatgaaaacggaaagtggtgtggtattgt

SEQ ID NO: 15507 - DNA, 108 bp, Neocallimastix californiae
  CBM_10
ttgtaaatttgaagaaattggatattcatgttgctctcattgtgatgtagtatatactgatgaagatggtgactggggtactgaagatggtaaatggtgtggtattcc

SEQ ID NO: 15508 - DNA, 114 bp, Neocallimastix californiae
  CBM_10
ctgttgggcagaagaacaaggttacccatgttgctctgatacgaatagaaaagttgaacaaattgatgataatggtaatgcttgggctatagaaaataatgattggtgtggttt

SEQ ID NO: 15509 - DNA, 111 bp, Neocallimastix californiae
  CBM_10
ttgttggtctttaccagattatccatgttgtagtaatgagaataccgctgttataacaactgatgaacaaggtgattggggtgttgagaatggtgattggtgcggtattat

SEQ ID NO: 15510 - DNA, 114 bp, Neocallimastix californiae
  CBM_10
ttctcaagctatcttaagtcaaggatataaatgctgttcaagcgattgtgttgtcatctttacggatgatgatggaacatggggtatagaaaacgatgaatggtgtggatgtaa

SEQ ID NO: 15511 - DNA, 102 bp, Neocallimastix californiae
  CBM_10
ttctcaaggctacaaatgttgtaaggataacaactgttctgttattgaaacagatgatgctggtaaatggggtattgaagatgacgattggtgtggtatttc

SEQ ID NO: 15512 - DNA, 108 bp, Neocallimastix californiae
  CBM_10
ttgttggtcacttccatttggatacccatgttgtccacattgtaaggttcttactgaggatgagaatggtaaatggggagaattaaatggagaatggtgtggtattgt

SEQ ID NO: 15513 - DNA, 114 bp, Neocallimastix californiae; identical to SEQ ID NO: 15178
  CBM_10

SEQ ID NO: 15514 - DNA, 108 bp, Neocallimastix californiae
  CBM_10
ttgggcaaatatacttggttatcaatgctgtgaaaatactaaagaagtatttttaaaggatgaaagtggtagttggggtattgaaaatgacgattggtgtggtatagt

SEQ ID NO: 15515 - DNA, 111 bp, Neocallimastix californiae
  CBM_10
ttgctgggcagatgctctcggatacaactgttgtatttatacaaaagaagtaatttacacagatgaaagtggagattggggtgtagaaaataatgaatggtgtggtattat

SEQ ID NO: 15516 - DNA, 105 bp, Neocallimastix californiae
  CBM_10
tttctctgaagaaatgggttacccatgctgtagtgactgttccgtagtctacaccgatagtgatggtggttggggtgttgaaggtgatgactggtgtggtattaa

SEQ ID NO: 15517 - DNA, 111 bp, Neocallimastix californiae
  CBM_10
ctgctggtctaaggctcttggttacccatgttgtaagagtagttgtgaagttatttactctgatgatgatggtgaatggggtgttgaagatgctgattggtgtggtattga

SEQ ID NO: 15518 - DNA, 111 bp, Neocallimastix californiae
  CBM_10
ttgctggtcagaaaaattaggttatccatgctgtgtttcttcttgttatgtttacgaatctgataatgaaggtgaatggggttatgaagacaatcactggtgtggtatttc

SEQ ID NO: 15519 - DNA, 105 bp, Neocallimastix californiae
  CBM_10
ctggtctaagaagtttggttacgactgttgtaacggatgtacttcttatgaagaagattctaatggtaaatggggttatgaagaaaataaatggtgtggtattgt

SEQ ID NO: 15520 - DNA, 117 bp, Neocallimastix californiae
  CBM_10
ttgctctgcttccattttagctcaaggatatgaatgctgttctgataactgtgaagttgtttatactgatgctgatggtgattggggtgttgaaaatgaacaatggtgtggttgtgg

SEQ ID NO: 15521 - DNA, 96 bp, Neocallimastix californiae
  CBM_10
tcaaggttacgaatgctgctcatcttgtggtaccgtttactacaccgatgatgatggtgaatggggtgttgaaaacaacaattggtgtggtatgcc

SEQ ID NO: 15522 - DNA, 117 bp, Neocallimastix californiae
  CBM_10
ttgctctgctaagatcttaagtcaaggttacaagtgttgtaagaagggatgtgctatcatttatactgatgatgatggtacttggggtgttgaaaatggagaatggtgtggatgcac

SEQ ID NO: 15523 - DNA, 102 bp, Neocallimastix californiae
  CBM_10
tgctgctcaaggatatcaatgttgtagtcctggtaactgtagtatctatcttgaagatgatactggtagatggggtattgaaaatgatgaatggtgtggtac

SEQ ID NO: 15524 - DNA, 108 bp, Neocallimastix californiae
  CBM_10
atgttggtctgaagtatttggttatccatgttgtaagggatgttacgtctatgaaactgatgacgatggtaaatggggttatgaaaatcaacattggtgcggtattca

SEQ ID NO: 15525 - DNA, 117 bp, Neocallimastix californiae
  CBM_10
atgtatggctgaaattattggttacccatgttgtgataaaaatgttaagactgtctatgaaaaagatgtctatggggattggggttatgacttcaagaagggtgaatggtgtggtct

SEQ ID NO: 15526 - DNA, 111 bp, Neocallimastix californiae
  CBM_10
atgtgcttttgaaaaaattggttacaaatgttgtgaaagtactactgaagtcgtatttgaagatggaagtggtacttggggtgtagaaaacaatgaatggtgtggtattac

SEQ ID NO: 15527 - DNA, 93 bp, Neocallimastix californiae
  CBM_10
agatggatatgaatgttgtaatggttgtagtgttgttgaacaatcagatggttataagtggggtgttgaaaataataaatggtgtattatcaa

SEQ ID NO: 15528 - DNA, 105 bp, Neocallimastix californiae
  CBM_10
atgttggtcaacaaaattaggttatggatgttgtactggatgtgatgtatcatacactgataatgatggtgattggggatatgaaaacgattggtgtggtatacc

SEQ ID NO: 15529 - DNA, 99 bp, Neocallimastix californiae
  CBM_10
cactacttctggctacaaatgttgtgatgattgtaatgttacttatgaagatagcactggtaaatggggtattaaggacaatgattggtgcgctatttc

SEQ ID NO: 15530 - DNA, 96 bp, Neocallimastix californiae
  CBM_10
aaaccaaggctattcatattgtaatttatgtgatgttatttacaatgacaatgatggccgatggggtattgaaaatggggaatggtgtggtattaa

SEQ ID NO: 15531 - DNA, 105 bp, Neocallimastix californiae
  CBM_10
tttttccattaatcttggatatccatgttgtaatggtaatacagtctactatactgataatgatggtcaatggggttacgaaaacaacaactggtgtggtattaa

SEQ ID NO: 15532 - DNA, 111 bp, Neocallimastix californiae
  CBM_10
atgttggtctgagaaatacggttatccatgttgtgattcatgtattgatgttaatttcgaggattctaatggttattggggtattcaaaatggtgaaatttgtggtatacc

SEQ ID NO: 15533 - DNA, 108 bp, Neocallimastix californiae
  CBM_10
ctggtcttctaatttgggctattcatgttgtccttcaggtactcctgtttactttacagatgaaaatggtgactggggtatcattaatgatgactggtgtggtattgt

SEQ ID NO: 15534 - DNA, 108 bp, Neocallimastix californiae
  CBM_10
tttctcagaggagcttggttatccctgctgttccagtggcgttttagtctatgaaaaggatgaacatggatcatggggtattgaaaataatgactggtgtggtattat

SEQ ID NO: 15535 - DNA, 105 bp, Neocallimastix californiae
  CBM_10
tttctccataccccttggctatccctgctgttctgagggcactccagaatactataccgatgagaatggttcatggggtgtagaaaatgatgactggtgtggact

SEQ ID NO: 15536 - DNA, 105 bp, Neocallimastix californiae; identical to SEQ ID NO: 15535
  CBM_10

SEQ ID NO: 15537 - DNA, 108 bp, Neocallimastix californiae; identical to SEQ ID NO: 15534
  CBM_10

SEQ ID NO: 15538 - DNA, 108 bp, Neocallimastix californiae; identical to SEQ ID NO: 15533
  CBM_10

SEQ ID NO: 15539 - DNA, 108 bp, Neocallimastix californiae
  CBM_10
tagtagtagaattacctctcaaggttataaatgctgtagtaactgtatcgtttactacactgataatgatggtgaatggggtgttgaagatggtaactggtgtggaac

SEQ ID NO: 15540 - DNA, 96 bp, Neocallimastix californiae
  CBM_10
atgtcactggcaatacccatgttgtgataactgtgaagtttattatactgataatgaaggtaaatggggtattttaaacaatgactggtgtaaaat

SEQ ID NO: 15541 - DNA, 111 bp, Neocallimastix californiae
  CBM_10
atgtaaatttgctaaaattggctatatgtgctgtaagaacaccgataaagttattcttcttgacaaaactggttcctggggagttgaaaatggcaaatggtgtggcattaa

SEQ ID NO: 15542 - DNA, 111 bp, Neocallimastix californiae
  CBM_10
atgttggagtgctttattaggttacaaatgctgtaagaagagctttagtcctttatacaaagacaagaacggaatctggagtgttgaaaatgataaatggtgtggtgtaga

SEQ ID NO: 15543 - DNA, 111 bp, Neocallimastix californiae
  CBM_10
ctggtcggaaaaattaggttatccctgttgtaagccaacgaataccgaaattttagaagtagataaatacggtgaatggggtatggaaaatggtgaaagatgtggaattca

SEQ ID NO: 15544 - DNA, 111 bp, Neocallimastix californiae; identical to SEQ ID NO: 15543
  CBM_10

SEQ ID NO: 15545 - DNA, 114 bp, Neocallimastix californiae
  CBM_10
taatgccaatattattgctcaaggttacaaatgttgtagagttggatgtactgttgaatacactgataatgatggtgaatggggtgttgaagatggtgactggtgtggttgtgg

SEQ ID NO: 15546 - DNA, 99 bp, Neocallimastix californiae
  CBM_10
tcgtcaaggttacaaatgttgtagagttggatgtactgttgaatacactgataatgatggtgaatggggtgttgaagatggtgactggtgtggttgtgg

SEQ ID NO: 15547 - DNA, 102 bp, Neocallimastix californiae
  CBM_10
ttggtctcttccagattatccatgctgtactggaaatgaagttgtttacacagatagtgatggcgattggggttacgaaaataatcaatggtgtggtattgc

SEQ ID NO: 15548 - DNA, 105 bp, Neocallimastix californiae
  CBM_10
tttctcggaatctcttggatataattgttgtaaaggatgtgatataattttaactgatgattatggttcatggggtgttgaaaataatgattggtgtggtattaa

SEQ ID NO: 15549 - DNA, 108 bp, Neocallimastix californiae
  CBM_10
atgttggtcacttccagaatataaatgttgttcagaaggtatagaatctatttttgaagattccattggtaagtggggtatagaagataatgaatggtgtggtattaa

SEQ ID NO: 15550 - DNA, 96 bp, Neocallimastix californiae
  CBM_10
cccaaaaaatgatgaatataaatgctgtggaaattgtgatgtttattatgttgatgattttgaatggggtgtggaagatggtaagtggtgtttaac

SEQ ID NO: 15551 - DNA, 117 bp, Neocallimastix californiae
  CBM_10
gtgttgggcacttgctgaaggttatccatgttgtaagaataaggatgccaaagtgtattctactgataagcatggtaaaaaatggggtattgaagataataattggtgtggtattat

SEQ ID NO: 15552 - DNA, 93 bp, Neocallimastix californiae
  CBM_10
ttctggttatagctgttgtgtattaactaagaaggttgaattaactgataacgttggtcagtggggtgttgaaaatggtgaatggtgtctttt

SEQ ID NO: 15553 - DNA, 111 bp, Neocallimastix californiae
  CBM_10
ctgttggtctaaaagtttaggttacccatgttgttcaggaaaatcagctgtactttatactgatgccagtggtcaatggggtgttgaaaatggtgactggtgtggtattgc

SEQ ID NO: 15554 - DNA, 114 bp, Neocallimastix californiae
  CBM_10
ttgggctaaggctcttggttcaaactgttgtagtactagtagctgtagaaatgttgtttactttgactacgatggtcaatgggatgttgaaaatggtgaatggtgtggtatctc

SEQ ID NO: 15555 - DNA, 111 bp, Neocallimastix californiae
  CBM_10
atgtacatttgaatctattggttacaaatgctgttcaaattcatgtactgtagtttatacagatgaaagtggtgattggggtgtagaaaatggtgaatggtgtggtattat

SEQ ID NO: 15556 - DNA, 105 bp, Neocallimastix californiae
  CBM_10
atgttttgcagaaaaattaggatactcatgttgtaatgaatgtaatattatttatactgataatgatggtgaatggggtatagaaaatgatgaatggtgtggttt

SEQ ID NO: 15557 - DNA, 108 bp, Neocallimastix californiae
  CBM_10
ttggtctcaatccttaggttatggttgttgtagcggttgtattgatgtcattatgaccgataatgatggtgaatggggagtagaaaataatgattggtgtggtattcc

SEQ ID NO: 15558 - DNA, 105 bp, Neocallimastix californiae
  CBM_10
cagcggtgcccaaggttatccttgctgtaaatccacttgttcatcatatttccaagataacgatggtgaatggggtgttgaaaatgatgattggtgtttaattaa

SEQ ID NO: 15559 - DNA, 108 bp, Neocallimastix californiae
  CBM_10
atgtttctctgttgacattggttatccatgttgtactaacaactccccagtttattacaccgatgatgatggtaaatggggtgttcaaaatggtgactggtgtggtct

SEQ ID NO: 15560 - DNA, 111 bp, Neocallimastix californiae
  CBM_10
ctgttggtcaaagaagcttggttatccatgctgttcaaagaacgcttctaccgtatatactgatgctgatggtaagtggggtgttgaaaacaatgaatggtgtggtataaa

SEQ ID NO: 15561 - DNA, 108 bp, Neocallimastix californiae
  CBM_10
ttgtttttctattgttcaaggctatccatgttgtgaaacttgtcatattgactatactgatgaaagtggagattggggtgtagaagatgataaatggtgtggtataaa

SEQ ID NO: 15562 - DNA, 114 bp, Neocallimastix californiae
  CBM_10
atgttggtcagaaaaattaggttattcatgctgttcagaaaacaacactagggttgtcttaactgatgatgatggtaaatggggagctgaaaacggtgaatggtgtggtattag

SEQ ID NO: 15563 - DNA, 117 bp, Neocallimastix californiae
  CBM_10
ttgttggtccattgaacttggttatccatgctgtagtactagtgaatgtaaagttgtttatgaagaagatgatgacggcaaatggggtgctgaaaacaatgattggtgtggtatcac

SEQ ID NO: 15564 - DNA, 99 bp, Neocallimastix californiae
  CBM_10
taaaaaagatggttttaattgttgtaatggttgtaccgttacctatactgatgcctctggtaaatggggtgttgagaataaccaatggtgtggtattga

SEQ ID NO: 15565 - DNA, 108 bp, Neocallimastix californiae
  CBM_10
atgttgggctacatcacaaggttatccatgctgtactggatgtgatgcaatttacactgacggtagtggaaagtggggttttgaaaataataactggtgtggtattgt

SEQ ID NO: 15566 - DNA, 111 bp, Neocallimastix californiae
  CBM_10
ttgttggtcagctgcagaaggtttcccatgttgttctacaactactgctgttgtccttactgatagtaagggtaagtggggtattgaaaataataattggtgtggtattgt

SEQ ID NO: 15567 - DNA, 102 bp, Neocallimastix californiae
  CBM_10
taataccggctatcattgttgttctgatccaaataccacagtatatacttccgattcctcaggtgattggggtgttgaaggtgattactggtgtttaattgt

SEQ ID NO: 15568 - DNA, 114 bp, Neocallimastix californiae
  CBM_10
atgttggtctttagaaagaggctatccatgttgtgtttatgctactacagtttactatacttcttccaatggtaaaacatggagtgttgaaaatggtgattggtgtggtattat

SEQ ID NO: 15569 - DNA, 105 bp, Neocallimastix californiae
  CBM_10
aagcgattatccaaattgtaaaaataaggatacagaaatattatatagttcagatgatactaaaaaagaatggggagaagaaaatgatgattggtgtattattac

SEQ ID NO: 15570 - DNA, 108 bp, Neocallimastix californiae
  CBM_10
tcctaattcttctgatggttatccatgttgtccagattgtaatgtagtttacactgatgaaaataatcaagtttggggaaatttaaatgatgaatggtgttctattcc

SEQ ID NO: 15571 - DNA, 108 bp, Neocallimastix californiae
  CBM_10
atgtttctcagaaccagatttcccatgttgtacttccactacagaagttgttgaagtcgatgaaaatggagaatggggaattgaaaatggaaactggtgtggtattag

SEQ ID NO: 15572 - DNA, 105 bp, Neocallimastix californiae
  CBM_10
tccaggtgaaaatttaggttataattgttgtagttcttgtatagaaccatatgaagaagatgaaaatggaaaatgggctgttgtagatgaaagctggtgttctct

SEQ ID NO: 15573 - DNA, 108 bp, Neocallimastix californiae
  CBM_10
atgtttttctaatggtttaggttatccatgttgtaactcttgtgatattatttacattgatgaaagtggtaactggggtgttgaaaatggagattggtgtggtattaa

SEQ ID NO: 15574 - DNA, 111 bp, Neocallimastix californiae
  CBM_10
atgctttgctacaatattaggatttaattgttgtgcatcatgtattaactcaatatatgatgatgatgacggtcattggggattagaaaataatgattggtgtggaatacc

SEQ ID NO: 15575 - DNA, 108 bp, Neocallimastix californiae
  CBM_10
ttgctttgctatatcattaggctattcatgttgtgagggaagtgaaattgtatataccgatgatgatggtgattggggttacgaaaatgacaattggtgtggaattga

SEQ ID NO: 15576 - DNA, 108 bp, Neocallimastix californiae
  CBM_10
atgcccaggaaaatctgaaggatatcaatgctgttcatcatgtaacgttgtttttacagatgaaaacggttcatggggtgttgaaaataatgaatggtgtggtatcag

SEQ ID NO: 15577 - DNA, 90 bp, Neocallimastix californiae
  CBM_10
tcttggatacccatgttgtgaaaacacatttgaagctacttatactgatgaaaatggtaaatgggccattgaaaatggtgattggtgtga

SEQ ID NO: 15578 - DNA, 108 bp, Neocallimastix californiae
  CBM_10
ttgggctaaggctttaggttatgaatgttgtaagacttgtcaaactactgtatcaaaagatgaaaatggtgaatggggtattgaaaatgatgaatggtgtggtattac

SEQ ID NO: 15579 - DNA, 105 bp, Neocallimastix californiae
  CBM_10
tttcgcaaaggcacaaggttttgaatgttgtaatgacagtgaagtagtatattctgatgattctggtgactggggtgttgttaatggacaatggtgtggtattgg

SEQ ID NO: 15580 - DNA, 87 bp, Neocallimastix californiae
  CBM_10
tgactacccatgctgttctgaatgtaattctgtctactctgatgaatctggtgaatggggtgttgaaaacaatgattggtgtttatt

SEQ ID NO: 15581 - DNA, 96 bp, Neocallimastix californiae
  CBM_10
gaatgaaggatacagtaaatgtgataactgtgaagttgtttacagtgatgattctggtaactggggtgtccaaaacaatgattggtgtggtattag

SEQ ID NO: 15582 - DNA, 93 bp, Neocallimastix californiae
  CBM_10
aggtcaagaatataattgttgtaaaggatgtgatgttatttataccgatacttcagattggggagttgaagatgatgattggtgttctattcc

SEQ ID NO: 15583 - DNA, 120 bp, Neocallimastix californiae
  CBM_10
atgttgggcaacagaacttggttatccatgttgtgaattaaaaactacaaaaatcgaatttacagatagtggttctggtaaacaatttggtgttgaaaataatcatatttgtggtattaa

SEQ ID NO: 15584 - DNA, 111 bp, Neocallimastix californiae
  CBM_10
aaagattcttgctcaaggatataaatgctgttctgacaagaattgtattgtatactatgaagatagcgatggttactggggaattgaaaatgatgattggtgtggttgtgg

SEQ ID NO: 15585 - DNA, 93 bp, Neocallimastix californiae
  CBM_10
aggttatccttgttgtaaaaatacatctactgtcttctatactgatgatgatggtgactggggtgttgaaaacaataactggtgtgtaatcaa

SEQ ID NO: 15586 - DNA, 108 bp, Neocallimastix californiae
  CBM_10
ttgttggtctgaacgtttaggttattcctgttgtcaaggatgtcaagtggtagaagtcgataacgacggtaactggggtatcgaaaatgatcaatggtgtggtatacc

SEQ ID NO: 15587 - DNA, 117 bp, Neocallimastix californiae
  CBM_10
atgtacatcagaaaaattaggttacccatgttgttcctctaataataataaagtttattatactgataatgatggagattggggctttgatgaaaataccaataactggtgtggttt

SEQ ID NO: 15588 - DNA, 108 bp, Neocallimastix californiae
  CBM_10
atgttggtctaagaagttcggtattgaatgttgtaaacaaacaaaggaagtcgtcagagaaacttatgatggtctctggggtaaggaaaatggtgaatggtgtggtct

SEQ ID NO: 15589 - DNA, 102 bp, Neocallimastix californiae
  CBM_10
ttttgcttctccagcttacccatgttgctctaagtgtaacgttgtatatactgatgaagagggcgaatggggatacgaaaaaggatcatggtgtggtattaa

SEQ ID NO: 15590 - DNA, 111 bp, Neocallimastix californiae
  CBM_10
ttgttggtctgaaaaattaggatatgattgttgtaaacattgtaccgtatcctatactgacgaaagtggtgaatggggtgttgaagaagatgatgtttggtgtggtatttt

SEQ ID NO: 15591 - DNA, 108 bp, Neocallimastix californiae
  CBM_10
atgctggtcagaaaaacttggctacaaatgttgtaaatattgtaatgttgaatatgaagatgaagaaggaaaatggggtctagaaaatgatgaatggtgtggtataaa

SEQ ID NO: 15592 - DNA, 105 bp, Neocallimastix californiae
  CBM_10
ttggtctaaaaaatttaatattccatgttgtaaatcaactgatgctgttgtaagatcaacttatgatggtgaatggggtttagaaaatggtgaatggtgtggtct

SEQ ID NO: 15593 - DNA, 108 bp, Neocallimastix californiae
  CBM_10
ctggtctgaagttttaggttatccatgttgtaccagttcctgtcatgtctacagtactgacagtgatggtcaatggggttatgaagacgaccattggtgtggtattgc

SEQ ID NO: 15594 - DNA, 108 bp, Neocallimastix californiae
  CBM_10
atgctggtcaaagaaatttggctatggctgttgtgaaggatgccgtgcctatgaagaagatgctgatggtaaatggggttatgaaaacaatgaatggtgtggtattgt

SEQ ID NO: 15595 - DNA, 108 bp, Neocallimastix californiae
  CBM_10
ttggtctaaggcattaggctataattgttgtactaccacttccgtcgtccagtacgaagatcaagatggtccttggggtattgaaaataatgattggtgtggtatcat

SEQ ID NO: 15596 - DNA, 105 bp, Neocallimastix californiae
  CBM_10
ttggtcttcccgattaggttacccatgctgtacttccaccaatagtatctacttttcggacggtgatggagattggggtatcgaaaataatcagtggtgtggcct

SEQ ID NO: 15597 - DNA, 108 bp, Neocallimastix californiae
  CBM_10
ttgcttttcagaaaaacttggttacaagtgttgtgaaggaagtgatgttgaattaattgatgaagatggtatgtggggtattgaaaatggtcaatggtgtggtatttc

SEQ ID NO: 15598 - DNA, 117 bp, Neocallimastix californiae
  CBM_10
atgttggtctatagaagaaggatatccatgttgccaaaagaaaacaaccaaagttaaacatgtttctaaaaatggaaatgaatggggtgttgaaaacaataattggtgtggtattac

SEQ ID NO: 15599 - DNA, 99 bp, Neocallimastix californiae
  CBM_10
tccaaagtatggaaagtacaattgttgtcaaggttgtaaggtaaaatatgttgattctgaaaaatggggttatgaaaatggtgaatggtgttccattcc

SEQ ID NO: 15600 - DNA, 111 bp, Neocallimastix californiae
  CBM_10
atgttgggcagaagcccttggttacaaatgttgtactaatactaaatccgtaaatttcacggatgaaaatggaagttggggttttgaaaacaatgttagatgtggtataat

SEQ ID NO: 15601 - DNA, 108 bp, Neocallimastix californiae
  CBM_10
gtgttggtctcgttccattggttttgtttgttgtgataaatgtaatgttctttacgttgatgaacaaggtcaatggggtgttgaagatggctactggtgtggtatcaa

SEQ ID NO: 15602 - DNA, 96 bp, Neocallimastix californiae
  CBM_10
gaataaaaagaatactttaccatgttgtactacctgtgatatttatttaattgatgctactggtagatatggttatgaaaatggtgaatggtgtaa

SEQ ID NO: 15603 - DNA, 111 bp, Neocallimastix californiae
  CBM_10
atgctttgctactaaattaggatattcttgctgtactactactaaaaatgtaatttctgtaaattcctatggtaagtggggtatagaaaatggaaaattatgtggtattga

SEQ ID NO: 15604 - DNA, 105 bp, Neocallimastix californiae
  CBM_10
ttgggctgttaaatatggttattcctgctgtaaggaaactactgttattgaagaagttgatgaaaatggcagatggggttttgaaaatggtggaagatgtggttt

SEQ ID NO: 15605 - DNA, 114 bp, Neocallimastix californiae
  CBM_10
atgctggtctgaaagttatggttacaaatgttgtactgatccagatgctaaaatagaatatgatggtgatggtaatttatggggtgttgaaaatggtgaatggtgtggtattaa

SEQ ID NO: 15606 - DNA, 108 bp, Neocallimastix californiae
  CBM_10
ttggtcagaacgtttaggttacccatgctgtgtcggatatactgatactatatttgctgatgctgatggtgaatggggcttacaaaatgatgattggtgtggtattac

SEQ ID NO: 15607 - DNA, 123 bp, Neocallimastix californiae
  CBM_10
ttggtctgaaagtttaagtgaggacaaaagattcccatgttgtagcagtaatgatgtagaagttgctggaaaagaaatggatggatcatggggttatgaaaatggtaaaaaatgtggtattag

SEQ ID NO: 15608 - DNA, 105 bp, Neocallimastix californiae
  CBM_10
cgctaataactatggttacccaggttgtaaaaatgctactaaaattagatattctggtgtcgaaggttcttggggttatgaaaatggatcctggtgtggtattga

SEQ ID NO: 15609 - DNA, 108 bp, Neocallimastix californiae
  CBM_10
gtgttggtctgaaccagaatatagatgttgtaatccagaaactcaagtcttttattctgatgatcaaggaaagtggggtattgaaaatggtgaatggtgtggtattat

SEQ ID NO: 15610 - DNA, 108 bp, Neocallimastix californiae
  CBM_10
atgttttactttggatttaggttatccatgttgtaagaaaaacaaagatttagtacttgaagatgaagatggtaaatggggtaatgaagatggtgaatggtgtggtct

SEQ ID NO: 15611 - DNA, 114 bp, Neocallimastix californiae
  CBM_10
ttcaccaaaaattctcgcacaaggatatagttgttgtccaaaaggatgtagagtttacgaaactgatgaagatggtgattggggttatgtagacaatgaatggtgtggttgtaa

SEQ ID NO: 15612 - DNA, 90 bp, Neocallimastix californiae
  CBM_10
aggttatccatgttgtaaaggagattctgaaatctacttagtagatgaagatggtaactggggttacgaagatgatgaatggtgtttact

SEQ ID NO: 15613 - DNA, 108 bp, Neocallimastix californiae
  CBM_10
ttgttgggcaagtttctatggttatgactgttgtaatggttgtaaagttaaatctgttgatagtttgggatcttggggtttcgaaggtggtaaatggtgtggtattga

SEQ ID NO: 15614 - DNA, 108 bp, Neocallimastix californiae
  CBM_10
atgttggtctaaatctttaggttactcttgctgtaagacttgtaatgtttacactgtagataaatctggttcctggggttacgaagatggtaaatggtgtggtattga

SEQ ID NO: 15615 - DNA, 108 bp, Neocallimastix californiae
  CBM_10
atgttggtctagtttctatggttattcttgctgtaagggatgtaaagtcagatatgtagatgatttaggttcatggggttatgaaggtggaaaatggtgtggtattga

SEQ ID NO: 15616 - DNA, 108 bp, Neocallimastix californiae
  CBM_10
ttgttggtcagaaacaaaaggatataaatgctgtaaaagttgtgatgtagtaacagttgatagattcggttcttggggtgttgaaaatggtgaatggtgtggtattga

SEQ ID NO: 15617 - DNA, 105 bp, Neocallimastix californiae
  CBM_10
ttggtcagaatctaaaggttatccatgttgtaaatattgtgatgttgtttctgttgatagatatggttcatggggtattgaaaacggtaaatggtgtggtgtaaa

SEQ ID NO: 15618 - DNA, 108 bp, Neocallimastix californiae
  CBM_10
atgttggtctagtggttacggttatccatgctgtaataattgtaaggtttacttcgttgatgacaatggagaatggggtattgaaaacggtaactggtgtggtattgt

SEQ ID NO: 15619 - DNA, 111 bp, Neocallimastix californiae
  CBM_10
atgttttgccacaaaattaggatatccttgttgtagtgttggttatccaactgttttaaaagatgaaagtggtagttggagtgttgaaaatggggaatggtgtggtgtttc

SEQ ID NO: 15620 - DNA, 111 bp, Neocallimastix californiae
  CBM_10
atgctggtcctcatcgttaggttatccatgttgtacttcaactaaggatgctattttagttgatgataacggtaaatggggttctgaaaatggaaattggtgtggtattgt

SEQ ID NO: 15621 - DNA, 114 bp, Neocallimastix californiae
  CBM_10
atgttggtctaaaaagtatggttatgaatgttgttcttcggaaaacacaagagttgtagttactgatgaaactggaaaatggggtgttgaaaatggtcaatggtgtggtgttct

SEQ ID NO: 15622 - DNA, 108 bp, Neocallimastix californiae
  CBM_10
ttgctggtcacttccatttggttataaatgctgtacacattgtaaggtacttacaaaagatgaaaatggtaaatggggtgaagaaaaaggagaatggtgtggtattat

SEQ ID NO: 15623 - DNA, 111 bp, Neocallimastix californiae
  CBM_10
atgttggtcacttaagctgaattacccttgttgtgaccgtaataataccatttctttttataggaatgattatggtgcatggggtaatgtagataataaatggtgtgggtt

SEQ ID NO: 15624 - DNA, 108 bp, Neocallimastix californiae
  CBM_10
atgtttctcagaaagacttggttatagatgttgttatggaaataaagttgttttaaccgatgctgatggtaaatggggtgttgaaaacaatcaatggtgtggtatttc

SEQ ID NO: 15625 - DNA, 111 bp, Neocallimastix californiae
  CBM_10
atgttgggctaatgcattaggttatccttgttgtaagacagcctatgccatctattacacagataatgatggtaattggagtattgaaaataatgaatggtgtggtattga

SEQ ID NO: 15626 - DNA, 108 bp, Neocallimastix californiae
  CBM_10
tacttttgaatcaattggatataattgctgttcatctacaactgatgttatataccaagatgaaaatggtgattggggtgtagaaaataacgactggtgcggtatcat

SEQ ID NO: 15627 - DNA, 105 bp, Neocallimastix californiae
  CBM_10
cttttctgagaaattaggatatccctgttgtataggttgtaatgtgatttacacagatgacgatggggattggggtattgaacagggatcatggtgtggtattaa

SEQ ID NO: 15628 - DNA, 105 bp, Neocallimastix californiae
  CBM_10
ttggtctgatgctttaggatacccatgttgtcatggttgtactgtttatgaaacagatgctgatggttcttggggttatgaaagtaatcaatggtgtggtattca

SEQ ID NO: 15629 - DNA, 120 bp, Neocallimastix californiae
  CBM_10
ttgttgggctgaaagtcttggttatccatgttgtactggtaaaaatccaattgtctatgaacatgacagtaatggtgattggggatacaattggaaaaccaatgaatggtgtggtatttc

SEQ ID NO: 15630 - DNA, 114 bp, Neocallimastix californiae
  CBM_10
ttgctggagtactggcttaggctatccatgttgtagtttaaccaacaccgatgtatactacatcgatgaaagtggtaattggggtatagaaaatgatgattggtgtggtatttc

SEQ ID NO: 15631 - DNA, 111 bp, Neocallimastix californiae
  CBM_10
atgtttctctaccaaattaggttatccatgttgtcaacaaacaaaagatgtcgtttatgaagataatgatggtcaatggggtgttgaaaacaatgattggtgtggtattac

SEQ ID NO: 15632 - DNA, 99 bp, Neocallimastix californiae
  CBM_10
aaccgaatataattgttgtgtcttctcaactacggaaaatgttcaaaccaccgaagaaggtaaatggggagtagaatttaataaatggtgtcttatcga

SEQ ID NO: 15633 - DNA, 93 bp, Neocallimastix californiae
  CBM_10
caatgataaatataagtgttgtagtcactgtaacgtatcctacacagattcaacaaaatggggaattgaaaataaccattggtgtcatattcc

SEQ ID NO: 15634 - DNA, 96 bp, Neocallimastix californiae
  CBM_10
ggctactgattatccaaattgtaattcatgtgatgtttattatacagatgccactggtaagtggggtgttgagaacagaaattggtgtattattca

SEQ ID NO: 15635 - DNA, 96 bp, Neocallimastix californiae
  CBM_10
tcacccacaatatgaatgttgtagcggttgtgatgtattttattctgataatgaagccttatggggtgttgaaaatggtaattggtgtgtaattca

SEQ ID NO: 15636 - DNA, 84 bp, Neocallimastix californiae
  CBM_10
ctatgaagattgtgaaggttgttatgttgtaactgaagaagatggtatcaaatggggtgttgagaacaatgattggtgtaaaat

SEQ ID NO: 15637 - DNA, 105 bp, Neocallimastix californiae
  CBM_10
ttgtttctctttcccaacttatatgtgttgtgaaggttgtgatgtttacgatcaaactgaagaaggaatgtggggtattgaaaatgacaactggtgtggtattaa

SEQ ID NO: 15638 - DNA, 105 bp, Neocallimastix californiae
  CBM_10
atgtttttcttacccaagttataaatgttgtcaaggttgtaacgtcattgaagaagatgcttccggaaaatggggtattgaaaacaatgaatggtgtggtattaa

SEQ ID NO: 15639 - DNA, 111 bp, Neocallimastix californiae
  CBM_10
ttgctgggctactaaattaggttactcttgctgtaagagtactaaggaagttgtctacactgatgccgatggtcgttggggtgttgaaaacaacaactggtgtggtattat

SEQ ID NO: 15640 - DNA, 111 bp, Neocallimastix californiae
  CBM_10
ttgggctactaagcttggttacaagtgttgtaccgctaagtgtccagttgaagaatacgtcgataatgatggtagctggggtattgaaaacaataattggtgtggtattac

SEQ ID NO: 15641 - DNA, 117 bp, Neocallimastix californiae
  CBM_10
gtgttggtccgaaaatttaggttataaatgttgtaccaagaaatgtgatgcaatatttgttcttaccgatgaattaggaaattggggaatggaaaataaagaatggtgtggtattcc

SEQ ID NO: 15642 - DNA, 108 bp, Neocallimastix californiae
  CBM_10
atgctctgcatcaaaattcggttatccatgttgtaaaggttgtactgtttatgaaaaagatgaagttggcgaatggggttatgaaaatgatgaatggtgtagtataaa

SEQ ID NO: 15643 - DNA, 108 bp, Neocallimastix californiae
  CBM_10
ttgggctgctaaattaggtttcaactgttgtaagactactaagactgttgtctatgaagatgctgatggtaattggggtgttgaagatgattactggtgtggtattat

SEQ ID NO: 15644 - DNA, 111 bp, Neocallimastix californiae
  CBM_10
atgctggtctaccaagttaggttatccatgttgtgaagatgctaacgttatctatactgttgatgaaaatggaagttggggttatgaagatgatcactggtgtggtattgt

SEQ ID NO: 15645 - DNA, 105 bp, Neocallimastix californiae
  CBM_10
tgaatttagtacaattggttactcttgctgtccagataatgaagttatctttgaagatgatcacaaatggggtgtcaatagcaatggtcaatggtgtggtgtttc

SEQ ID NO: 15646 - DNA, 117 bp, Neocallimastix californiae
  CBM_10
ctgctgggctgaagaacttggatatgaatgttgttccagaaaagatacaaatattattttcattgatgaaaatggtttatggggtgcaacaaaagacaataaatggtgtggtattgt

SEQ ID NO: 15647 - DNA, 96 bp, Neocallimastix californiae
  CBM_10
aaaaggatataatagttgtacattgggaactaaagtttcatttactgatgtaaatggtatttggggtatagaaaatgataaatggtgtgctatact

SEQ ID NO: 15648 - DNA, 111 bp, Neocallimastix californiae
  CBM_10
gtgttggtctttatctgaaggatataaatgttgtagtgcaggtactactgtcgcattagttgatagtaaaggtaagtggggtattgaaaacggagattggtgtggtattat

SEQ ID NO: 15649 - DNA, 108 bp, Neocallimastix californiae
  CBM_10
ttgttgggcttccagtgaaggttacagttgttgtaaaggatgtgaatctattttcactgatggtgtaagaagatggggtgttgaaaatgatcaatggtgtggtattat

SEQ ID NO: 15650 - DNA, 102 bp, Neocallimastix californiae
  CBM_10
tgcttcaaaggatggttattcatgctgtaagagttgtacaattgtattggatgatgaatctggtaaatggggtgttgaaaatggtgattggtgtggtattga

SEQ ID NO: 15651 - DNA, 108 bp, Neocallimastix californiae
  CBM_10
ttggtcaaatgccttaggttatccatgttgtaagacgacgaccactgttatctctactgatagtgatggtcaatggggtgttgaaaataatgaatggtgtggtattcc

SEQ ID NO: 15652 - DNA, 108 bp, Neocallimastix californiae
  CBM_10
ttgggcaacaaaattagattatccatgctgttcctattctactcaagtttttgaaacggatgaaaatggtcaatggagtatagaaaatggagaatggtgtggtattgt

SEQ ID NO: 15653 - DNA, 108 bp, Neocallimastix californiae
  CBM_10
tttttctgagaaattggggtacccatgttgtaaaaaaacaaaagatattgtttactcagatgaagatggtccatggggtgtagaagataatagttggtgtggtattca

SEQ ID NO: 15654 - DNA, 96 bp, Neocallimastix californiae
  CBM_10
cgatggttatccatgctgttctcaagaatgtacctcctacttcagagatgaaagtggtgactggagtgttgaaaatggcgactggtgtttaattga

SEQ ID NO: 15655 - DNA, 108 bp, Neocallimastix californiae
  CBM_10
ctgctggtctgaagccttaggctatccatgttgtcaaggtgaagtagaatatgtagaaagtaatgaaaatggtgattggggtttagaaaacaatgaatggtgtggtct

SEQ ID NO: 15656 - DNA, 111 bp, Neocallimastix californiae
  CBM_10
ttgttggtctgaagccttaggctatccatgttgtcaaggtgaagtagaattagttgaaagtaatgaagatggtgattggggtttagaaaacaatgaatggtgtggtattcc

SEQ ID NO: 15657 - DNA, 111 bp, Neocallimastix californiae
  CBM_10
ctgttggtctgaagcctacggttttccatgttgtcaaggtgaaattggatatatagaaagtgatgaatatggtgattggagtgtagaaaacaataaatggtgtggtgtacc

SEQ ID NO: 15658 - DNA, 108 bp, Neocallimastix californiae
  CBM_10
atgtccaaatcaaaagaacggatacccatgctgtcaaacctgtgatgtatacttaactgatgctgacggtaaatggggtgttgaaaatggaaattggtgtagtattaa

SEQ ID NO: 15659 - DNA, 117 bp, Neocallimastix californiae
  CBM_10
atgctggtcatcaaaattaggttacaaatgttgttctagaggttgtaatactgctgttgttgttactgataatgatggtgcttggggtgttgaaaacggtgaatggtgtggtgttca

SEQ ID NO: 15660 - DNA, 105 bp, Neocallimastix californiae
  CBM_10
ctgctggtctgaaccagattatccatgctgtaagaatacctgtagagttgtctataccgatagttctgaatggggtgttgaaaatggtaactggtgtggtattcc

SEQ ID NO: 15661 - DNA, 108 bp, Neocallimastix californiae
  CBM_10
atgtccagactatccagactatccatgttgtagtacttgtgacgtttatttaactgaagataatggtagtcgctggggtgttgaaaataacgactggtgtagtatcaa

SEQ ID NO: 15662 - DNA, 108 bp, Neocallimastix californiae
  CBM_10
ttggtctgaaaaacttggatatccatgctgtcaaaatacctcttctgttgcttacactgattctgatggtaaatggggtgttgaaaatggtaattggtgtggaataaa

SEQ ID NO: 15663 - DNA, 73 bp, Neocallimastix californiae
  CBM_10
ttggtctgaaaaacttggatatccatgctgtcaaaatacctcttctgttgtttacacagataatgatggtaat

SEQ ID NO: 15664 - DNA, 105 bp, Neocallimastix californiae
  CBM_10
atgtggtgctgctgctctcggttatccatgttgtcaatcaacttgtactgaagtttatactgatgaatacagatggggtgttgaaaatggtgactggtgtggact

SEQ ID NO: 15665 - DNA, 102 bp, Neocallimastix californiae
  CBM_10
ttgctggtctgaaccagattacaagtgttgtactacctgtgatattgtttatactgatgatcataactggggtgttgaaaatggcgaatggtgtggtattga

SEQ ID NO: 15666 - DNA, 108 bp, Neocallimastix californiae
  CBM_10
atgttggtcagaaatattaggatatccatgttgtaaaggatgtaaaatctatgaaactgactcagatggatcttggggatatgaatttaatcaatggtgtggtattat

SEQ ID NO: 15667 - DNA, 114 bp, Neocallimastix californiae
  CBM_10
tttatcagaattcttgggatatccatgctgttcatctgaacttacgaccgtctatgctgaggatgagtatggtgaatggagttatgatttcaccaagaatgaatggtgtggttt

SEQ ID NO: 15668 - DNA, 105 bp, Neocallimastix californiae
  CBM_10
tttctctattgctttaggtttcccatgttgtaagggtaatacagtaatttatactgatgatgatggtgattggggtgttgaaaatgaagaatggtgtggtattag

SEQ ID NO: 15669 - DNA, 108 bp, Neocallimastix californiae
  CBM_10
atgctttgctaaagctttaggttatgaatgttgtagtacttgtgatgttgtttatacagatgatgatggtgattggggtgttgataatggtgaatggtgtggtattaa

SEQ ID NO: 15670 - DNA, 117 bp, Neocallimastix californiae
  CBM_10
gtgttggtcattaaaattagatgaaccatatccatgttgtgtttatgctaccgaaatcatatacactaatgaaaatggtaaatggagtatggaaaatggtgactggtgtggtataat

SEQ ID NO: 15671 - DNA, 108 bp, Neocallimastix californiae
  CBM_10
atgttggtcgaatttcttaggttatccatgttgtaagaaaactgacgatattatttataatgcagttaaaggatcatggggttatgaaaataattcatggtgtggttt

SEQ ID NO: 15672 - DNA, 114 bp, Neocallimastix californiae
  CBM_10
atgttgggcctacgccagaaattacaaatgttgtagtaatccaaatactaaagtagaaactgaagataaatatggaaaatggggtattgaaaataatgaatggtgtggtattga

SEQ ID NO: 15673 - DNA, 99 bp, Neocallimastix californiae
  CBM_10
taaaggtctaagtgaaggttatccatgttgttcaagtcttagtatgaagacttcaggatatgatgatcaatggggctatgaagataatgattggtgtcg

SEQ ID NO: 15674 - DNA, 117 bp, Neocallimastix californiae
  CBM_10
ctgttgggctgaagaattagatgatggctacccatgttgtaaaactactaatgtagttatagaaactgatggcaatggggaatggggtattgaaaatgatcaatggtgtggtattag

SEQ ID NO: 15675 - DNA, 114 bp, Neocallimastix californiae
  CBM_10
gtgttggtcattaagccaaggatatccatgttgttcaattcaaccatatcatatagaattaagtgatgaatctggtgattggggtatagaaaatggagattggtgtggtattcc

SEQ ID NO: 15676 - DNA, 111 bp, Neocallimastix californiae
  CBM_10
ctgggcaaccaagaaaggttttccatgttgttcaaacaaagatacttcaattgttagtgttgattcggaaggacaatggggaatggaaaacggtcaatggtgtggaattga

SEQ ID NO: 15677 - DNA, 114 bp, Neocallimastix californiae
  CBM_10
atgttggtctgtcagtaaaggttatccatgttgtgtaggagataatccttccatagaatttgttgattctgatggtcaatggggtttggaaaatggaaattggtgtggtattgc

SEQ ID NO: 15678 - DNA, 117 bp, Neocallimastix californiae
  CBM_10
atgttggtctaaaagtcaaggttattcctgttgtaaggatgccaccactaccgttcgtacgacggatagtaaaggttatttatggggtattgaaaataatgaatggtgtggtattac

SEQ ID NO: 15679 - DNA, 96 bp, Neocallimastix californiae
  CBM_10
tactggttattcctgctgtatgtttaatactaccgccatagccactaaggatagtgatggttattggggtgttgaaaatggtcaatggtgtctctt

SEQ ID NO: 15680 - DNA, 108 bp, Neocallimastix californiae
  CBM_10
atgtccagccgctaaaaatggatataaatgttgtaatgcctgtaaggtcaagaccacagataaaaatggtgactggggtgttgaaaatggagaatggtgttccattcc

SEQ ID NO: 15681 - DNA, 105 bp, Neocallimastix californiae
  CBM_10
cagtagttctggttatatatgctgtagaaccactgactgtgaagttgtttccagcgatgaagctggtgattggtgtatggaaggaaatttatggtgtttaatttc

SEQ ID NO: 15682 - DNA, 114 bp, Neocallimastix californiae
  CBM_10
atgctggtctttagctgaaggttacccatgttgtcaacacgctactaaagttgaaaacattgatgaacaaggtagaaaatggtctgttgaaaatgatgattggtgtggtattat

SEQ ID NO: 15683 - DNA, 114 bp, Neocallimastix californiae
  CBM_10
ttctggtgctatcttaagtcaaggttacaaatgttgtagtagtggatgttctgtagtttacactgatggtgatggtacttggggatttgaaaatgatcaatggtgtggatgtaa

SEQ ID NO: 15684 - DNA, 102 bp, Neocallimastix californiae
  CBM_10
ttcccaaggttataaatgttgtagtagtaataactgtgatgtttatcttaccgatgaatctggtaaatggggtgttgaaaacaatgactggtgtggtatttc

SEQ ID NO: 15685 - DNA, 117 bp, Neocallimastix californiae
  CBM_10
ttgttctgctgctatcttaagtcaaggttacaaatgttgtagtggtggatgttctgtagtttacactgacggcgatggtacttggggagttgagaatggtcaatggtgtggatgtgc

SEQ ID NO: 15686 - DNA, 117 bp, Neocallimastix californiae
  CBM_10
tccagctactattacttcccaaggttataaatgttgtagcagtaataactgtgatgtctatcttaccgatgaatctggaagatggggtgttgaaaacaatgattggtgtggtatttc

SEQ ID NO: 15687 - DNA, 111 bp, Neocallimastix californiae
  CBM_10
tttcagtgaagataaaaatcttggctatccctgctgtcaaaattgttacgttattgaaagtgatgaaaatggtgattatggtatagaaaacggtgaatggtgtagtattcc

SEQ ID NO: 15688 - DNA, 93 bp, Neocallimastix californiae
  CBM_10
aaatggctatccttactgtaaaaataccaaaatcgttgtatacactgacgatgttgaatggggtgtagaaaataatgaatggtgtgtcattaa

SEQ ID NO: 15689 - DNA, 108 bp, Neocallimastix californiae
  CBM_10
atgttggtcagaaaagctaggttatccatgctgtgttggtaacactgtttatactactgatgaaagtggttcatggggtttagaaaatgatgattggtgtggtattaa

SEQ ID NO: 15690 - DNA, 108 bp, Neocallimastix californiae
  CBM_10
atgtttctctcttgtattaggtttcccatgttgttcttcatgtgattcaatttatgaagatgatgatggaaaatggggtgttgaaaataacaattggtgtggtattaa

SEQ ID NO: 15691 - DNA, 108 bp, Neocallimastix californiae
  CBM_10
atgctggtcagaggagcaaggttatcaatgttgttcaggatgtgatattgtttatgaagacaatactggtttctggggagttgaaaataatgaatggtgtggaattaa

SEQ ID NO: 15692 - DNA, 96 bp, Neocallimastix californiae
  CBM_10
tcatccaaattacgattgttgtaatggttgtgatgtttattacaccgatgacgaaggtgagtggggtattcaaaacaataattggtgcttcattaa

SEQ ID NO: 15693 - DNA, 105 bp, Neocallimastix californiae
  CBM_10
taaatttgaagcgattggttatccatgttgtagtcactgtaacattgtttacactgatgatagtggcaactggggtattgaaaatgatgattggtgtggtataag

SEQ ID NO: 15694 - DNA, 111 bp, Neocallimastix californiae
  CBM_10
atgctgggctaaagctttaggttatgaatgttgttcatcttgccaaccatctgccttcaaagatgaaagtggtgaatggggtatagaaaataaccagtggtgtggtattat

SEQ ID NO: 15695 - DNA, 90 bp, Neocallimastix californiae
  CBM_10
tcttggttatgagtgttgtaaaactactactactgttatctatacggatgaatctggtaaatggggtattgaaaataacgaatggtgtga

SEQ ID NO: 15696 - DNA, 84 bp, Neocallimastix californiae
  CBM_10
atatagtaattgtaaaaacacttgtgaaattgcctatgaagatgaaaataaatggggtattgaaaatgaagattggtgtattct

SEQ ID NO: 15697 - DNA, 108 bp, Neocallimastix californiae
  CBM_10
ttgttggtctcttgctaatggttatgattgttgtgaaggttgtgaagttgcttacactgacgctgatggcaaatggggttatgaaaatgatgaatggtgtggtattaa

SEQ ID NO: 15698 - DNA, 108 bp, Neocallimastix californiae
  CBM_10
atgttgggcttcatcattaggttattcatgttgtaaaggatgtgatataataattactgattccaatggcgattggggtgttgaagataatgaatggtgtggtatttt

SEQ ID NO: 15699 - DNA, 108 bp, Neocallimastix californiae
  CBM_10
atgtaagggtgcccaaggttatccatgctgtgcctactcatgtactgcctatgaaaaggatagagatggtgaatggagtgttgaaaacaatgattggtgtttaattaa

SEQ ID NO: 15700 - DNA, 111 bp, Neocallimastix californiae
  CBM_10
ctgtttctcaaaggctttaggttataactgttgtaagtcatgtagtggtgtttactacgttgataaggatggtgaatggggtattgaaaatggtcaatggtgtggtatggc

SEQ ID NO: 15701 - DNA, 105 bp, Neocallimastix californiae
  CBM_10
tccaggagaaggaactgaatataaatgttgttccagctgtttagatgtctatgaagaagatgagaatggaccatgggcaattgaggatgaacaatggtgttcact

SEQ ID NO: 15702 - DNA, 114 bp, Neocallimastix californiae
  CBM_10
tttctctgaaaagatagaaccctactatccatgctgtaagaccaccactgagattgtgtcaaccgataactccggagattggggtatagaaaatgatgagtggtgtggtattgg

SEQ ID NO: 15703 - DNA, 87 bp, Neocallimastix californiae
  CBM_10
cggatatccatgctgtagcaactgtgaacttacctaccaagatgaaacaggaaagtggggagtagaaggagaggaatggtgtggact

SEQ ID NO: 15704 - DNA, 114 bp, Neocallimastix californiae
  CBM_10
atgttggtcattaaaatatggttatctttgctgtaattctgattctacttcagttgttaaaaccaataaatatggtaattggggtaaggaaaatggtaaatggtgtggtattaa

SEQ ID NO: 15705 - DNA, 114 bp, Neocallimastix californiae
  CBM_10
atgtccattcaaagctataggctatggatgttgtaaaaattctaagactgaaattgtttttactgatagttttggtaactatggtgttgaaaagggtaagcgttgtggtattat

SEQ ID NO: 15706 - DNA, 117 bp, Neocallimastix californiae
  CBM_10
ttggtcgcttagccttggctacaaatgctgtactctcagaactacagagccgaactattattctaaatcagcaggtaaatggtacggtattgaaaatgatgaatggtgtggtatcac

SEQ ID NO: 15707 - DNA, 93 bp, Neocallimastix californiae
  CBM_10
taccggttatcactgttgtctttacaccactgaggtggaaaccacagatgccgtgggtcagtggggtattgaagccggagaatggtgtctctt

SEQ ID NO: 15708 - DNA, 87 bp, Neocallimastix californiae
  CBM_10
ggaatacaggtgttgtaaggaatgtaatgtcatcttcaccgactctgaagattggggtatagaagatggtgactggtgttctattcc

SEQ ID NO: 15709 - DNA, 111 bp, Neocallimastix californiae
  CBM_10
atgtttctcagaaaaattaggttttccatgttgtgttgaaactaaagaagttgttaatgttgatgaaaatggacaatggggtattgaaaataacaattggtgtggtattga

SEQ ID NO: 15710 - DNA, 114 bp, Neocallimastix californiae
  CBM_10
ttgctggtcattacctttaggttacaattgttgttcctctgacaacactgaagtatactatactgatgatgatggtcaatggggtgttgaaaatggtgactggtgtggtatcat

SEQ ID NO: 15711 - DNA, 114 bp, Neocallimastix californiae
  CBM_10
atgttggtccgaacctttaggttatgaatgttgtgatccaaaggataatacttactattatgaggatgatgatggttactggggattagttgatggtgaatggtgtggtatcat

SEQ ID NO: 15712 - DNA, 111 bp, Neocallimastix californiae
  CBM_10
atgttggtcattaaaattaggatatccctgttgtaaagaatccattgaagtttatactaccgacgaaaatggttcatggggtgttgaaaatgaacaatggtgtggaatatc

SEQ ID NO: 15713 - DNA, 111 bp, Neocallimastix californiae
  CBM_10
ttgtttttcaaaaccagattatccatgttgttcaaggtgtgatataaaagtaattcttgatgatggtgataataaacaatggggtattgaaaattcaaattggtgtggtct

SEQ ID NO: 15714 - DNA, 111 bp, Neocallimastix californiae
  CBM_10
atgttttgctaataaattaggatatccatgttgtacacaaactaatgaaatcgtttctattgatgaaaacggtaaatggggtttagaaaatggtcaaatttgtggtattga

SEQ ID NO: 15715 - DNA, 111 bp, Neocallimastix californiae
  CBM_10
ttggtctactgctttaggttatccatgttgttcttctgctaatgctgaagtttatttcactgatgaaagtggtgattggggtattgaaaataatacatggtgtggtattcc

SEQ ID NO: 15716 - DNA, 114 bp, Neocallimastix californiae
  CBM_10
ttgggctaaagaattaggatatgaatgttgtagtactaattcttgtagaaatgctatttataccgatgatgacggtgaatgggatgtcgaaaatggcaactggtgtggtataac

SEQ ID NO: 15717 - DNA, 99 bp, Neocallimastix californiae
  CBM_10
aggttataaatgttgtgaaatcaacaattgtaatatttaccataaggatggtgatggtgattggggtcttgacagaaacttaaaatggtgtggtatccg

SEQ ID NO: 15718 - DNA, 96 bp, Neocallimastix californiae
  CBM_10
tcaaatgggttataaatgttgtaattcatgtaatgctgtttataccgattccaccggtagatggggagtcgaaaacagacaatggtgtggtattcg

SEQ ID NO: 15719 - DNA, 87 bp, Neocallimastix californiae
  CBM_10
agaatatccatgctgtaaggaatgtaacatttattatacggatagtgaagattggggtattgaagatggaaaatggtgttccattcc

SEQ ID NO: 15720 - DNA, 117 bp, Neocallimastix californiae
  CBM_10
ttggtcctctccatttggttatgattgttgtaaattgaaaaagacacaaccatattcctattctaattcagccggtcattggtatggtattgaaaatggagaatggtgtggtattac

SEQ ID NO: 15721 - DNA, 93 bp, Neocallimastix californiae
  CBM_10
taccggctttaactgttgtctcttcacaaccatagtggcgacgaccgattctgttggtcaatggggcgttgaaaacggagaatggtgtctctt

SEQ ID NO: 15722 - DNA, 114 bp, Neocallimastix californiae
  CBM_10
ttgggcaacttatcttgataaaaattatacttgttgttcaaatgataatattgaaattaaatccattaatatggatggagaatggggtcttgagaataataattggtgtggttt

SEQ ID NO: 15723 - DNA, 108 bp, Neocallimastix californiae
  CBM_10
ttggtcattaccagattatccatgttgtaataataataatattgctgtagtaataactgatgataagggtaattggggtattgaaaatggagaatggtgtggtattct

SEQ ID NO: 15724 - DNA, 105 bp, Neocallimastix californiae
  CBM_10
ttgggcagagaaatttggttttaaatgttgtaaagagaatcatattgataacgtatcagattcagatggtgattgggcacaagaaaatggagattggtgtggttt

SEQ ID NO: 15725 - DNA, 111 bp, Neocallimastix californiae
  CBM_10
ctgttggtctttacctgattatccatgttgtcgtaataaaaagacagatgtagtttatacagatgataatggtaattggggtattgaaaatgaaaattggtgtgggattat

SEQ ID NO: 15726 - DNA, 111 bp, Neocallimastix californiae
  CBM_10
atgttggtccttaccggattattcatgttgtaaagataagaatatagatgtaatctatacagataatatgggcaattggggtattgaaaatggagaatggtgtggtattat

SEQ ID NO: 15727 - DNA, 85 bp, Neocallimastix californiae
  CBM_10
atgttggtctacttctttaggatactcctgttgtaaaacttgtactgacatcatcctcgtggattcaaacggaaaatggggtgtt

SEQ ID NO: 15728 - DNA, 111 bp, Neocallimastix californiae
  CBM_10
atgttggtctgcttcattaggttatccttgttgtgaaaataccacaagtgtagctgttagtgatgctagtggtgattggggtgttgaacaagatcaatggtgtggtataat

SEQ ID NO: 15729 - DNA, 111 bp, Neocallimastix californiae
  CBM_10
ttgcttttctgaaaaattaggatacccttgttgtagtatcggctatgcaactgtcattactgataatgatggtttatggagtgttgaaaatgatgattggtgtggtgtaac

SEQ ID NO: 15730 - DNA, 111 bp, Neocallimastix californiae
  CBM_10
atgttggtctgaagctcaaggttatccctgctgtaaattcacttctgatgtcgttttcaccgacaatgacggaaactggggtgttgaaaatggaaattggtgtggtatcca

SEQ ID NO: 15731 - DNA, 111 bp, Neocallimastix californiae
  CBM_10
tttttcatcaagattaggtttcccttgctgttcctcttcttccgctgaagtttggtataccgattctgatggtaaatggggtgttgaaaatgatggatggtgtggtattcc

SEQ ID NO: 15732 - DNA, 105 bp, Neocallimastix californiae
  CBM_10
ttggtctgaaagtcttggatataaatgttgttcatcatgtggacaagtatacttcaccgatgaaaatggaagatggagtgttgaaaatgatgactggtgtggttt

SEQ ID NO: 15733 - DNA, 114 bp, Neocallimastix californiae
  CBM_10
ttgttggtcaaattctttaggatacaattgttgtagtgattcaaatactcaagtgtactatgaagatcaagatggtcaatggggtattgaaaataataattggtgtggtatttc

SEQ ID NO: 15734 - DNA, 102 bp, Neocallimastix californiae
  CBM_10
atttacttctcaaggctataagtgttgttcctattgtagtacagtttattatactgatgattcaggaaaatggggtattgaaaatggcaattggtgtggatt

SEQ ID NO: 15735 - DNA, 96 bp, Neocallimastix californiae
  CBM_10
gcaaggttacaaatgttgtccagctaactgtcaaattgtttatgctgataatgatggtacttggggtgttgacaataatcaatggtgtggatgtgg

SEQ ID NO: 15736 - DNA, 108 bp, Neocallimastix californiae
  CBM_10
atgtacaggtagaaatcagggctatcaatgctgtaattcatgtgatgtttactatacagataatgatggcagatggggtgttgaaaataatgcttggtgcggtatcaa

SEQ ID NO: 15737 - DNA, 105 bp, Neocallimastix californiae
  CBM_10
tttttctgttaatcttggttatccatgttgtaatggtaacactgtttattatactgatgatgatggaaaatggggttacgaaaatgataattggtgtggtattaa

SEQ ID NO: 15738 - DNA, 99 bp, Neocallimastix californiae
  CBM_10
cactcaacaaggttacaaatgctgttcatcttgtttaccagttatgtacactgatgaatctggtaagtggggtgttgaaaacaacaactggtgtggatt

SEQ ID NO: 15739 - DNA, 117 bp, Neocallimastix californiae
  CBM_10
tccagctgctattactaaccaaggttacaagtgttgtagtgctaagtgtaacccagttgtttacaaggatgaatctggtgactggggtgttgaaaacaaccaatggtgtggttgtcc

SEQ ID NO: 15740 - DNA, 117 bp, Neocallimastix californiae
  CBM_10
tccaactgctattactagccaaggttacaagtgttgtagaaacaagtgtaacccagttgtttaccaagatgaagctggtgactggggtgttgaaaacaaccaatggtgtggatgtcc

SEQ ID NO: 15741 - DNA, 117 bp, Neocallimastix californiae; identical to SEQ ID NO: 15740
  CBM_10

SEQ ID NO: 15742 - DNA, 102 bp, Neocallimastix californiae
  CBM_10
tactcaacaaggttacaagtgttgctcaacttgtactgctactgtttacgttgatgatgccggtaaatggggtgttgaaaacaatgactggtgtggtattcc

SEQ ID NO: 15743 - DNA, 117 bp, Neocallimastix californiae
  CBM_10
tccaactgctattactagccaaggttacaagtgttgtagtgctaagtgtaacccagttgtttaccaagatgaagctggtgactggggtgttgaaaacaaccaatggtgtggatgtcc

SEQ ID NO: 15744 - DNA, 102 bp, Neocallimastix californiae
  CBM_10
tactcaacaaggttacaagtgttgctcaacttgtactgaaactttctacgttgatgatgccggtaaatggggtattgaaaacaatgactggtgtggtattcc

SEQ ID NO: 15745 - DNA, 96 bp, Neocallimastix californiae
  CBM_10
aattagtaaatatccatgttgtgaatcttgtgatgttgttaccactgatcaaaatggtaaatggggtattgaaaatggccattggtgttctattaa

SEQ ID NO: 15746 - DNA, 105 bp, Neocallimastix californiae
  CBM_10
ttggtctgaagccttaggttacaattgttgttatggttgtatttcttactacgaagatgatgatggtaaatggggtgttgaaaacaatcaatggtgtggtattct

SEQ ID NO: 15747 - DNA, 111 bp, Neocallimastix californiae
  CBM_10
ttctagcactaactccaattcttattcttattgtaatggttgtagtgtaacatctactggttcagatggttctaaatggggttgggaaaataataagtcttgtagaataaa

SEQ ID NO: 15748 - DNA, 87 bp, Neocallimastix californiae
  CBM_10
tccttattgttatggctgtcaagttacttacactagcaatgatggaatttgttggggatgggaaaataataattcttgtgttattaa

SEQ ID NO: 15749 - DNA, 102 bp, Neocallimastix californiae
  CBM_10
cactaactccaattcttattcttattgtaatggttgtagtgtaacatctactggttcagatggttctaaatggggttgggaaaataataagtcttgtagaat

SEQ ID NO: 15750 - DNA, 123 bp, Neocallimastix californiae
  CBM_10
taacaataatggcaatggtagagccacatatggctatccttattgttatggctgtcaagttacttacactagcaatgatggaatttgttggggatgggaaaataataattcttgtgttattaa

SEQ ID NO: 15751 - DNA, 111 bp, Neocallimastix californiae
  CBM_10
atgttggtctaagaagtttggtattgaatgttgtaaacacactaaaaccgtagttaggaaaacttatgatggtccctggggtaaagaaaatggaaaatggtgtggtattgg

SEQ ID NO: 15752 - DNA, 120 bp, Neocallimastix californiae
  CBM_10
atgtgaagccaaagaatatggctatccttgctgtccagctgaattcaatactgtcaaatatcataatgaacttggtgactggggatttgatcttgaacatagtgaatggtgtagtattac

SEQ ID NO: 15753 - DNA, 111 bp, Neocallimastix californiae
  CBM_10
atgctggtcattaaaattaggatattcatgttgtaaagaatccactaaagtttatactacagatgaaagtggatcatggggtgttgaaaatggacaatggtgtggtatatc

SEQ ID NO: 15754 - DNA, 114 bp, Neocallimastix californiae
  CBM_10
ttgtttctctgaaccagattatccatgttgctccaaatgtgatatagaagtagctttcaacgaaggtgaacataaactttggggtatagaaaattcaaattggtgtggtattcc

SEQ ID NO: 15755 - DNA, 100 bp, Neocallimastix californiae
  CBM_10
ttggccaggtgaatatgaatgttgttcaccaggtactaaggttgaatacacggatgaagaagcattatggggtgttgaaaatggtaattggtgttacatt

SEQ ID NO: 15756 - DNA, 114 bp, Neocallimastix californiae
  CBM_10
atgttgggctgaagaatttggatatgaatgttgtcttttcagttcaatggtttcctacgttgacgataaaggacgttattgggatttccaaaatggaaattggtgtggcgtaac

SEQ ID NO: 15757 - DNA, 102 bp, Neocallimastix californiae
  CBM_10
ttggccaggtgaatatgaatgttgttcaccaggtactaaggttgaatacacggatgaagaagcattatggggtgttgaaaatggtaattggtgttacattac

SEQ ID NO: 15758 - DNA, 102 bp, Neocallimastix californiae; identical to SEQ ID NO: 15757
  CBM_10

SEQ ID NO: 15759 - DNA, 108 bp, Neocallimastix californiae
  CBM_10
atgttggccagataataaatttaaatgttgttcaccaggtactaaggttgaatacacagatgaagaagcattatggggtgttgaaaatggtaattggtgttacattac

SEQ ID NO: 15760 - DNA, 117 bp, Neocallimastix californiae
  CBM_10
atgtagatctgaagtgaaaggttatccttgttgtccaccagaaattacagaaatttatatggtcgatactgatggagactggggatttgatgaaaaaactaataattggtgtggttt

SEQ ID NO: 15761 - DNA, 129 bp, Neocallimastix californiae
  CBM_10
atgttggtcagagaaatatggttatccatgctgtaaagatccaaatactttattagtttcaccacaaagtaaatctaatccggatcatgaatggtatggtgttgaaaataatgaatggtgtggtattgc

SEQ ID NO: 15762 - DNA, 99 bp, Neocallimastix californiae
  CBM_10
ccaattcaatgatcaatacaagtgttgtcaacattgtaaggtggtctacactgattcacaaaaatggggtattgaagataatgaatggtgtcatattcc

SEQ ID NO: 15763 - DNA, 114 bp, Neocallimastix californiae
  CBM_10
atgctggtcattagaaagaggctatccatgctgtgtatcagccacagaagttctttatacctcctctaatggtaaaacttggagtgttgaaaatggtgactggtgtggtattat

SEQ ID NO: 15764 - DNA, 96 bp, Neocallimastix californiae
  CBM_10
tactggttatccttgctgtagtaatccagacgctcaggtatatactacggattcctctggtgattggagtattgaaggtgatttttggtgtttagt

SEQ ID NO: 15765 - DNA, 84 bp, Neocallimastix californiae
  CBM_10
aaaataccatgtctgtaaaaactgtagtgttgctgcttaccaaaatgatatctactggggttttgaaaataatcaatggtgtga

SEQ ID NO: 15766 - DNA, 105 bp, Neocallimastix californiae
  CBM_10
atgtcattcttatcctctttatccatgttgtgctgattgtaacgtcgttgctgaaaccgaggatggtgaatggggtgttgaaaatggtcaatggtgtggaataaa

SEQ ID NO: 15767 - DNA, 105 bp, Neocallimastix californiae
  CBM_10
ctggagtaaatccttgggctattcttgttgtacctcatgtgaaatttcttatgaagatactgatggaaaatggggttatgaaaatgatgactggtgtggtattgt

SEQ ID NO: 15768 - DNA, 111 bp, Neocallimastix californiae
  CBM_10
atgttgggctacctctttaggatattcttgttgttctgaaggtgctgatattattttagaagatgaaaatggaaaatggggtttagaaaacgacgactggtgtggcatcat

SEQ ID NO: 15769 - DNA, 93 bp, Neocallimastix californiae
  CBM_10
atatggatatcgctgctgttcaacttgtactatttcatacaccgatgatactggcaattggggtgttgaaaatgatgaatggtgtattgttga

SEQ ID NO: 15770 - DNA, 114 bp, Neocallimastix californiae
  CBM_10
ttgctggtctgaagcttatggttacccatgttgttcctctgccagtactaaggttatttacaccgatagcgatggtgaatggggtgttgaaaacggtaactggtgtggtatttc

SEQ ID NO: 15771 - DNA, 105 bp, Neocallimastix californiae
  CBM_10
tttctctgatactttaggttacccatgttgtactagtaccactaatgttatctacactgatagctacggtcgctggggtattgaaaacagtaattggtgtattct

SEQ ID NO: 15772 - DNA, 111 bp, Neocallimastix californiae
  CBM_10
ttgtttctctcttgctcttggttataattgttgtaagcatacaaccgaagttatttctgttgataatgatggttcatggggtattgaaaataatgaatggtgtggaatagg

SEQ ID NO: 15773 - DNA, 108 bp, Neocallimastix californiae
  CBM_10
tttttctgaagcattaggttatccttgttgtagtgatggagtagctgtcgtctacacagataatgatggaccatggggtgtagaaaacaatgattggtgtggtatctc

SEQ ID NO: 15774 - DNA, 102 bp, Neocallimastix californiae
  CBM_10
acaaaatactaattatccatattgtaaatatagtacagctgtatattatgttgatgaagatggtcaatggagtgttgaaaataatgaatggtgtttaattca

SEQ ID NO: 15775 - DNA, 114 bp, Neocallimastix californiae
  CBM_10
atgctggtcttctgctttgggttatccatgctgttctagtagtaatgtaccaattattgaaactgatggtgatggccaatggggtattgaaaatgatgaatggtgtggagtacc

SEQ ID NO: 15776 - DNA, 108 bp, Neocallimastix californiae
  CBM_10
atgttgggctgaagcttatggatatccatgttgtagtaaatgtttacctgttattgatacaacaaatgataaagaatgggcattagaaaatggaaattggtgtggtct

SEQ ID NO: 15777 - DNA, 90 bp, Neocallimastix californiae
  CBM_10
atcaatgtataaatgttgcaaatcatgtaatattgttcttgatgatggagataaatggggtgtagaaaatggtgaatggtgtagtataac

SEQ ID NO: 15778 - DNA, 114 bp, Neocallimastix californiae
  CBM_10
tctatcagaattttatggctatccatgttgttccccggaattaaccgaggtttacgctcaagatgactatggtgactggggttatgacttttcaaagagtgaatggtgtggtct

SEQ ID NO: 15779 - DNA, 117 bp, Neocallimastix californiae
  CBM_10
ttggtctgaagcattaggatatccatgctgtccatcaggaataacgacagtttatgagcatgatgaagatggagactggagttataatttttctaaagaagaatggtgtggaataat

SEQ ID NO: 15780 - DNA, 90 bp, Neocallimastix californiae
  CBM_10
tggttacccatgttgtaaatcttgtgacgtcgttgatactgatgatgatggtcaatggggtgttgaaaataatgattggtgtagtattga

SEQ ID NO: 15781 - DNA, 90 bp, Neocallimastix californiae
  CBM_10
tatttatccatgttgtaagacatgtacttctgtttacgaagatgatgatggtaaatggggtgttgaaaatgatgactggtgtttaattaa

SEQ ID NO: 15782 - DNA, 108 bp, Neocallimastix californiae
  CBM_10
ctggagtaaatctttaggttatgactgttgtaaggaaggcacatctgttgcatatactgatgatagtggtaaatggggtgtcgttggagatcaatggtgtggtattat

SEQ ID NO: 15783 - DNA, 123 bp, Neocallimastix californiae
  CBM_10
ctgttgggtttccgtttacggatatccatgttgtgaaggtaaaattaaagaacatgtctatgccacggataatgatggaaaatggggatatgatttctccaaaaagatatggtgtggtatttc

SEQ ID NO: 15784 - DNA, 105 bp, Neocallimastix californiae
  CBM_10
ttggtcccttgaacaaggttacaattgttgtgttggctgtaccaccttcttaaccaccgatgaaggaaattggggtattgaaaatgctgaatggtgtggtatacc

SEQ ID NO: 15785 - DNA, 93 bp, Neocallimastix californiae
  CBM_10
atataattatccatattgtaagacaacttcttctgttgtctatactgatgattttgaatggggtattgagaatgatgattggtgtattattaa

SEQ ID NO: 15786 - DNA, 105 bp, Neocallimastix californiae
  CBM_10
ttgggcagaaaaattaggttataactgctgtaccagtaaagaagtatactttgaagatgaagatggtaaatggggtgttgaaaatgatgattggtgtggtatttt

SEQ ID NO: 15787 - DNA, 114 bp, Neocallimastix californiae
  CBM_10
atgttggtcaaaaaaattaggttggccatgttgtagtgaaggtaatgttgatatctattatactgatgaagatggtgattggggtgttgaaaataatgattggtgtggtatgga

SEQ ID NO: 15788 - DNA, 108 bp, Neocallimastix californiae
  CBM_10
ctgctggtctgaaaagttcaatattccatgttgtaagtctactacttcagtcgaaagatcaacttataatggtgattttggtaaggaaaatggacaatggtgtggtct

SEQ ID NO: 15789 - DNA, 111 bp, Neocallimastix californiae
  CBM_10
atgttggtctgaaattttaggttattcatgctgtcatactacttgtacttcagttgaagatgatgctgacggtagttggggtatagaaggcaatgaatggtgtggtattcc

SEQ ID NO: 15790 - DNA, 105 bp, Neocallimastix californiae
  CBM_10
tactggcgctttaggttatccatgttgtacttaccaatgctcaattttatatactgatgaagatggtgattggagtgttgaaaacgacgactggtgtttaatcga

SEQ ID NO: 15791 - DNA, 111 bp, Neocallimastix californiae
  CBM_10
ttcagaaattgcaccaaatggttatccatattgccaaggatgtgatgttacagctactggaggtgatggttctaagtggggatgggaaaataataaatcctgtgtcattaa

SEQ ID NO: 15792 - DNA, 111 bp, Neocallimastix californiae
  CBM_10
ttcagatatggcaccaaatggttctccttattgtgaaggttgtgaagctactgctactagtggtgatggtactttatggggttgggaaaatgaacaatcctgtgtaatcaa

SEQ ID NO: 15793 - DNA, 99 bp, Neocallimastix californiae
  CBM_10
accaaatggttctccttattgtgaaggttgtgaagctactgctactagtggtgatggtactttatggggttgggaaaatgaacaatcctgtgtaatcaa

SEQ ID NO: 15794 - DNA, 99 bp, Neocallimastix californiae
  CBM_10
accaaatggttatccatattgccaaggatgtgatgttacagctactggaggtgatggttctaagtggggatgggaaaataataaatcctgtgtcattaa

SEQ ID NO: 15795 - DNA, 108 bp, Neocallimastix californiae
  CBM_10
ttgttggtctgaatcattaggttattcatgttgtcatggctgtaccatttatgaaactgatgatgatggttcttggggttatgaaaatgatagttggtgtggtattca

SEQ ID NO: 15796 - DNA, 120 bp, Neocallimastix californiae
  CBM_10
atgttgggctgaaagtcttggttatccatgttgttctggtaaaaatccaaaagtatatgcccatgataatgatggtgattggggttacaactttgccactggagaatggtgtggtatttc

SEQ ID NO: 15797 - DNA, 111 bp, Neocallimastix californiae
  CBM_10
ttgggcctctaagattggttatccatgttgtaagaaaaagaatggaaagatctataaagtgaattcctatggaagttggggaatagagaaatctaattggtgtggtatggt

SEQ ID NO: 15798 - DNA, 114 bp, Neocallimastix californiae
  CBM_10
atgttggtcagaagaattaggatttctatgttgtaaggaaagcaagacgaaggtcaaactagaagatattaatggaaaatggggaaaagagaaaggcaggtggtgtggtattat

SEQ ID NO: 15799 - DNA, 96 bp, Neocallimastix californiae
  CBM_10
tgatccaaattacaaagtatgtaaaggttgcgaagtagttgtcactgatatagaaggtgcatggggtgcagaaaatggtgaatggtgttacattga

SEQ ID NO: 15800 - DNA, 87 bp, Neocallimastix californiae
  CBM_10
ttacgattgttgtactggttgcaaaccaattgtagctgatgatgaaggcttatggggtgcagaaaatggtgattggtgtttgattga

SEQ ID NO: 15801 - DNA, 108 bp, Neocallimastix californiae
  CBM_10
atgttggtcagaaatattaggatatccatgttgtaaaggatgtaaaatctatgaaactgactcagatggatcctggggatatgaatttaatcaatggtgtggtattat

SEQ ID NO: 15802 - DNA, 114 bp, Neocallimastix californiae
  CBM_10
tttatcagaattcttgggatatccatgttgttcatctgaacttacgaccgtctatgctgaggatgagtatggtgaatggagttatgatttcaccaagaatgaatggtgtggttt

SEQ ID NO: 15803 - DNA, 93 bp, Neocallimastix californiae
  CBM_10
aaccgcctatccatgctgtagccattgtaacgtctcaatttcagaagaatatatccgttggggtattgaaaatggtgactggtgtatgattaa

SEQ ID NO: 15804 - DNA, 111 bp, Neocallimastix californiae
  CBM_10
atgttggagtaaagctttaggttatgaatgttgtgatagttgtaacgtagtcttcattgatgataaaaaacaaaaatggggatcaatgaataagcaatggtgtggtattga

SEQ ID NO: 15805 - DNA, 123 bp, Neocallimastix californiae
  CBM_10
ttggtctgaaagtttaaaggaatcaaaaaaattcccatgttgtagtagtaataatgtaaaagttgctggaaaagatatggatggttcatggggatatgagaatggtgtaaaatgtggtattag

SEQ ID NO: 15806 - DNA, 105 bp, Neocallimastix californiae
  CBM_10
gtgttggacattgtctgatggatatccatgctgtgaatctcttgcaagtaaagttgagggtgaaaatgatgaatggggttatgaaaatggtggttggtgtggatt

SEQ ID NO: 15807 - DNA, 111 bp, Neocallimastix californiae
  CBM_10
atgttggtcaagtagtttaggttattcatgttgtaaaagtacaaacgaagttaaatatactgctatcaatggttcttttggatatgaaaacgactcatggtgtggaataaa

SEQ ID NO: 15808 - DNA, 114 bp, Neocallimastix californiae
  CBM_10
ttgttggtcggtatcattaggttatccatgctgcagtgaagataatcaaggtatttacttaattgatgaaaatggatcatggggtttggaaaacaatgactggtgtggtattat

SEQ ID NO: 15809 - DNA, 108 bp, Neocallimastix californiae
  CBM_10
gtgtttctctgaagctcttggctacccatgttgtactaataactcaccaatttactacgttgataatgacggaaattggggtgttcaaaataacaactggtgtggtct

SEQ ID NO: 15810 - DNA, 111 bp, Neocallimastix californiae
  CBM_10
ttgttggtctactgccttaggttatccatgttgttcatctggtaccgttgttacttacactgataatgatggtgactggggaataaacaataacaattggtgtggaattat

SEQ ID NO: 15811 - DNA, 108 bp, Neocallimastix californiae
  CBM_10
ttgttggtccaaaaaattaggttacccttgttgtaatggatgtaaaatttatgaaagtgatttggatggtttatggggatatgaaaaacatcaatggtgtggtattca

SEQ ID NO: 15812 - DNA, 108 bp, Neocallimastix californiae; identical to SEQ ID NO: 15811
  CBM_10

SEQ ID NO: 15813 - DNA, 105 bp, Neocallimastix californiae
  CBM_10
ctggtcagaatccgtcggttacccttgttgtacaggatgtgaagtggtagaagttgaagatgataaaaaatggggagtagaatctaatgaatggtgtggtattcc

SEQ ID NO: 15814 - DNA, 120 bp, Neocallimastix californiae
  CBM_10
atgtatggcagaattagctggttatacttgctgtcctccagaaatagatactgtctatttccaagatgaatatggtgattggggtgttaatcctgaaaataataattggtgtggtatcac

SEQ ID NO: 15815 - DNA, 111 bp, Neocallimastix californiae
  CBM_10
ttgggcaaataaattaagttatagatgttgctcaacaagtgatgctgatgttgtatttaaagacggtagtggtgaatgggctattgaaaacggtgactggtgtggaattat

SEQ ID NO: 15816 - DNA, 111 bp, Neocallimastix californiae
  CBM_10
ttgggccaatgatataaagtatgaatgttgtgaatcaaatgatggtgaagtatatttcattgatgatgatggtaaatggggtattgaaaatggttcatggtgtggtatcat

SEQ ID NO: 15817 - DNA, 96 bp, Neocallimastix californiae
  CBM_10
tcaaggttattcctgttgtaaatctagctgtaatgtttatgaagaagattctgatggtaaatggagtattgaaaatgacgaatggtgcttaattga

SEQ ID NO: 15818 - DNA, 96 bp, Neocallimastix californiae; identical to SEQ ID NO: 15817
  CBM_10

SEQ ID NO: 15819 - DNA, 114 bp, Neocallimastix californiae
  CBM_10
ttgggctaatgaattaggatatgactgttgttctaaaagagatactaaaattatttttattgatgaatctggtgcttggggtgcaacaaaagataataaatggtgtggaattat

SEQ ID NO: 15820 - DNA, 96 bp, Neocallimastix californiae
  CBM_10
aaatggttatggtagttgttctcttcaaaccaaaataattgcagtagataatgatggaatttggggtatagaaaataataaatggtgtgctatcct

SEQ ID NO: 15821 - DNA, 111 bp, Neocallimastix californiae
  CBM_10
atgctggtctgatgttttaggatatagctgttgtaagaaaaattgttatgtttattatactgataaagatggaaaatggggtgttgaagataatcaatggtgtggtattat

SEQ ID NO: 15822 - DNA, 108 bp, Neocallimastix californiae
  CBM_10
ttacggtgaaaccactaaggaatatccatgttgtgaaggttgtaaaaccgcatatagagataacaatggtaaatggggatatgaaaataataattggtgttccataaa

SEQ ID NO: 15823 - DNA, 108 bp, Neocallimastix californiae
  CBM_10
ctggtcagaaaaattaggatattcttgttgtcaaacttcatgtcatgtctatgaaactgatgaagacggagaatggggatacgaagaaggtcactggtgtggtattcc

SEQ ID NO: 15824 - DNA, 111 bp, Neocallimastix californiae
  CBM_10
ctgttggtctgttaaatatggatattcatgctgtgaaacctcttgcaatgtttatgaaactgatgctgctggtgattggggatatgaagatcaccattggtgtggtattaa

SEQ ID NO: 15825 - DNA, 111 bp, Neocallimastix californiae
  CBM_10
ttgctggtctactgctcaaggatatccatgttgttctgaatgtcaagacccaatttatgaagatgatgatggtaaatggggtgttgaagataatgactggtgtggtatttc

SEQ ID NO: 15826 - DNA, 120 bp, Neocallimastix californiae
  CBM_10
atgtatagctgaaacattaggatatcattgttgctcttcagataatactactgtttatgctcatgatagtaatggcgattggggatttgactttgaaaaaaaagaatggtgtggtattac

SEQ ID NO: 15827 - DNA, 111 bp, Neocallimastix californiae
  CBM_10
ctgctggtcagaaattttaggctatttatgttgttcagaatgtattaaagtagttgaagttgattctaatggtaaatggggtatagaaaataatcattggtgtggtattcc

SEQ ID NO: 15828 - DNA, 108 bp, Neocallimastix californiae
  CBM_10
atgttgggccgcttcacaaggttataaatgttgtaatagttgtcaacctgtttatactgatggttcaagaagatggggtgttgaaaataatcaatggtgtggtatcat

SEQ ID NO: 15829 - DNA, 102 bp, Neocallimastix californiae
  CBM_10
tgctactaaattaggatataaatgttgtaaaagttgtacgatctatttaaatgatagcaccggtaaatggggtgtagaaaataatcaatggtgtggtattga

SEQ ID NO: 15830 - DNA, 108 bp, Neocallimastix californiae
  CBM_10
ttgggctgcctctgaaggttataagtgttgtaaagctggtaccgcagttgttcttacagatagtaagggtaaatggggtattgaaaacaatcaatggtgtggtattgt

SEQ ID NO: 15831 - DNA, 108 bp, Neocallimastix californiae
  CBM_10
ttggtctgaaaaattaggatatccatgttgtacttctactagtgtttctgtctttgaagataatgatggtaaatggggtattgaaaacggtaactggtgtggtattat

SEQ ID NO: 15832 - DNA, 114 bp, Neocallimastix californiae
  CBM_10
ctgtttctccttaaagttaggttatccatgttgttctaatgctagcactccatctgtctatgaagattctgatggtaaatggggtgttgaaaatggtaactggtgtggtattcc

SEQ ID NO: 15833 - DNA, 105 bp, Neocallimastix californiae
  CBM_10
ttggtccgaaaagtttggatattcttgctgtaaaaaatgtgttgtatatgaaacagataataatggtaaatggggttatgagaataatcattggtgtggtattcc

SEQ ID NO: 15834 - DNA, 117 bp, Neocallimastix californiae
  CBM_10
atgttatgctgaattactgaactatccttgctgttcatccagtataactgaagtctttgcacatgataatttgggggattggggttatgattttgaaaaaaagacatggtgtggact

SEQ ID NO: 15835 - DNA, 108 bp, Neocallimastix californiae
  CBM_10
tttctcagaagctcttggttacccctgttgtaccaataattcacgagtatattttataggtgaaagcggttcctggggaattcaagatgatcaatggtgtggtattat

SEQ ID NO: 15836 - DNA, 105 bp, Neocallimastix californiae
  CBM_10
cttttccgaatcacttggttacccctgttgcactaataactcaaaagtctactacactgacaaacatggttcctggggacttcaagacaatgaatggtgtggtct

SEQ ID NO: 15837 - DNA, 111 bp, Neocallimastix californiae
  CBM_10
atgctggtctttaaaactaggatactcatgttgtcctaccggtactaaagtttattccacagatagtgatggagattggggggttcacaatcataaatggtgtggtattat

SEQ ID NO: 15838 - DNA, 108 bp, Neocallimastix californiae
  CBM_10
gtgtaaagctgctataaagggttattcctgttgtagtcaatgtaaagtgaaatataccgacaatgatggcgattggggagtagaaaataatcaatggtgttccattcc

SEQ ID NO: 15839 - DNA, 111 bp, Neocallimastix californiae
  CBM_10
tttctctcaggctttaggatatccatgttgttctaatccgaatacatcggtgaaagcaactgataaggatggagaatggggtatagaaaataatgcatggtgtggtatcaa

SEQ ID NO: 15840 - DNA, 111 bp, Neocallimastix californiae
  CBM_10
ttgctgggctgaaaaattaggttactcttgctgtacttctacttctcaagttgtttacactgatggtgatggtaactggggtgttgaaaacggtaactggtgtggtattat

SEQ ID NO: 15841 - DNA, 114 bp, Neocallimastix californiae
  CBM_10
ttgctggtctgaaaatttaggttataaatgttgttcaagtgccaacgctccaattgtttacactgatagtgatggtaactggggtgttgaaaacggtaactggtgtggtattcc

SEQ ID NO: 15842 - DNA, 111 bp, Neocallimastix californiae
  CBM_10
ttgctgggctgaaaaattaggttactcttgctgtacttctacttctcaagttgtttacactgatggtgatggtaactggggtgttgaaaacggtaactggtgtggtattac

SEQ ID NO: 15843 - DNA, 114 bp, Neocallimastix californiae
  CBM_10
ttgctggtctcaaagtttaggttactcatgttgtacaaatgctagcactccagttgtttactctgataatgacggtgactggggtgttgaaaacggtaactggtgtggtattcc

SEQ ID NO: 15844 - DNA, 120 bp, Neocallimastix californiae
  CBM_10
ttgttggtctgaattaataggctatccatgttgttcttcagaaaatacaacagtttatcaacaagatgaatacggtgattggggttacgattttactaaacaagaatggtgtggtatttc

SEQ ID NO: 15845 - DNA, 117 bp, Neocallimastix californiae
  CBM_10
ttgggctgaaaatcttggttactcatgctgttctccagagaacacctacatttacagtagtgatgaaaatggtgattggggttttgattttgaaaatcaacaatggtgtggtattat

SEQ ID NO: 15846 - DNA, 108 bp, Neocallimastix californiae
  CBM_10
atgctggtctaaaaaattaggttatccatgttgtaagggatgtaaattatattctactgatgatgatggttcatggggttatgaatctaatcaatggtgtggtattca

SEQ ID NO: 15847 - DNA, 114 bp, Neocallimastix californiae
  CBM_10
ctgttgggctaaaaagttaggttataaatgttgtaccgctaaatgtccaggcgaatattacatagatgaatatggtagttggggtgtagaaaacaatgattggtgtggtattaa

SEQ ID NO: 15848 - DNA, 111 bp, Neocallimastix californiae
  CBM_10
ctgttggtctgaaaaacttggttataaatgttgtaagactagttatccagtttacttcactgattcagatggtcaatggggtgttgaaaacggtaactggtgtggtattgt

SEQ ID NO: 15849 - DNA, 84 bp, Neocallimastix californiae
  CBM_10
tccttgttgtaaaggttgtaatgtagtagaagaagatgcttctggtaaatggggtattgaaaataattattggtgtgctattaa

SEQ ID NO: 15850 - DNA, 90 bp, Neocallimastix californiae
  CBM_10
tgcctattcaaattgttatggttgccaagtagttactgaagaagatggttataaatggggtgttgaaaacaatgattggtgtataattaa

SEQ ID NO: 15851 - DNA, 111 bp, Neocallimastix californiae
  CBM_10
atgtttttcagttcatttaggtttcccttgttgtcaaaatacacaggaaattatttattctgataacgatggtgattggggtgttgaaaataatagttggtgtggaataaa

SEQ ID NO: 15852 - DNA, 105 bp, Neocallimastix californiae
  CBM_10
cccaggatatcttgattatccatgctgttcatcttgtaacgtcatcttagttgaagacgacggtagccgttggggtgttcaagataataactggtgcagtattaa

SEQ ID NO: 15853 - DNA, 105 bp, Neocallimastix californiae
  CBM_10
ctgctggtctgaacctgattatccatgctgtaaaaacacttgcaatgttattcttaatgatggttcagaatggggttccgaaaatggtgaatggtgtggtattcc

SEQ ID NO: 15854 - DNA, 108 bp, Neocallimastix californiae
  CBM_10
atgttggtctgaaccattaggttacccatgttgttccgaatgtggttattcttactacagtgactccgatggtgaatggggtgttgaaaacgacgactggtgtggtct

SEQ ID NO: 15855 - DNA, 108 bp, Neocallimastix californiae
  CBM_10
ttggactgaagaattaggttatccatgttgtcaaacttgccaaatcagtcaattcaaagatgaaagtggtgattggggttacgaaaatgatgattggtgtggtattat

SEQ ID NO: 15856 - DNA, 90 bp, Neocallimastix californiae
  CBM_10
tcaaggttatccatgttgtcaatcaactactagtgtcatttataccgaaaataatgttaaatggggtattgaaaatgataactggtgtga

SEQ ID NO: 15857 - DNA, 114 bp, Neocallimastix californiae
  CBM_10
ctggtctactcctcttggttaccaatgttgtccaagtggctgtaaagctgaagtctatgaaaccgatgacaatggcaaatggggttatgaaaatggcaaatggtgtggtgttcc

SEQ ID NO: 15858 - DNA, 114 bp, Neocallimastix californiae
  CBM_10
ctgttggtctgaaaagttaggttatccatgttgtccaagtgaccgctgtcatgtccttgttactgatgaatcaggttcttggggtgtctaccaaaatgaatggtgtggtattga

SEQ ID NO: 15859 - DNA, 93 bp, Neocallimastix californiae
  CBM_10
cagtggctataactgttgtctcttcagtacctccgttataacgaccgataatgtgggaaaatggggtattgaaaatgatgaatggtgtctctt

SEQ ID NO: 15860 - DNA, 93 bp, Neocallimastix californiae
  CBM_10
tggtggtcaatataattgttgtgaggaatgtaacgtcgtttacaccgactctgaggattggggtattgaaaatggtaagtggtgttctatacc

SEQ ID NO: 15861 - DNA, 120 bp, Neocallimastix californiae
  CBM_10
ctgttggtccactaaacttggttacaagtgctgtaccctaagaacaacaaagccaatctactactctaaatctgctgataagtggtatggtgttgaaaatgatgaatggtgtggtatcat

SEQ ID NO: 15862 - DNA, 93 bp, Neocallimastix californiae
  CBM_10
tggtggtcaatataattgttgtaaggaatgtaacgtcgtttacaccgactcagaagattggggtattgaagatggtaagtggtgttctatccc

SEQ ID NO: 15863 - DNA, 120 bp, Neocallimastix californiae
  CBM_10
ctgttggtccactaaactcggttacaagtgctgtaccctaagaacaacaaaaccaacctactactctaaatctgctgataagtggtatggtgttgaaaatgatgaatggtgtggtatcat

SEQ ID NO: 15864 - DNA, 93 bp, Neocallimastix californiae
  CBM_10
cagtggctataactgttgtctcttcagtacctccgttataacgaccgataaagtgggtcagtggggtattgaaaatgatgaatggtgtctctt

SEQ ID NO: 15865 - DNA, 96 bp, Neocallimastix californiae
  CBM_10
aagtggtggtctctacccttgctgtgaatcttgtgaaatattttataccgatactgaggattggggtattgaaaatggtaactggtgttccattcc

SEQ ID NO: 15866 - DNA, 120 bp, Neocallimastix californiae
  CBM_10
ctgctggtccactaagtttggttataagtgttgtaccttaagaaccacagaaccatccaccttttctgaatctgatggtaaatggtatggtatcgaaaatggtaaaaagtgtggaattgt

SEQ ID NO: 15867 - DNA, 93 bp, Neocallimastix californiae
  CBM_10
cagtggttataattgttgcctcttcacaactacagttgaaacaacagattctgtgggtgactggggtattgaaaatggtgattggtgtctctt

SEQ ID NO: 15868 - DNA, 111 bp, Neocallimastix californiae
  CBM_10
atgttggtctgaaaaattaggttacccatgttgtacaagtggtgctcaagtttattacactgatgctgatggtcaatggggtgttgaaaacaataactggtgtggtattat

SEQ ID NO: 15869 - DNA, 108 bp, Neocallimastix californiae
  CBM_10
tttcgccaccaaattaggttacccatgttgtactactactactgaagttgtttttactgataatgatggtaaatggggtgttgaaaacaataactggtgtggtatggc

SEQ ID NO: 15870 - DNA, 108 bp, Neocallimastix californiae
  CBM_10
ttggtctaaagctttaggatatccatgttgtacttcgactaatgatgttatttataaagataatgatggtgaatggggtattgaaaatgatgattggtgtggtattac

SEQ ID NO: 15871 - DNA, 111 bp, Neocallimastix californiae
  CBM_10
atgttggtcagaaagattaggatacccatgttgtaaatcaagtacggaagttttctttgaagatagtgatggtcaatggagtgttgaaaatgatgattggtgtggtattca

SEQ ID NO: 15872 - DNA, 105 bp, Neocallimastix californiae
  CBM_10
tttctctactagattaggttatccttgttgttcaggaaataccgtcgcttatacagataatgatggtgattggggtgttgaaaatggtaattggtgtggtattgg

SEQ ID NO: 15873 - DNA, 114 bp, Neocallimastix californiae
  CBM_10
ttgttggtctaccgctttaggttatccttgttgttcttcttcaagtgccgaagtttggtataccgataatgacggagcatggggtgttgaaaatggtgactggtgtggtattcc

SEQ ID NO: 15874 - DNA, 60 bp, Neocallimastix californiae
  CBM_10
ttggtataccgataatgacggagcatggggtgttgaaaatggtgactggtgtggtattcc

SEQ ID NO: 15875 - DNA, 117 bp, Neocallimastix californiae
  CBM_10
atgtatttctgaagttttaggttacccatgctgtcctccagaaattactgaagtctacgtcactgatattaatggtgattgggcttacgattatgaaaaacaagtttggtgtggtct

SEQ ID NO: 15876 - DNA, 111 bp, Neocallimastix californiae
  CBM_10
atgttggtctgaaagtttgaattatccatgttgtgataattgtgttgtctatgaagtcgatgataatggcaaatggggttatgatttccaaactcaaacctggtgtggtag

SEQ ID NO: 15877 - DNA, 108 bp, Neocallimastix californiae
  CBM_10
ttgctttgctgaaagattaggttatccatgttgttctggtaatgaagttgtttacaccgataacgatggaaagtggggtgtagaaaacggtaattggtgtggtattgc

SEQ ID NO: 15878 - DNA, 114 bp, Neocallimastix californiae
  CBM_10
ttgttggtccctttctcaaggttatccatgctgttcttcttcaaatgctgaagtttggtacaccgatgcctcaggtaagtggggtgttgaaaatggagactggtgtggaattcc

SEQ ID NO: 15879 - DNA, 108 bp, Neocallimastix californiae
  CBM_10
atgttggtctgaagctttaggttacccatgttgttctgaatgcataaatgcctacgctgaagatgctgatggcaaatggggtattgaaaatgataactggtgtggtct

SEQ ID NO: 15880 - DNA, 90 bp, Neocallimastix californiae
  CBM_10
aggttatgaatgttgcgaaggttgtacagttgaatatgaagaaaacaatataaaatggggttacgaaaatagaaattggtgtgttatacc

SEQ ID NO: 15881 - DNA, 99 bp, Neocallimastix californiae
  CBM_10
caccagatttggatttccatgttgtgaaaaatgtatacttcaatatgttgatgattttggaaattggggatttgaaaatgacaattggtgtggtatttc

SEQ ID NO: 15882 - DNA, 93 bp, Neocallimastix californiae
  CBM_10
attaggctatagatgttgtagttcttgtgaaataaaatatatagataataatattaaatatggttatgaagacggtgaatggtgtggtattcc

SEQ ID NO: 15883 - DNA, 114 bp, Neocallimastix californiae
  CBM_10
atgttggtctaaaggtctttttaaaattccatgttgtaaaaaaactgatgtagtcgttcgtaccacatatgatggtgaatggggtcaagaagataacggaaaatggtgtagtct

SEQ ID NO: 15884 - DNA, 108 bp, Neocallimastix californiae
  CBM_10
ttatggtgaaaccacaggtgaatattcatgttgtgaaaaatgtaaggttcgttactctgacaagcatggtgattggggtatcgaaaataaagagtggtgttccataaa

SEQ ID NO: 15885 - DNA, 108 bp, Neocallimastix californiae
  CBM_10
ttggtcagaaattttaggttatagttgttgcaaagaaacctgtaagacaaaatatactgataagcatggtaattggggtgttgaaaataaacaatggtgtggtattat

SEQ ID NO: 15886 - DNA, 108 bp, Neocallimastix californiae
  CBM_10
ttggtcagaaattttaggttacagttgttgcaaaaaaacctgtaaaacaaaatattcagataaacatggtaattggggtgttgaaaataaacagtggtgtggtattat

SEQ ID NO: 15887 - DNA, 90 bp, Neocallimastix californiae
  CBM_10
atgttggtctgaagtattaggatatccatgttgtaagagttgcacagtttatgacaccgattctgatggacaatggggttatgaagatga

SEQ ID NO: 15888 - DNA, 117 bp, Neocallimastix californiae
  CBM_10
ttgggttgaacaatttggttatccatgttgttcatcaagaaataagattgtttatgctcatgatggtgaaggagattggggttatgactttagtaagatggaatggtgtggtattac

SEQ ID NO: 15889 - DNA, 114 bp, Neocallimastix californiae
  CBM_10
ttgttggtcactttctcagggttatccatgttgctcttcatcaaatgctgaagtttggtacaccgatgcctccggtaaatggggtgttgaaaatggtgactggtgtggtattcc

SEQ ID NO: 15890 - DNA, 105 bp, Neocallimastix californiae
  CBM_10
tttctctaccagattaggttatccatgttgttctggaaatgatgttgtttacattgataatgacggtaaatggggtgttgaaaatggtaactggtgtggtattgc

SEQ ID NO: 15891 - DNA, 112 bp, Neocallimastix californiae
  CBM_10
atgttggtccaagaaacttggttatgaatgttgtactggtgatgatgaaggccatatctttgttgttgaagaagataaagatggtcaatggggttatgaaaatggccattgg

SEQ ID NO: 15892 - DNA, 111 bp, Neocallimastix californiae
  CBM_10
atgttggtctcaaagattaggttataattgttgtaccacttcctgttatatctatgaaaaggaccaagatggtaattggggctatgaaaacaacgaatggtgtggaattcc

SEQ ID NO: 15893 - DNA, 96 bp, Neocallimastix californiae
  CBM_10
tatatacaaatgttgcagtagtagtgatgctgaagtatggtatgttgatgatgatggaaattggggtgttgaaaatggagaatggtgcttcataga

SEQ ID NO: 15894 - DNA, 111 bp, Neocallimastix californiae
  CBM_10
ttggtctagaaaactcggttacagatgttgttctgctgataataccgaagttatagtaatagataaagatggaaaatggggtgttgaagaccaagaatggtgtggtatcat

SEQ ID NO: 15895 - DNA, 108 bp, Neocallimastix californiae
  CBM_10
atgttggtctgagccattaggttatccttgttgtcagaaatgttcaattattgaaaccaatgaaagtggttcatggggatttgaattaaatcaatggtgtggtattcc

SEQ ID NO: 15896 - DNA, 114 bp, Neocallimastix californiae
  CBM_10
atgtttatctgaaataattggttattcatgctgtccattaggttatgaaaatatttatcatgataattatggtgactggggttatgattttgaaaatgatacatggtgtggtct

SEQ ID NO: 15897 - DNA, 120 bp, Neocallimastix californiae
  CBM_10
ctgttggtccaccaaactgggttataaatgttgtaccttaagaacgaccgagccaatccactactctaaatctgcggataaatggtacggtgtggaaaatgacgaatggtgtggtattgt

SEQ ID NO: 15898 - DNA, 96 bp, Neocallimastix californiae
  CBM_10
aagtggtggcctctacccctgttgtaagacctgtgaagttgtctataccgatacggaagattggggtattgaagacgctaactggtgttccattcc

SEQ ID NO: 15899 - DNA, 93 bp, Neocallimastix californiae
  CBM_10
cagtggctacaactgttgtctcttcaccaccaaagtagaaacgagtgatacggtgggggactggggtatcgaaaacaatgaatggtgtctctt

SEQ ID NO: 15900 - DNA, 108 bp, Neocallimastix californiae
  CBM_10
ctgttggtctacttccttaggtttcccatgttgtagtggtaattctattgtttatttcactgattccaatggtcaatggggtattgaaaatgaccaatggtgtggtaa

SEQ ID NO: 15901 - DNA, 114 bp, Neocallimastix californiae
  CBM_10
ttggagtagtaaatatggttacaaatgctgtagtacatcaacctgtagaaatagtgtattcgctgatactgatggtcaatgggatgttgaaaacggtcaatggtgtggtatttc

SEQ ID NO: 15902 - DNA, 114 bp, Neocallimastix californiae
  CBM_10
ttgttggtctacctcattaggctatccatgttgtaaatcatgtaatacttcagccgttttcgaagataatgatggtaaatggggtattgaaaacgatgactggtgtggtattcc

SEQ ID NO: 15903 - DNA, 96 bp, Neocallimastix californiae
  CBM_10
acaaggttacccatgttgtaagactacctgttccgtcttctctactgatagtgatggtaaatggggtattgaaaacgacaattggtgtttaattga

SEQ ID NO: 15904 - DNA, 105 bp, Neocallimastix californiae
  CBM_10
ttggtctgaaagatttaatattccttgttgtaaatcaactaatactgtcgtaagatcaacttatgatggtgaatggggaatggaaaatggtgaatggtgtggtct

SEQ ID NO: 15905 - DNA, 99 bp, Neocallimastix californiae
  CBM_10
ccaaggttacaaatgttgcgctgattcaaattgtactgtttactacactgatgccgatggtacctggggtgttgaaaatggtgaatggtgtggttgtgg

SEQ ID NO: 15906 - DNA, 120 bp, Neocallimastix californiae
  CBM_10
ttgttcttcaaagattactgctcaaggttataagtgctgttctgatccaaactgtgttgtttactacactgatgctgatggtacttggggtgttgaaaacggccaatggtgtggttgtgg

SEQ ID NO: 15907 - DNA, 111 bp, Neocallimastix californiae
  CBM_10
atgtgcttttgaaaagattggttataaatgttgtgaaagtactactgatgtcgtatttgaagatggaagtggtacttggggtgtagaaaataatgaatggtgtggtattac

SEQ ID NO: 15908 - DNA, 90 bp, Neocallimastix californiae
  CBM_10
tggttacaagtgttgtgaacgttgtgaagttgaatactctgatgatactggttcttggggtgttgaaaatggtgactggtgtggtattcc

SEQ ID NO: 15909 - DNA, 111 bp, Neocallimastix californiae
  CBM_10
ttgctgggcccaagctcaaggatatcaatgttgtacttctacctccgaagttgttttcactgatgaaagtggtgattggggtgtagaaaacggtgaatggtgtggaattaa

SEQ ID NO: 15910 - DNA, 93 bp, Neocallimastix californiae
  CBM_10
tagtggctatccatattgtaagagtactactgaagtcatttatactgatgatgtaaactggggtgttgaaaatggtgactggtgtgttattaa

SEQ ID NO: 15911 - DNA, 90 bp, Neocallimastix californiae; identical to SEQ ID NO: 15908
  CBM_10

SEQ ID NO: 15912 - DNA, 111 bp, Neocallimastix californiae; identical to SEQ ID NO: 15909
  CBM_10

SEQ ID NO: 15913 - DNA, 93 bp, Neocallimastix californiae; identical to SEQ ID NO: 15910
  CBM_10

SEQ ID NO: 15914 - DNA, 111 bp, Neocallimastix californiae
  CBM_10
ttgctggtctgttaagttaggttacccatgttgtgaagtttctaatgccatttactctgttgatgacaatggtagttggggtgttgaagatgatttctggtgtggtatcgt

SEQ ID NO: 15915 - DNA, 114 bp, Neocallimastix californiae
  CBM_10
atgctggtctgattcattaggatacccatgttgtagttccgctgatattcaagttgtatctgaagattcttctggaaaatggggtattgaaaataacaactggtgtggtattcc

SEQ ID NO: 15916 - DNA, 111 bp, Neocallimastix californiae
  CBM_10
gtgctggtctgaaccagattacccatgttgtaaattatcttctactagagtagaatacactgatgcaagtggtagttggggtattgaaaatggtaactggtgtggtattgt

SEQ ID NO: 15917 - DNA, 108 bp, Neocallimastix californiae
  CBM_10
ttgttgggctgaagcacttggatattcatgttgtccaagtggtactccagttagttacactgatgcttcaggtgattggggttacgttaatgattggtgtggtattgt

SEQ ID NO: 15918 - DNA, 105 bp, Neocallimastix californiae
  CBM_10
atgtttcgcttacccattatacaactgttgtaaaggatgtgatgttattgaagaatctgatgaaggtaaatggggtattgaaaatggttactggtgtggtattaa

SEQ ID NO: 15919 - DNA, 87 bp, Neocallimastix californiae
  CBM_10
ttatgatgaatgtaaagcatgtaatgttgtttatgttgaaggtgatgaaaaatggggtgttgaaaacaatgactggtgtataattcc

SEQ ID NO: 15920 - DNA, 96 bp, Neocallimastix californiae
  CBM_10
aaatgcttcaaaatataaatgttgtgattcctgtaaagtttctgtggatgatggtaataaatggggtatacttaatggtgaatggtgtagtataac

SEQ ID NO: 15921 - DNA, 111 bp, Neocallimastix californiae
  CBM_10
atgctgggctgaggcttatggttattcatgttgtactaaatgtgtatccgtagtagatatatctaataatagaaaatggggtatagaaaataatagatggtgtggtattcc

SEQ ID NO: 15922 - DNA, 114 bp, Neocallimastix californiae
  CBM_10
tccatctgctattaccgctcaaggttacaagtgctgctcttcctgtggtaccgtttactacaccgatggtgatggtgaatggggtgttgaaaacggtgactggtgtggaatgcc

SEQ ID NO: 15923 - DNA, 96 bp, Neocallimastix californiae
  CBM_10
tcaaggttacaagtgctgttccgctaactgtgaagttgtttatactgataatgatggtgattggggtgttgaaaacaacgaatggtgtggttgtgg

SEQ ID NO: 15924 - DNA, 108 bp, Neocallimastix californiae
  CBM_10
ttgttggtctagttccttaagctatggatgctgttctggatgtaaagttctctataccgataaagatggtaaatggggaatagaaaatggtgattggtgtggtattcc

SEQ ID NO: 15925 - DNA, 111 bp, Neocallimastix californiae
  CBM_10
ttgttggtcaacccaattgggctataaatgttgtaccaaaactaattttattgtatataccgacaaggatggctactggggtgttgaaaataagcaatggtgtggtattag

SEQ ID NO: 15926 - DNA, 108 bp, Neocallimastix californiae
  CBM_10
atgtccaggtaagaaatatggatatccatgttgtgaaagctgtgatgtcttcttagaagatgaaagtggtatttggggagctgaaaatggtcaatggtgcagtattaa

SEQ ID NO: 15927 - DNA, 117 bp, Neocallimastix californiae
  CBM_10
atgttggtctgaagctttcggatataaatgctgttctgctggatgtaattcagtagttgttgttattgatgaaagtggttactggagtgctgaaaacggtgaatggtgtggtattcc

SEQ ID NO: 15928 - DNA, 99 bp, Neocallimastix californiae
  CBM_10
aagccaaggttaccaatgttgtagcaacaacaattgtaatattgtttaccaagatggtactggtaactggggtgttgaaaacaaccaatggtgtggtct

SEQ ID NO: 15929 - DNA, 99 bp, Neocallimastix californiae
  CBM_10
atgtcatccacaatacccatgttgtagtggatgtgatgttatttacactgatactgatggtgaatggggtgttgaaaactatgactggtgtttcattga

SEQ ID NO: 15930 - DNA, 96 bp, Neocallimastix californiae
  CBM_10
aaaacaaggttattcatgctgttcaagctgtattatatattttactgataatgatggcaaatggggtgttgaaaatggaaaatggtgtggtattca

SEQ ID NO: 15931 - DNA, 96 bp, Neocallimastix californiae
  CBM_10
aagtcaaggttatgcatgctgtagatcatgcgatattatttattctgatgagagtggtgattggggaattgaaaatagttattggtgtggaatttc

SEQ ID NO: 15932 - DNA, 99 bp, Neocallimastix californiae
  CBM_10
taaaaaacaaggttattcatgctgttcaagctgtattatatattttactgataatgatggcaaatggggtgttgaaaatggaaaatggtgtggtattca

SEQ ID NO: 15933 - DNA, 96 bp, Neocallimastix californiae; identical to SEQ ID NO: 15931
  CBM_10

SEQ ID NO: 15934 - DNA, 114 bp, Neocallimastix californiae
  CBM_10
ttgtaaatttactcaacttggttatccatgttgtgataatccaaagactgtttccgtttataccgatgaatctggtgattggggtattgaaaatggtgattggtgtggtattga

SEQ ID NO: 15935 - DNA, 108 bp, Neocallimastix californiae
  CBM_10
ttgtactggaatgaatttaggttacccatgttgtgatgattgtaatgtcgtttacacggatcatgatggtaaatggggtgttcaaaatgatgattggtgtggtatcaa

SEQ ID NO: 15936 - DNA, 96 bp, Neocallimastix californiae
  CBM_10
tttatatccatgttgtaaaaattgtgaagttatttacaccgatgaagatgatggtactcaatatggtcttgataagatagaatggtgtattatcga

SEQ ID NO: 15937 - DNA, 105 bp, Neocallimastix californiae
  CBM_10
tgcaaatgcctatggatatcctggatgtaaaagtactaccgaaattaaatattacgatgaagaaggttcttggggttatgaaaatggaacctggtgtggtattga

SEQ ID NO: 15938 - DNA, 111 bp, Neocallimastix californiae
  CBM_10
gtgttggtcagaaccattaggttacccatgttgtactggtattatcaagactgaatatactgataaagatggggaatggggattacaaaatggcgattggtgtggtatcac

SEQ ID NO: 15939 - DNA, 105 bp, Neocallimastix californiae
  CBM_10
ttatattaaaggttataaatggtgttctgatccaaatactaaaagatatccatataatgatgaagatttttggggtgttgaaaatggtaattggtgtgttattaa

SEQ ID NO: 15940 - DNA, 111 bp, Neocallimastix californiae
  CBM_10
ttgttggtcagaaccattaggatacccatgttgtactggtattatcgaaactgaatatactgataaagatggggaatggggattacaaaatggcgattggtgtggtatcac

SEQ ID NO: 15941 - DNA, 111 bp, Neocallimastix californiae
  CBM_10
tcattttttagatataaattataaatgttgtactacaaccatgacatcttcatatgaagatattgatggtttatggggaaatgaaactaatggtgaatggtgtggtattga

SEQ ID NO: 15942 - DNA, 105 bp, Neocallimastix californiae
  CBM_10
ttggtctgcaaaatttggttatccttgctgtaaggaaactactgttgtagaagctgttgatgaaaatggcagatggggattagaaaatggtggaagatgtggttt

SEQ ID NO: 15943 - DNA, 111 bp, Neocallimastix californiae
  CBM_10
gtgttggtcagaaccattaggttacccatgttgtactggtaataccaaaactgaatatactgataaagatggggaatggggattacaaaatggtgattggtgtggtatcaa

SEQ ID NO: 15944 - DNA, 87 bp, Neocallimastix californiae
  CBM_10
ttcaaaatataaatgttgcgaatcttgcaatgtttcctacgatgatggaaataaatggggtgtattaaatggagaatggtgtagttt

SEQ ID NO: 15945 - DNA, 93 bp, Neocallimastix californiae
  CBM_10
ttcttacccatgctgtgaaaatacttgtgctgttcaatatactgacgctgatggtcaatggggtattgaaaatggtgaatggtgtagtatttc

SEQ ID NO: 15946 - DNA, 111 bp, Neocallimastix californiae
  CBM_10
tttctctactagacttggttacccatgctgttccccaaataataccaatgttgtttatgctgataatgatggtgattggggtattgaaaatggaaattggtgtggtatgag

SEQ ID NO: 15947 - DNA, 111 bp, Neocallimastix californiae
  CBM_10
atgttggtctagtgctatgggttattcatgttgtaaatcatgtgatagtttcaattacaaagataatgatggtgaatggggtatagaaaatgatgcctggtgtggtattcc

SEQ ID NO: 15948 - DNA, 105 bp, Neocallimastix californiae
  CBM_10
taaaggtgctttaggttatccatgttgtaaatctacatgtaatgtttactcatctgatgaaagtggtcaatggggtattgaagataacaactggtgtttaattga

SEQ ID NO: 15949 - DNA, 105 bp, Neocallimastix californiae
  CBM_10
atgtttctcttacccagaatacatatgttgtgaaggttgtaatgtaatagaagaaacagctgaaggtaaatggggtattgaaaagaaccaatggtgtggtatcaa

SEQ ID NO: 15950 - DNA, 84 bp, Neocallimastix californiae
  CBM_10
atatgaatattgccaaggctgtagagtattttatgaagatgaccaacaatggggtgttgaaaacaatgattggtgtattattcc

SEQ ID NO: 15951 - DNA, 90 bp, Neocallimastix californiae
  CBM_10
ttctaaaactggttatccatactgttctttggaaaatattgatattgcatacactcatgaaacgggttcttggggatttgaaaatgacct

SEQ ID NO: 15952 - DNA, 93 bp, Neocallimastix californiae
  CBM_10
gggttataactgttgtaaaaattcttgtaatgtcacttacaaggataacgatggtaattgggatgtagagaacggtaactggtgtggtgttcc

SEQ ID NO: 15953 - DNA, 108 bp, Neocallimastix californiae
  CBM_10
ttggagtatgccagattacccatgttgtaccaacactaaaactgcggtctacactgataatgccggtaatgaatggggcatggaaaataataactggtgtggtattat

SEQ ID NO: 15954 - DNA, 111 bp, Neocallimastix californiae
  CBM_10
cttctctgaagctttaggttatccatgttgctctgattcaaacgctgctgttgttactaccgatgagtttggtcattggggtattgaaaataatgaatggtgtggtatact

SEQ ID NO: 15955 - DNA, 99 bp, Neocallimastix californiae
  CBM_10
ttcaaatggatttccaacttgtaaatcatgcgatgttaccgcaacaggcactgatggggtctctctttggggatgggaaaatgaaaaatcttgtaaaat

SEQ ID NO: 15956 - DNA, 96 bp, Neocallimastix californiae
  CBM_10
ctcaggctataattgttgtgtctttgatactactgccgttcaaaccgtggatgttgttggcaaatgggggattgaaaatggagattggtgtctctt

SEQ ID NO: 15957 - DNA, 99 bp, Neocallimastix californiae
  CBM_10
tccaagtggtggaacctataaatgttgttcttcctgtgaaattctttatactgacacggaagaatggggtattgaagatggtgaatggtgttccattcc

SEQ ID NO: 15958 - DNA, 120 bp, Neocallimastix californiae
  CBM_10
ctgttggtcaaagagtttaggttacccatgctgtacctctaaaacaacagaactaatttacttttctaaaagtgcgaataaatggtatggtgttgaaaatgatgaatggtgtggtattgt

SEQ ID NO: 15959 - DNA, 108 bp, Neocallimastix californiae
  CBM_10
tattacttcccaaggttacaagtgttgtaaagaagataactgttcagttattgaaaccgatgatgctggtaaatggggtattgaagatggacaatggtgtggtatttc

SEQ ID NO: 15960 - DNA, 114 bp, Neocallimastix californiae
  CBM_10
ttctgatgctatcttaaagaaaggatacaaatgttgttcaaaggattgtttcatagtttttactgatgatgatggtacatggggtattgaaaatgatcaatggtgtggttgtga

SEQ ID NO: 15961 - DNA, 105 bp, Neocallimastix californiae
  CBM_10
tactggtgctcaaggttatccatgttgtcaatccaccactaaagttgaatatacagatggagatggtaactggggtgttgaaaatggtgattggtgtattattag

SEQ ID NO: 15962 - DNA, 96 bp, Neocallimastix californiae
  CBM_10
tcaaggttataaatgttgttctagaaattgtgttgttgtttactctgatgctgatggtaattggggtgttgaaaatggtgaatggtgtggatgtgc

SEQ ID NO: 15963 - DNA, 108 bp, Neocallimastix californiae
  CBM_10
ttggtctaaaaaattaggttatccatgttgtacttcttcatctcaagtttatgaaactgatgctaatggtgaatggggttatgaagataatcattggtgtggtattcc

SEQ ID NO: 15964 - DNA, 111 bp, Neocallimastix californiae
  CBM_10
atgttggtcagaagttttaggttatccatgttgtacttcttcctgccatgtttatgaaacagattctgatggtgaatggggttatgaaaataaacaatggtgtggtattcc

SEQ ID NO: 15965 - DNA, 111 bp, Neocallimastix californiae
  CBM_10
atgcttttcaaaatctcttggttatccctgttgtacttctaaaaatcctcgtatctatttcagtgatagtaaaggtaattggagttatgaaaatggaaaatggtgtggtgc

SEQ ID NO: 15966 - DNA, 108 bp, Neocallimastix californiae
  CBM_10
atgttttgcaactgctctcggctatccatgctgttctccatatgctaaagaacgtttcagagataaaaatggtagatggggtattgaatatggtgcatggtgtggttt

SEQ ID NO: 15967 - DNA, 108 bp, Neocallimastix californiae
  CBM_10
atgttttaccattccattgggttatccttgttgtactaaaactaaagaagtaacttatactaatggctatggtacatggggtacagaaaatggagattggtgtggtct

SEQ ID NO: 15968 - DNA, 108 bp, Neocallimastix californiae
  CBM_10
ctggtccaaaacattaggctatgattgttgtaaaaatacatgtaatgttgtttattcagataatgatggagaatggggagttgaaaataatgaatggtgtggtataat

SEQ ID NO: 15969 - DNA, 100 bp, Neocallimastix californiae
  CBM_10
atgctatggtaccactacaggtgaatatccatgttgtactcattgtgatatatattatgttgacgaaaatggtaattggggtattgaaaataataactgg

SEQ ID NO: 15970 - DNA, 105 bp, Neocallimastix californiae
  CBM_10
atgtttctcttatccagattatccatgttgtgaagaatgtaatgtatatgaagaagatgattctggtaaatggggtattgaaaataaccaatggtgtggtattaa

SEQ ID NO: 15971 - DNA, 90 bp, Neocallimastix californiae
  CBM_10
ctacagtaactgtaatagtacatgtagagttgtaacagttgaagacggtgtcagctggggtgtagaaaataatgactggtgtattattaa

SEQ ID NO: 15972 - DNA, 102 bp, Neocallimastix californiae
  CBM_10
atcccaaggttataagtgttgttctgataagaactgtgctgttgtctacagtgataatgatggtacttggggtgttgaaaatggacaatggtgtggatgtaa

SEQ ID NO: 15973 - DNA, 105 bp, Neocallimastix californiae
  CBM_10
taagggtgttactggttatccatgttgtcaatctaacaaaactgtctacttctctgatgaatctggtgattggagtgttgaaaacaataactggtgtttaattgc

SEQ ID NO: 15974 - DNA, 108 bp, Neocallimastix californiae
  CBM_10
atgtagatttgaatctcttggatatccatgttgtagtcattgtaatgttatttacactgatgatgatggtaactggggtgctgaaaatggtcaatggtgtggtattcc

SEQ ID NO: 15975 - DNA, 111 bp, Neocallimastix californiae
  CBM_10
tgttgttaaatctcttggttacccatgttgttcaccaaacaacactgaagtcttctacactgatgaaaatggtgattggggtgttgaaaatggtgactggtgtggtattac

SEQ ID NO: 15976 - DNA, 105 bp, Neocallimastix californiae
  CBM_10
ttggtctgaagctttaggttacccatgttgttctacttgttccagtcctgtctacagtgataatgatggtaactggggtattgaaaatggtgactggtgtggtct

SEQ ID NO: 15977 - DNA, 105 bp, Neocallimastix californiae
  CBM_10
ttggtctcttgctttaggttacccatgttgtgttggtaatgatgttatctttgttgatgaaagtggtgaatggggtgttgaaaacaataattggtgtggtattgt

SEQ ID NO: 15978 - DNA, 117 bp, Neocallimastix californiae
  CBM_10
atgttgggctactgctctcggttatgactgttgtagtactaatgtatgtagaactgtatactacgaagataatgacggtaaatgggatgttgaaaatggtcaatggtgtggtattac

SEQ ID NO: 15979 - DNA, 114 bp, Neocallimastix californiae
  CBM_10
gtgctggtcattgaaagatggctatccatgttgtaagactactttcacagttattgaagtagatgaaaatggtaaaaagtggggttttgaaaataataattggtgtggtattaa

SEQ ID NO: 15980 - DNA, 111 bp, Neocallimastix californiae
  CBM_10
atgttgggccacaaaatatgattatccatgttgtaaaaagactactgaggtaattgaaaaagatgaacatggaaaatggggctttgaaaacaatgattggtgtggtatagt

SEQ ID NO: 15981 - DNA, 109 bp, Neocallimastix californiae
  CBM_10
ttgttgggcatcaaaattaggattttcatgttgtaaaaatacaaaagacgttgtatatagagatagtaatggaaaatggggcgttgaaaataatacatggtgtggtata

SEQ ID NO: 15982 - DNA, 111 bp, Neocallimastix californiae
  CBM_10
atgctgggcatcggaatttggttatccatgttgtaaaacgactactgaagtaattgaaaaggatgagcatggaaaatggggttttgaaaataaagagtggtgtggtatagt

SEQ ID NO: 15983 - DNA, 111 bp, Neocallimastix californiae
  CBM_10
atgctgggcatcagaatttaattatccatgttgtaaaacaaccagtaaagtaattgaagtaaacgaatatggtaaatggggtatagaaaataatgactggtgtggaattat

SEQ ID NO: 15984 - DNA, 105 bp, Neocallimastix californiae
  CBM_10
ttggtcaatagatttaggttatccatgttgtatagaaaataatgttgttgaagtcaatgaaaatggaaaatggggtattgagaataataactggtgtggtataat

SEQ ID NO: 15985 - DNA, 93 bp, Neocallimastix californiae
  CBM_10
ttctggatataattgttgtatattaactaaatcagttaaattaatcgataatgttggtcagtggggtgttgaaaatggtgaatggtgtctttt

SEQ ID NO: 15986 - DNA, 114 bp, Neocallimastix californiae
  CBM_10
ttgggctataagtgaaggttatccatgttgtaaaaacaaaaatactcaagttcaagatatatctagtgatggtaggaaatggggttttgaaaatgatgattggtgtggtattat

SEQ ID NO: 15987 - DNA, 96 bp, Neocallimastix californiae
  CBM_10
tccagtaaattctgaatattcttgctgtagtagttgtgatgtttattatgttgatgaatttgaatggggtgtggaagatggttcatggtgtttgac

SEQ ID NO: 15988 - DNA, 102 bp, Neocallimastix californiae
  CBM_10
taagtttggttattcctgttgtaaaaaggaaaccactgccattttaacaactgatagagatgccgattggggagttgaggatggtaaatggtgtgccataaa

SEQ ID NO: 15989 - DNA, 108 bp, Neocallimastix californiae
  CBM_10
ttggtcattaccacaaggttatccttgttgtaaaaaaactacaaatgttacttacagggatgaaacaggtaattggggtttcgaatttggaaattggtgtggtatggt

SEQ ID NO: 15990 - DNA, 111 bp, Neocallimastix californiae
  CBM_10
taaaaagacttatgcttcagattatcctacttgtactggatgtgtactgtatgcctctggtaccgatggaaatttgtggggttgggaaaattttgatttctgtaaaattcc

SEQ ID NO: 15991 - DNA, 111 bp, Neocallimastix californiae
  CBM_10
ttgtcacattaatattagtgaacatccattctgtaaaggttgtgttgtcacggctacaggaacagattctagtttatggggttgggaaaacaattcttcctgtatgattga

SEQ ID NO: 15992 - DNA, 108 bp, Neocallimastix californiae
  CBM_10
tcacattaatattagtgaacatccattctgtaaaggttgtgttgtcacggctacaggaacagattctagtttatggggttgggaaaacaattcttcctgtatgattga

SEQ ID NO: 15993 - DNA, 96 bp, Neocallimastix californiae
  CBM_10
tcaaggttatccatgctgtgaatcttctactattgtctactacaccgatggtgatggtgattggagtgttgaaaatggtgactggtgtattattag

SEQ ID NO: 15994 - DNA, 96 bp, Neocallimastix californiae
  CBM_10
acaaggttattcatgttgtcaaccaggttgtactgttgtttacactgataatgatggtgattggggtgttgaaaataatgcctggtgtggatgtgg

SEQ ID NO: 15995 - DNA, 114 bp, Neocallimastix californiae
  CBM_10
ttgtttctctgaaaaacttggttacccatgttgttcagctaacaataagaatgttgtttacactgacagtgatggtgattggggtgttgaaaacaacaactggtgtggtatgtc

SEQ ID NO: 15996 - DNA, 108 bp, Neocallimastix californiae
  CBM_10
ttgggccactgctcttggttacaagtgttgtcaatctacttctgttgtagttgaaactgatgctaatggtaagtggggtattgaaaataatgaatggtgtggtattgt

SEQ ID NO: 15997 - DNA, 114 bp, Neocallimastix californiae
  CBM_10
ttcatctaaaattactgctcaaggttacagttgttgttctaaatattgtactattgtttacactgataatgatggtacttggggttatgaaaatggtgattggtgtggatgtgg

SEQ ID NO: 15998 - DNA, 87 bp, Neocallimastix californiae
  CBM_10
agaatatccatgttgtaaagaatgtaatgtttattacacggatactgaagattggggtattgaagatggagaatggtgttccattcc

SEQ ID NO: 15999 - DNA, 120 bp, Neocallimastix californiae
  CBM_10
atgttggtctcttaagtatgactataaatgttgtacattaagaactacagaaccaagctacttctccaagacagccaataactggtatggtattgaaaatggagaatggtgtggtattac

SEQ ID NO: 16000 - DNA, 93 bp, Neocallimastix californiae
  CBM_10
caccggatataattgttgtcttttcactactaccgttgtaactacagattcggttggtgactggggtgttgaaaatgaagattggtgtctctt

SEQ ID NO: 16001 - DNA, 96 bp, Neocallimastix californiae
  CBM_10
tcaaggatacaagtgttgttccgatggttgtacagtcatttacattgacagtgatggagattggggagcagaaaatggggaatggtgtggatgtgg

SEQ ID NO: 16002 - DNA, 96 bp, Neocallimastix californiae
  CBM_10
atatggttataaatgttgttcttcatgctctaaagtttattacactgataaagatggtaaatggggtattgaaaatagagattggtgtggtatacc

SEQ ID NO: 16003 - DNA, 108 bp, Neocallimastix californiae
  CBM_10
ttttgcattatctgatggttatgaatgttgtttcgataatgaagttgtttatgaagatgaaactggtaaatggggtattaatgacaaaggtgaatggtgtggtgttga

SEQ ID NO: 16004 - DNA, 117 bp, Neocallimastix californiae
  CBM_10
atgttgggctgaagctttaggttacaaatgttgtagtgatgatggtttccatccagttatttaccaagatgaaagtggtgattggagtgctgacaatggtgaatggtgtggtgttat

SEQ ID NO: 16005 - DNA, 114 bp, Neocallimastix californiae
  CBM_10
atgttggtcaaaggctcaaggttatgattgttgtgctgaaggaacttccgttttccttgaagatgaaagtggaaaatggggtgttactccaaatggtttatggtgtggtattaa

SEQ ID NO: 16006 - DNA, 84 bp, Neocallimastix californiae
  CBM_10
ttgctgtaaaaattctaatttaaaagtatcttatgttgataataatggctattggggtattgagtctgaatcatggtgcaaaat

SEQ ID NO: 16007 - DNA, 111 bp, Neocallimastix californiae
  CBM_10
atgttggtcagaatcattaggttataaatgctgtagccttgatatagagccgatttttacagataatgatggtatttggggtatggaaaacgaacaatggtgtggcataat

SEQ ID NO: 16008 - DNA, 111 bp, Neocallimastix californiae
  CBM_10
ttggagtttagatattggctatggttgttgttccagtaataacactgatatattatataataatgaagatggatcatggggaattgaaaatggtcagtggtgtggtattgt

SEQ ID NO: 16009 - DNA, 117 bp, Neocallimastix californiae
  CBM_10
ttgttcctctaagattcttgctcaaggttacccatgctgttctgacaattgtactgttgtttatactgatgatgatggtacttggggtgttgaaaatggtcaatggtgtggctgtgg

SEQ ID NO: 16010 - DNA, 108 bp, Neocallimastix californiae
  CBM_10
ctgttggtcagcctctttaggttatccatgctgtaaatcttgcagtgtttactattctgataatgatggaaagtggggtattgaaaacgacaactggtgtggtatatt

SEQ ID NO: 16011 - DNA, 96 bp, Neocallimastix californiae
  CBM_10
acaaggatacccatgctgtcaaaatacttgtactgtctactccactgatgctgatggtaaatggggtattgaaaataatgactggtgtttaattaa

SEQ ID NO: 16012 - DNA, 108 bp, Neocallimastix californiae
  CBM_10
ttgggcttctgctttaggtttcaaatgttgtaagactacttcaactgttatatttgaagatcaagatggtagttggggtatagaagatgatttctggtgtggtattat

SEQ ID NO: 16013 - DNA, 111 bp, Neocallimastix californiae
  CBM_10
ttgttggtccactagattaggttacccatgttgtgaagatagtaatgttgtttacgctgttgatgaaaatggtatttggggttatgaaaataaacattggtgtggtattac

SEQ ID NO: 16014 - DNA, 85 bp, Neocallimastix californiae
  CBM_10
atgtgaatttaatgctcttggttactcttgttgtccagatgctgctgttgtctttgaagatgatcacaaatggggttacgttaac

SEQ ID NO: 16015 - DNA, 111 bp, Neocallimastix californiae
  CBM_10
ctgtttttccgttgcactcggttttccatgttgttcatcaagtgctactgaagtgttcagagatagttatggtagttggggtgttgaatatggtgaatggtgtggtatgtc

SEQ ID NO: 16016 - DNA, 114 bp, Neocallimastix californiae
  CBM_10
ttgcttttctagtgctctcggtattccctgttgttcttccaaaaatgcagaaatctattacagtgacattaaaggtaattggggtattgaaaatggagactggtgtggtatatc

SEQ ID NO: 16017 - DNA, 114 bp, Neocallimastix californiae
  CBM_10
atgcttttcaaaatctcttggtttcccgtgttgttcctccaaaaataaagatatttatttcactgatgaaaaaggtaattggggtattgaaaacggtgaatggtgtggtatatc

SEQ ID NO: 16018 - DNA, 108 bp, Neocallimastix californiae
  CBM_10
ttgtttttctattccactgggatatccttgttgtacttccacaaaagaagttattgatacaaatgaatatggtacttggggtatagaaaatggtgattggtgtggact

SEQ ID NO: 16019 - DNA, 72 bp, Neocallimastix californiae
  CBM_10
aggatatacttgttgtaaaggatgtgatgtaatatatactgatgactttaaatggggttttgaagctggtga

SEQ ID NO: 16020 - DNA, 120 bp, Neocallimastix californiae
  CBM_10
atgttggtcgctttcacaaggttacccatgttgtaagaaagaaaccactgctataaactatactagtagtagtaccggtgcggaatggggtatagaaaatggtaattggtgtggtatcac

SEQ ID NO: 16021 - DNA, 99 bp, Neocallimastix californiae
  CBM_10
aggtactggttatgcttgttgtatattcaagaatactatagttgaaactgttgatgagagtggccaatggggacatgaaggaaatgattggtgcctaat

SEQ ID NO: 16022 - DNA, 105 bp, Neocallimastix californiae
  CBM_10
ttgggctttagctgaaggttataattgttgtagtggttgttctgtttcttatgaagatgaaactggtaaatggggtattgaaaatggtcaatggtgtggtattga

SEQ ID NO: 16023 - DNA, 66 bp, Neocallimastix californiae
  CBM_10
ttctgtttcttatgaagatgaaactggtaaatggggtattgaaaatggtcaatggtgtggtattga

SEQ ID NO: 16024 - DNA, 108 bp, Neocallimastix californiae
  CBM_10
ctgtttctcttatactttaggttacccatgttgtactagtaccactaatgttatctacactgatagctacggtcgctggggtattgaaaagggtaattggtgttttct

SEQ ID NO: 16025 - DNA, 111 bp, Neocallimastix californiae
  CBM_10
ctggtctaaaacttatggttacccatgttgttcctctgccagtactaaggttatgtacaccgataacgatggtgaatggggtgttgaaaacggtaactggtgtggtattgt

SEQ ID NO: 16026 - DNA, 111 bp, Neocallimastix californiae
  CBM_10
atgttggagtttagaacttggttatccatgttgtaaaacaacaaaagacgtagtttatactgataatagtggtgattggggtcttgaaaatggtgattggtgtggtatcgt

SEQ ID NO: 16027 - DNA, 108 bp, Neocallimastix californiae
  CBM_10
ttggatcaaagattacttttcttgttgtgatgagggagctgaagttatttacgaagatcataatggtaaatggggtatccaaggggctaatgattggtgtttaatagt

SEQ ID NO: 16028 - DNA, 93 bp, Neocallimastix californiae
  CBM_10
tttagcatatgaagattgtaaatcatgttatattcattatgaagatagtgatggttactggggatacaatggtgatgaatggtgtataattaa

SEQ ID NO: 16029 - DNA, 105 bp, Neocallimastix californiae
  CBM_10
ttggtcagagaaatatggttatccatgttgtccaaaatctaaagtaattacagttgataagcatggaaaatggggtattgaaaatggtgattattgtggtgtatc

SEQ ID NO: 16030 - DNA, 105 bp, Neocallimastix californiae
  CBM_10
atgtttcgctacaaaattaaattacaaatgttgttcaggttgtgatgttgctttcgttgataacgatggtaaatggggctatgaaaataacaattggtgtggttt

SEQ ID NO: 16031 - DNA, 105 bp, Neocallimastix californiae
  CBM_10
tttctctcttccagaatacccatgttgtacttcaactaaaactgtaatgtatactgatgaaaagggaccatggggtattgaaaatggtaactggtgtggtattca

SEQ ID NO: 16032 - DNA, 108 bp, Neocallimastix californiae
  CBM_10
atgtttctcaattaaattaggttatccatgttgtaatacatgtaatgttagcaccactgaccaagacggttcatggggtattgaaaataatcaatggtgtggtattaa

SEQ ID NO: 16033 - DNA, 111 bp, Neocallimastix californiae
  CBM_10
atgttggtctactgcattaggttattcatgttgtaaatcatgtttagctgccgttttctctgataatgatggtaaatgggcagttgaagaggataattggtgtggtattcc

SEQ ID NO: 16034 - DNA, 114 bp, Neocallimastix californiae
  CBM_10
ttgctgggctactaagcttggttataagtgttgtactgctaaatgtccagaagtttcttacgttgaccaagatggtgcttggggtgttgaaaacggtaactggtgtggtattac

SEQ ID NO: 16035 - DNA, 111 bp, Neocallimastix californiae
  CBM_10
ttgctgggctactaaacttggttttaactgttgtaagaacactagtgctgtttatgaaaccgatgctaatggccgttggggtattgaaaatggtaattggtgtggtattat

SEQ ID NO: 16036 - DNA, 96 bp, Neocallimastix californiae
  CBM_10
tcaaggttacccatgttgttccgctaactgtcaagttgtttacactgatgctgatggtgaatggggtgttgaaaatggtgactggtgtggttgtgg

SEQ ID NO: 16037 - DNA, 96 bp, Neocallimastix californiae
  CBM_10
ccaaggtttcccatgctgtgaatcctctaccattgtttactacactgatggtgatggtgactggagtgttgaaaataatgactggtgtatcattag

SEQ ID NO: 16038 - DNA, 108 bp, Neocallimastix californiae
  CBM_10
ttgctggtctactagcttaggttatccatgttgttctggtaatgaagttgtttacactgataatgatggtaagtggggtgttgaaaatggtaattggtgtggtattgc

SEQ ID NO: 16039 - DNA, 78 bp, Neocallimastix californiae
  CBM_10
ttgttctggtaacgaagttgtttacactgataatgatggtaagtggggtgttgaaaatggtaattggtgtggtattgc

SEQ ID NO: 16040 - DNA, 117 bp, Neocallimastix californiae
  CBM_10
ttcatcctccattaccaatcaaggttattcttgctgtagtagcagtaattgtaatataatctatactgataaggatggtaaatggggtgtagaaaataatacctggtgtggtattac

SEQ ID NO: 16041 - DNA, 117 bp, Neocallimastix californiae
  CBM_10
atgttcatcttctatcttaagccaaggatataaatgctgttcctctaaatgtactattgtttatgttgatgaagatggtacatggggtattgaaaatgatgaatggtgtggatgtaa

SEQ ID NO: 16042 - DNA, 114 bp, Neocallimastix californiae
  CBM_10
ttcagcttctattttaaaacaaggttattcttgctgctcatcaagatgtaccgttacatttactgacgaagatggagattggggtgttgaaaatggacaatggtgtggatgtgg

SEQ ID NO: 16043 - DNA, 105 bp, Neocallimastix californiae
  CBM_10
caataatactggatatgattgctgtgctgattctaatgctagagttcaatacactgatgaaagtggtaactggagtattgaaaatggtaattggtgtcttatttg

SEQ ID NO: 16044 - DNA, 73 bp, Neocallimastix californiae
  CBM_10
atgtttcagtatttcacttggttacccatgctgtcaaggaaacacagttgtatataccgataaggatggcaaa

SEQ ID NO: 16045 - DNA, 90 bp, Neocallimastix californiae
  CBM_10
tggttatgaatgctgcaaatcatgtaatatcgttttaacagatgaaagtggtaattggggtgttgaagacggtcaatggtgtggtattga

SEQ ID NO: 16046 - DNA, 111 bp, Neocallimastix californiae
  CBM_10
atgttgggctgctgaacaaggttatccatgttgtaccactactacagaagtagctttcgctgatgccagtggaaagtggggtattgaagatggaaactggtgtggtattat

SEQ ID NO: 16047 - DNA, 90 bp, Neocallimastix californiae
  CBM_10
tatttacccatgttgtcaaggatgtgtcgtagtcacttctgatagtgatggtgattggggtgttgaagatggtcaatggtgtttaattaa

SEQ ID NO: 16048 - DNA, 117 bp, Neocallimastix californiae
  CBM_10
atgttggtcagaaacttatggatacaaatgctgttctaaaggatgtagttccaacgtcttaacaaatgatgaatatggttattggggtgctgaaaatggtgaatggtgtggtatccc

SEQ ID NO: 16049 - DNA, 102 bp, Neocallimastix californiae
  CBM_10
tgcttcaaatcaaggctacagttgttgtaaagattgtactgttgtatacgaagatgaagctggtaaatggggtgtagaaaacgatcaatggtgtggaattga

SEQ ID NO: 16050 - DNA, 108 bp, Neocallimastix californiae
  CBM_10
atgttgggctactgctcaaggttatggatgttgtactggatgtgaagccatcatgactgatgataatagaaaatggggttttgaaaatggtaattggtgtggaattat

SEQ ID NO: 16051 - DNA, 108 bp, Neocallimastix californiae
  CBM_10
ttgggctgctgctgaaggatttaaatgctgtagtcccggcgtcaaatctattcttacagatagtaaaggttcatggggtattgaaaatgatgaatggtgtggtattgt

SEQ ID NO: 16052 - DNA, 93 bp, Neocallimastix californiae
  CBM_10
gcaaggttatccatgctgtaagaacaccaaggatgtttactatagagatgccgatggtaattggggtatcgaaaataataactggtgttacat

SEQ ID NO: 16053 - DNA, 99 bp, Neocallimastix californiae
  CBM_10
acaaggttacaagtgttgttccagcagtaactgtgttgttcaatatgttgatagtgatggttactgggctgttgaaaataaccaatggtgtggatgtgg

SEQ ID NO: 16054 - DNA, 117 bp, Neocallimastix californiae
  CBM_10
atgttctgctaacattttaaaacaaggttataaatgttgtccaagtggatgtgtcgttgtttttactgataatgatggtacttggggtgttaacaatggtgaatggtgtggatgtaa

SEQ ID NO: 16055 - DNA, 105 bp, Neocallimastix californiae
  CBM_10
tttcgcacttgatttaggttttaaatgttgtaatgatgccactgttgtttacactgatgattcaggtgactggggttacgttaataatgattggtgtggtattgg

SEQ ID NO: 16056 - DNA, 84 bp, Neocallimastix californiae
  CBM_10
tccatgttgtagtgaatgtactgttgtatacactgatgaatctggtgactggggtgttgaaaataatgaatggtgtttaattaa

SEQ ID NO: 16057 - DNA, 114 bp, Neocallimastix californiae
  CBM_10
ttgttgggcttcagctttaggttatccatgttgtagtagttcaagtgttactgtttatgaagaagattctaatggtaaatggggtattgaaaatgataattggtgtggtattcc

SEQ ID NO: 16058 - DNA, 105 bp, Neocallimastix californiae
  CBM_10
ttttgctattaaacttggttataaatgttgtaaaactactactgttaccatttatgaagataatgatggaccatggggtattgaaaatgatgaatggtgtggtct

SEQ ID NO: 16059 - DNA, 91 bp, Neocallimastix californiae
  CBM_10
ttgctggtcagaatctttcggttacccatgctgtcacagttgttacgtttttgaaactgatgacaatggtaagtggggttttgaaaacaac

SEQ ID NO: 16060 - DNA, 105 bp, Neocallimastix californiae
  CBM_10
atgttggactcttccagattacccatgttgtaaaggtaacactgttgtcttaactgatgtaaaaggtgattggggtgttgaaaacaacgcctggtgtggtattaa

SEQ ID NO: 16061 - DNA, 102 bp, Neocallimastix californiae
  CBM_10
ttggtcattaccacaatttccatgttgtaaaaacaatgtagtagtttacactgatggttctggtgattggggttttgaaaacaacaactggtgtggtattat

SEQ ID NO: 16062 - DNA, 57 bp, Neocallimastix californiae
  CBM_10
ttatacagacgaagacggaaactggggtgttgagaatgatcaatggtgcggatgtga

SEQ ID NO: 16063 - DNA, 93 bp, Neocallimastix californiae
  CBM_10
aggctattcatgctgtcctaaagattgtaaagttttatatactgatgaagaagggacttggggaattaacaattataaatggtgtatttgtaa

SEQ ID NO: 16064 - DNA, 93 bp, Neocallimastix californiae
  CBM_10
taattatccatgttgttcccttggttatgataaaattgtttattctgataaatatgcttattggggttttgaaaatggtgattggtgtgttat

SEQ ID NO: 16065 - DNA, 111 bp, Neocallimastix californiae
  CBM_10
atgctgggctactaaattaggttacccatgttgtactactacttcacaatcattattcactgatgaaaacggtgaatggggtgttgaaaacaatgactggtgtggtattag

SEQ ID NO: 16066 - DNA, 99 bp, Neocallimastix californiae
  CBM_10
acatccaaatggttatccatactgtaaacaaactaatgaagtagttttcactgatactgttgaatggggtgtagaaaatggtgcttggtgtgttataaa

SEQ ID NO: 16067 - DNA, 91 bp, Neocallimastix californiae
  CBM_10
atgttggtctcttgaatacggttacaaatgttgttcacactgtaaagttcttctcaaggatgactatggtaaatggggagaaatgaatggt

SEQ ID NO: 16068 - DNA, 114 bp, Neocallimastix californiae
  CBM_10
atgttggtctaaggcattaggttatgaatgctgttctaaagacaataccagagttgttgttagcgatgattctggtaaatggggtgttgaaaatggacaatggtgtggtattaa

SEQ ID NO: 16069 - DNA, 114 bp, Neocallimastix californiae
  CBM_10
ttgttggtccgaaagaaaaggtttcccatgttgttcttccaaagatactaaagttgattatgaagattcagatggtaaatggggtcatgaaaataatcaatggtgtggtataag

SEQ ID NO: 16070 - DNA, 105 bp, Neocallimastix californiae
  CBM_10
tttctcaatagatttaggttatccatgttgtaaaaaaacccaaaaagttgaatcaaaagatagtgatggtacctggggttatgaaaatggtggatggtgtggttt

SEQ ID NO: 16071 - DNA, 111 bp, Neocallimastix californiae
  CBM_10
ctgttggtcaaaggcttccggttttaactgttgtaagaactgtggtaaggtttacttcattgataaagatggtgaatggggtattgaaaacaatgactggtgtggtatgcc

SEQ ID NO: 16072 - DNA, 99 bp, Neocallimastix californiae
  CBM_10
taagggtgctcaaggatatccatgctgtgcctactcttgtgattcacttttcactgatagtgatggagaatggagtgttgaaaacgaaaattggtgttt

SEQ ID NO: 16073 - DNA, 96 bp, Neocallimastix californiae
  CBM_10
tactggctatgactgctgtcaatacacgaccattccaacctataccgataagcagggttactgggccatggaggatgaggaatggtgtatcattga

SEQ ID NO: 16074 - DNA, 93 bp, Neocallimastix californiae
  CBM_10
ggctaactacaagtgttgtaccaccacctgtgaagtctactactctgatgaatctggcgattggggggttgaggataatgattggtgttccat

SEQ ID NO: 16075 - DNA, 105 bp, Neocallimastix californiae
  CBM_10
ttgttggtcccttccagatttcccatgttgtaccggaaaggatatagtttattctgatggtagtggtgattggggttttgaaaatggcagttggtgtggtattgt

SEQ ID NO: 16076 - DNA, 111 bp, Neocallimastix californiae
  CBM_10
atgttggtctcttccagaatatccatgctgtactgacagtaatactccagtaatggaagaagatacacttggaaaatggggtattgaaaatggtagctggtgtggtattaa

SEQ ID NO: 16077 - DNA, 99 bp, Neocallimastix californiae
  CBM_10
aggttccggctattcctgttgtatatttgatacaacccctgtggtttccaaggataataccggctattggggtgttgaaaatggtcaatggtgtctctt

SEQ ID NO: 16078 - DNA, 117 bp, Neocallimastix californiae
  CBM_10
atgttggtctgaagcacaagactatccatgttgtaaggaaccgaccaccagtgttgtgagtaaagatagtaaaggctacttatggggtgttgaaaataatgaatggtgtggtattac

SEQ ID NO: 16079 - DNA, 105 bp, Neocallimastix californiae
  CBM_10
atgtttctcttacccagattacccatgttgtaaaagttgtgttgaagtttatgaagatgatttaggtaaatggggtattgaaaatgatgtatggtgtggtattaa

SEQ ID NO: 16080 - DNA, 78 bp, Neocallimastix californiae
  CBM_10
ttgtgaaggttgtaaagtaattcaagaagataaagatggtaaatggggttatgaaaataatgaatggtgtggtattaa

SEQ ID NO: 16081 - DNA, 90 bp, Neocallimastix californiae
  CBM_10
aagagaatataaatgttgtaaatcatgtgatattatttatacagacacctcagattggggagttgaagatgatgactggtgttctattcc

SEQ ID NO: 16082 - DNA, 111 bp, Neocallimastix californiae
  CBM_10
ttgctggtctcaagatcttggctatccatgttgccaaagcacagtcgatgttagatacaccgataaagatggattatggggtgtagaaaatggaaattggtgtggtattat

SEQ ID NO: 16083 - DNA, 106 bp, Neocallimastix californiae
  CBM_10
ttgtttctccattgacatgggttacccatgttgttcaacttgtactgtagtctacactgatagtgatggaggttggggtgttgaaaatggtgaatggtgtggtgtc

SEQ ID NO: 16084 - DNA, 108 bp, Neocallimastix californiae
  CBM_10
ttgttgggctcaaggtttaggttatccatgttgtgaaggttgtgaagcctcatttactgatggtgatggtgattgggctattgaaaatggtaactggtgtggtattga

SEQ ID NO: 16085 - DNA, 111 bp, Neocallimastix californiae
  CBM_10
atgttggtctcaatcccaaggatttccatgttgtagtccagacacaccagtcttttctacagatgaaagtggaaaatggggtattgaaaatgatgactggtgtggtattat

SEQ ID NO: 16086 - DNA, 111 bp, Neocallimastix californiae
  CBM_10
ttgttggtcagaattattaggttttccatgttgtgttggaactgttacagttgaatatactgatgaagatggtgaatggggtttacaaaatggtgattggtgtggtattcc

SEQ ID NO: 16087 - DNA, 108 bp, Neocallimastix californiae
  CBM_10
ctggtctactgcattaggttacccatgttgtaaaaactctagtattgtttatttcactgataatgatggtaaatggagtgttgaagataatgaatggtgtggtatttc

SEQ ID NO: 16088 - DNA, 76 bp, Neocallimastix californiae
  CBM_10
ctggtctactgcattaggttacccatgttgtaaaaactctagtattgtttatttcactgataatgatggtaaatgg

SEQ ID NO: 16089 - DNA, 120 bp, Neocallimastix californiae
  CBM_10
atgttggtctgaacagttaggttatccatgttgtaattcaggaaataaagaagtagtatttgaagatgaaaatggtaattggggaatcagccctaaaaccaatgattggtgtggtattcg

SEQ ID NO: 16090 - DNA, 93 bp, Neocallimastix californiae
  CBM_10
ttttaaatgctgttcttcaagtgatgccaaggtagaatatacagataatgatggtaaatggtctatagaagatggtaattggtgtggtatttt

SEQ ID NO: 16091 - DNA, 114 bp, Neocallimastix californiae
  CBM_10
atgttgggctttggaattaggatttgagtgttgtacttcagaagatattgaagttcaatacactgacaaagatggaaaatggggaattgaaaattatgaatggtgtggtattat

SEQ ID NO: 16092 - DNA, 96 bp, Neocallimastix californiae
  CBM_10
agatcaaggttattcttgttgtaaaacttgtacagtatcatatactgatgaaagtggtgaatggggtattgaaaacaaccattggtgtggtatttc

SEQ ID NO: 16093 - DNA, 45 bp, Neocallimastix californiae
  CBM_10
taatgatggtgattggggttttgaaaatgacaactggtgtggttt

SEQ ID NO: 16094 - DNA, 108 bp, Neocallimastix californiae
  CBM_10
tccaaatggtggtgaacagtactcttgctgtaagagtacctgtactccttccttatccgataatactggtgattgggctgttgaaaatggtgcctggtgttccattcc

SEQ ID NO: 16095 - DNA, 87 bp, Neocallimastix californiae
  CBM_10
ttatggatgttgtaagggttgtaaggtaagagctactgatagtactggtgaatggggttatgaaaatggtaaatggtgtggtattga

SEQ ID NO: 16096 - DNA, 108 bp, Neocallimastix californiae
  CBM_10
ttgctggtcaaatgcattaggatatgaatgttgtaaaggatgtactgtaattgaatcggatgcaagtggtgattggggtattgaaaataatcaatggtgtggtattcc

SEQ ID NO: 16097 - DNA, 108 bp, Neocallimastix californiae
  CBM_10
ttgttggtctaaaagtttaggatatgattgttgtaaagaatgtaatacagtttatactgatggtgatggtgattggggtttcgaaaataatcaatggtgtggaatttc

SEQ ID NO: 16098 - DNA, 81 bp, Neocallimastix californiae
  CBM_10
atgttgttcaaagtgtaatgttgtatacaccgatgatgagggtgattggggtttcgaaaaaggagcatggtgttctattag

SEQ ID NO: 16099 - DNA, 108 bp, Neocallimastix californiae
  CBM_10
ttgttgggctgaacaatatggatatgattgttgtaagcattgtaacgttacttatactgatgaaactggtgattggggtaaagaagatgatgcttggtgtggtatttt

SEQ ID NO: 16100 - DNA, 111 bp, Neocallimastix californiae
  CBM_10
atgttgggctaatgcctatggttatgactgctgtgttgatggtactcttacatacttagaagatgaaactggaaaatggggtgttacctctgactaccaatggtgtggtct

SEQ ID NO: 16101 - DNA, 90 bp, Neocallimastix californiae
  CBM_10
atgttgggctaatgcctatggttatgactgctgtgttgatggtactcttacatacttagaagatgaaactggaaaatggggtgttacctc

SEQ ID NO: 16102 - DNA, 111 bp, Neocallimastix californiae; identical to SEQ ID NO: 16100
  CBM_10

SEQ ID NO: 16103 - DNA, 111 bp, Neocallimastix californiae
  CBM_10
atgttggtctgctaaatttggttacaaatgttgtgattcatcaactgaaatttcatttgaagatgaaaagggaaaatggggtattgatggatcttcttggtgtggtatagt

SEQ ID NO: 16104 - DNA, 111 bp, Neocallimastix californiae
  CBM_10
atgtttctctgctaaattaggttactcatgttgtactactggaattgcttcagttaaaaatgatgaaaatggctattggggtattgaaaatgatgaatggtgtggtgttgc

SEQ ID NO: 16105 - DNA, 114 bp, Neocallimastix californiae
  CBM_10
cagtgctaagattactagtcagggttatccatgctgttcctctagctgtactgttgtctacactgatgaatctggtgactggggtgttgaaaacaatcaatggtgtggttgtgg

SEQ ID NO: 16106 - DNA, 102 bp, Neocallimastix californiae
  CBM_10
cggtgctcaaggttatccttgctgtaggactgccacatttgtttactacaccgatagtgatggtaattggagtgttgaaaacaatgattggtgtttaattcc

SEQ ID NO: 16107 - DNA, 105 bp, Neocallimastix californiae
  CBM_10
ctggtcaagtggctatggttattcctgttgtaaaacatgtaagatttactatacagatgatatcggtgaatggggtattgaaaatggacaatggtgtggtattgt

SEQ ID NO: 16108 - DNA, 102 bp, Neocallimastix californiae
  CBM_10
tttttcagagccattttatccatgctgtgaaaaaaatacagtagtatttactgataaacaagggaaatggggtattgaaaatggctcttggtgtggtatagg

SEQ ID NO: 16109 - DNA, 87 bp, Neocallimastix californiae
  CBM_10
agaatataaatgttgtaagggttgtgaagtcgtatacacggattctgaagattggggtattgaagatggtaaatggtgttctatccc

SEQ ID NO: 16110 - DNA, 117 bp, Neocallimastix californiae
  CBM_10
ctggtccgttagccttggttataaatgttgtaccctaagaacaacaaagccatattattattctaaatctgttgataaatggtacggtgtcgaaaataatgaatggtgtggtattat

SEQ ID NO: 16111 - DNA, 54 bp, Neocallimastix californiae
  CBM_10
tactgataacgatggagaatggggtataaacaatggagaatggtgcggatgtgg

SEQ ID NO: 16112 - DNA, 76 bp, Neocallimastix californiae
  CBM_10
atgtttctctattaaacttggttacccatgttgtcaaggtaatactgtttattatattgataatgatggacaatgg

SEQ ID NO: 16113 - DNA, 96 bp, Neocallimastix californiae
  CBM_10
tggtaccagttactcttgttgtgttttaactacaacggttgtcaccaccgatggtactggtaaatggggtattgaaggaaatcaatggtgtcttat

SEQ ID NO: 16114 - DNA, 93 bp, Neocallimastix californiae
  CBM_10
tgcttacagtaactgtacccatacttgtaacgttatagttactgaagatggcgttgaatggggagctgaaaaccaagattggtgtattattga

SEQ ID NO: 16115 - DNA, 102 bp, Neocallimastix californiae
  CBM_10
atgtttctctttcccacaataccactgttgtaatgaatgtaatgttgtattagaagatgaagaaggtaaatggggttttgaaaacaataaatggtgtggtct

SEQ ID NO: 16116 - DNA, 108 bp, Neocallimastix californiae
  CBM_10
ttgggcagaaaaattaggttatccttgttgttcttcttctaaagatgtattatttgaagatagtgatggacaatggagtgttgaaaacgataattggtgtggtattcc

SEQ ID NO: 16117 - DNA, 61 bp, Neocallimastix californiae
  CBM_10
tcaaggttatgaatgctgtccaagtgactgtgaaactatttatacagatgatgatggtgac

SEQ ID NO: 16118 - DNA, 93 bp, Neocallimastix californiae
  CBM_10
tgaatgttgtaataataatgaagttgtatatactgatgaaactggagattggggtttaactgatactgtacctcctcaatggtgtagtattgg

SEQ ID NO: 16119 - DNA, 78 bp, Neocallimastix californiae
  CBM_10
tccatattgtaatggatgtgaatccaattatactgatggagatggtgattggtatttcgttgataataattggtgtaa

SEQ ID NO: 16120 - DNA, 99 bp, Neocallimastix californiae
  CBM_10
caatggatatcaatgttgtaagaattcctctactgtagctgtttattcagataaggatggtgaatggggtgttgaaaataatgattggtgtattattcc

SEQ ID NO: 16121 - DNA, 102 bp, Neocallimastix californiae
  CBM_10
tggtgctgccggttatccatgttgtaaatcaagttgtaccgtttatgctgaagattctgacggtaaatggagtattgaaaatgataattggtgtttaattga

SEQ ID NO: 16122 - DNA, 111 bp, Neocallimastix californiae
  CBM_10
ttgttggtctgttggtttaggttattcttgttgtaaatcatgtatagctgccgtctatacagataatgatggtaaatggggagttgaaaatgataaatggtgtggtattcc

SEQ ID NO: 16123 - DNA, 70 bp, Neocallimastix californiae
  CBM_10
tactaaacaaggttacaaatgttgtagtagctgtagctttgtctactacactgatgaatcaggtgactgg

SEQ ID NO: 16124 - DNA, 114 bp, Neocallimastix californiae
  CBM_10
tcccgctgctattcgtaaccaaggttacaaatgttgtaaggctggttgtcaagttatttacaaagattctgatggtgattggggtgttgaaaacaaccaatggtgtggttgtgg

SEQ ID NO: 16125 - DNA, 90 bp, Neocallimastix californiae
  CBM_10
taagtgttgtagtgaaacttgtgaagtcaaaaaatttactaaatctggtaaagttttgggttatgaaaatggaaagtggtgttctattcc

SEQ ID NO: 16126 - DNA, 111 bp, Neocallimastix californiae
  CBM_10
ttgggcatacaaattaggttatcaatgttgtttaggagacaatgttaaaagtatatacaatgatgtagatggtgattggaattatcttaatggaagatggtgtggtattat

SEQ ID NO: 16127 - DNA, 106 bp, Neocallimastix californiae
  CBM_10
ttgtttttctgttgctcttggctatccatgttgtgaatcatcttgtaacgtatattacacagataatgatggtgaatggggtgtagaaaatggaaattggtgtggt

SEQ ID NO: 16128 - DNA, 60 bp, Neocallimastix californiae
  CBM_10
tgtctatgtcgataaagatggtgaatggggtgtagaaaatggaaattggtgtggtattgg

SEQ ID NO: 16129 - DNA, 96 bp, Neocallimastix californiae
  CBM_10
gggttataattgttgtaagtacagaagtactcctgtttatgaaaaggataatgatggtttatggggtattgaagataacgattggtgtggtgtcac

SEQ ID NO: 16130 - DNA, 93 bp, Neocallimastix californiae
  CBM_10
aggttatgaatgctgtccaagtgattgtgaagtcatttatacagataatgatggtgactggggtgttaacaacaatcaatggtgtggttgtgg

SEQ ID NO: 16131 - DNA, 108 bp, Neocallimastix californiae
  CBM_10
taatattaaagcccaaggttataaatgttgctctgctaattgtattgtttattacactgatgctgatggtgattggggtattgaaaatgatgaatggtgtggatgtgg

SEQ ID NO: 16132 - DNA, 96 bp, Neocallimastix californiae
  CBM_10
tggttataaatgttgtaagggtgaaaatgtaattcctattgtcactgaatctgtaggtcaatggggtatagaaaatgatgattggtgtggtattgt

SEQ ID NO: 16133 - DNA, 117 bp, Neocallimastix californiae
  CBM_10
atgttggtctgaagtagttggttattcatgctgtagttctaatgaaactacggtttatgctcatgatgataacggtgattggggttatgactttaataaacaagaatggtgtggtct

SEQ ID NO: 16134 - DNA, 81 bp, Neocallimastix californiae
  CBM_10
taattgttgtacaaaatgtgattatcgtttggaagatgaatatggtcaatggggttttgaaaatggtaaatggtgttcggt

SEQ ID NO: 16135 - DNA, 111 bp, Neocallimastix californiae
  CBM_10
atgttggtctctcccaagatatccatgttgttctaatgtcacaataactctaattaaggatatgtatggaaataaatggggtatggaaaataaaaattattgtggtatttt

SEQ ID NO: 16136 - DNA, 84 bp, Neocallimastix californiae
  CBM_10
tgaatgttgtcaaggttgtgaagtttttgaagaaactgaagaaggtaaatggggtgctgaaaatggtgaatggtgtggtattaa

SEQ ID NO: 16137 - DNA, 108 bp, Neocallimastix californiae
  CBM_10
atgtggagctgctgctatcggttacccatgttgtgaaaatacctgtactgaagtctacactgatgaatacagatggggtgttgaagatgatgaatggtgtggtattga

SEQ ID NO: 16138 - DNA, 109 bp, Neocallimastix californiae; identical to SEQ ID NO: 15442
  CBM_10

SEQ ID NO: 16139 - DNA, 88 bp, Neocallimastix californiae
  CBM_10
ttgttggtcacaacctctcggatatccatgttgttcttctccaaatgctgaagtttattacactgataacgatggtaagtggagtgtc

SEQ ID NO: 16140 - DNA, 103 bp, Neocallimastix californiae
  CBM_10
ttgttggtcacaacctctcggatatccatgttgttcttctccaaatgctgaagtttattacactgataacgatggtaagtggagtgtcgaaaacaacgattgg

SEQ ID NO: 16141 - DNA, 93 bp, Neocallimastix californiae
  CBM_10
tggtggtgaatatccttgctgtcaggaatgcaatgttttatacacggatactgaagattggggtatcgaaaatggtagctggtgttctattcc

SEQ ID NO: 16142 - DNA, 109 bp, Neocallimastix californiae
  CBM_10
ttgctggtctactgctgaaggttacccatgctgtaccccaggtactgcagttacacttactgatagtaagggtaaatggggtattgaaaacggaagctggtgtggtatt

SEQ ID NO: 16143 - DNA, 79 bp, Neocallimastix californiae
  CBM_10
ttgttggtcacaacctctcggatatccatgttgttcttctccaaatgctgaagtttattacactgataacgatggtaag

SEQ ID NO: 16144 - DNA, 114 bp, Neocallimastix californiae; identical to SEQ ID NO: 15140
  CBM_10

SEQ ID NO: 16145 - DNA, 114 bp, Neocallimastix californiae; identical to SEQ ID NO: 15140
  CBM_10

SEQ ID NO: 16146 - DNA, 105 bp, Neocallimastix californiae; identical to SEQ ID NO: 15153
  CBM_10

SEQ ID NO: 16147 - DNA, 114 bp, Neocallimastix californiae; identical to SEQ ID NO: 15140
  CBM_10

SEQ ID NO: 16148 - DNA, 114 bp, Neocallimastix californiae; identical to SEQ ID NO: 15140
  CBM_10

SEQ ID NO: 16149 - DNA, 114 bp, Neocallimastix californiae; identical to SEQ ID NO: 15140
  CBM_10

SEQ ID NO: 16150 - DNA, 97 bp, Neocallimastix californiae
  CBM_10
ttgttggtcacaacctctcggatatccatgttgttcttctccaaatgctgaagtttattacactgataacgatggtaagtggagtgtcgaaaacaac

SEQ ID NO: 16151 - DNA, 88 bp, Neocallimastix californiae; identical to SEQ ID NO: 16139
  CBM_10

SEQ ID NO: 16152 - DNA, 97 bp, Neocallimastix californiae
  CBM_10
ttggtcacttgatcatggttataaatgttgtaaaggtgaaaatgttgaagttgaatatactgattctaaaggtcaatggggtaaagaaaatggtgaa

SEQ ID NO: 16153 - DNA, 109 bp, Neocallimastix californiae; identical to SEQ ID NO: 15442
  CBM_10

SEQ ID NO: 16154 - DNA, 96 bp, Neocallimastix californiae
  CBM_10
ccaaggttatccatgttgtaagactgcaactgaagttttctacactgataatgatggtaactggggtgttgaaaatggacaatggtgtggttgtgg

SEQ ID NO: 16155 - DNA, 114 bp, Neocallimastix californiae; identical to SEQ ID NO: 15140
  CBM_10

SEQ ID NO: 16156 - DNA, 114 bp, Neocallimastix californiae; identical to SEQ ID NO: 15140
  CBM_10

SEQ ID NO: 16157 - DNA, 114 bp, Neocallimastix californiae; identical to SEQ ID NO: 15140
  CBM_10

SEQ ID NO: 16158 - DNA, 114 bp, Neocallimastix californiae; identical to SEQ ID NO: 15140
  CBM_10

SEQ ID NO: 16159 - DNA, 82 bp, Neocallimastix californiae; identical to SEQ ID NO: 15255
  CBM_10

SEQ ID NO: 16160 - DNA, 112 bp, Neocallimastix californiae
  CBM_10
ttgttggtcacaacctctcggatatccatgttgttcttctccaaatgctgaagtttattacactgataacgatggtaagtggagtgtcgaaaacaacgattggtgtggtatt

SEQ ID NO: 16161 - DNA, 103 bp, Neocallimastix californiae; identical to SEQ ID NO: 16140
  CBM_10

SEQ ID NO: 16162 - DNA, 114 bp, Neocallimastix californiae; identical to SEQ ID NO: 15140
  CBM_10

SEQ ID NO: 16163 - DNA, 114 bp, Neocallimastix californiae; identical to SEQ ID NO: 15140
  CBM_10

SEQ ID NO: 16164 - DNA, 88 bp, Neocallimastix californiae; identical to SEQ ID NO: 16139
  CBM_10

SEQ ID NO: 16165 - DNA, 94 bp, Neocallimastix californiae
  CBM_10
ttgttggtcacaacctctcggatatccatgttgttcttctccaaatgctgaagtttattacactgataacgatggtaagtggagtgtcgaaaac

SEQ ID NO: 16166 - DNA, 114 bp, Neocallimastix californiae; identical to SEQ ID NO: 15140
  CBM_10

SEQ ID NO: 16167 - DNA, 99 bp, Anaeromyces robustus; identical to SEQ ID NO: 15738
  CBM_10

SEQ ID NO: 16168 - DNA, 117 bp, Anaeromyces robustus; identical to SEQ ID NO: 15739
  CBM_10

SEQ ID NO: 16169 - DNA, 117 bp, Anaeromyces robustus; identical to SEQ ID NO: 15740
  CBM_10

SEQ ID NO: 16170 - DNA, 111 bp, Anaeromyces robustus; identical to SEQ ID NO: 15842
  CBM_10

SEQ ID NO: 16171 - DNA, 114 bp, Anaeromyces robustus
  CBM_10
ctgtttctctgttaaattaggatacccatgttgttctagtgccaatgttccagttgcttacactgataatgatggtaactggggtattgaaaatggtgattggtgtggtattcc

SEQ ID NO: 16172 - DNA, 114 bp, Anaeromyces robustus
  CBM_10
ttgctggtctgaaaaattaggtttcccatgttgttcatctccaagtgctccagttcaatacactgatgctgatggtaaatggagtgttgaaaatggtgactggtgtggtattcc

SEQ ID NO: 16173 - DNA, 90 bp, Anaeromyces robustus; identical to SEQ ID NO: 15856
  CBM_10

SEQ ID NO: 16174 - DNA, 108 bp, Anaeromyces robustus; identical to SEQ ID NO: 15855
  CBM_10

SEQ ID NO: 16175 - DNA, 108 bp, Anaeromyces robustus; identical to SEQ ID NO: 15854
  CBM_10

SEQ ID NO: 16176 - DNA, 111 bp, Anaeromyces robustus; identical to SEQ ID NO: 15868
  CBM_10

SEQ ID NO: 16177 - DNA, 108 bp, Anaeromyces robustus; identical to SEQ ID NO: 15869
  CBM_10

SEQ ID NO: 16178 - DNA, 82 bp, Anaeromyces robustus
  CBM_10
ttgttcttcaaagattactgctcaaggttataagtgctgttctgatccaaattgtactgtttactacactgatgccgatggt

SEQ ID NO: 16179 - DNA, 108 bp, Anaeromyces robustus; identical to SEQ ID NO: 15900
  CBM_10

SEQ ID NO: 16180 - DNA, 114 bp, Anaeromyces robustus; identical to SEQ ID NO: 15901
  CBM_10

SEQ ID NO: 16181 - DNA, 114 bp, Anaeromyces robustus; identical to SEQ ID NO: 15915
  CBM_10

SEQ ID NO: 16182 - DNA, 111 bp, Anaeromyces robustus; identical to SEQ ID NO: 15916
  CBM_10

SEQ ID NO: 16183 - DNA, 108 bp, Anaeromyces robustus; identical to SEQ ID NO: 15917
  CBM_10

SEQ ID NO: 16184 - DNA, 105 bp, Anaeromyces robustus; identical to SEQ ID NO: 15918
  CBM_10

SEQ ID NO: 16185 - DNA, 87 bp, Anaeromyces robustus; identical to SEQ ID NO: 15919
  CBM_10

SEQ ID NO: 16186 - DNA, 114 bp, Anaeromyces robustus; identical to SEQ ID NO: 15902
  CBM_10

SEQ ID NO: 16187 - DNA, 96 bp, Anaeromyces robustus; identical to SEQ ID NO: 15903
  CBM_10

SEQ ID NO: 16188 - DNA, 108 bp, Anaeromyces robustus; identical to SEQ ID NO: 15879
  CBM_10

SEQ ID NO: 16189 - DNA, 99 bp, Anaeromyces robustus; identical to SEQ ID NO: 15929
  CBM_10

SEQ ID NO: 16190 - DNA, 99 bp, Anaeromyces robustus; identical to SEQ ID NO: 15928
  CBM_10

SEQ ID NO: 16191 - DNA, 114 bp, Anaeromyces robustus; identical to SEQ ID NO: 15832
  CBM_10

SEQ ID NO: 16192 - DNA, 108 bp, Anaeromyces robustus; identical to SEQ ID NO: 15831
  CBM_10

SEQ ID NO: 16193 - DNA, 108 bp, Anaeromyces robustus; identical to SEQ ID NO: 15831
  CBM_10

SEQ ID NO: 16194 - DNA, 114 bp, Anaeromyces robustus; identical to SEQ ID NO: 15832
  CBM_10

SEQ ID NO: 16195 - DNA, 93 bp, Anaeromyces robustus; identical to SEQ ID NO: 15945
  CBM_10

SEQ ID NO: 16196 - DNA, 111 bp, Anaeromyces robustus; identical to SEQ ID NO: 15946
  CBM_10

SEQ ID NO: 16197 - DNA, 105 bp, Anaeromyces robustus; identical to SEQ ID NO: 15949
  CBM_10

SEQ ID NO: 16198 - DNA, 84 bp, Anaeromyces robustus; identical to SEQ ID NO: 15950
  CBM_10

SEQ ID NO: 16199 - DNA, 111 bp, Anaeromyces robustus; identical to SEQ ID NO: 15947
  CBM_10

SEQ ID NO: 16200 - DNA, 105 bp, Anaeromyces robustus; identical to SEQ ID NO: 15948
  CBM_10

SEQ ID NO: 16201 - DNA, 90 bp, Anaeromyces robustus
  CBM_10
ttattcatgttgtaaatcatgtgatagtttcaattacaaagataatgatggtgaatggggtatagaaaatgatgcctggtgtggtattcc

SEQ ID NO: 16202 - DNA, 105 bp, Anaeromyces robustus
  CBM_10
taaaggtgctttaggttatccatgttgtaaatctacatgtaatgtttactcatctgatgaaagtggtcaatggggtatagaaaatgatgcctggtgtggtattcc

SEQ ID NO: 16203 - DNA, 105 bp, Anaeromyces robustus
  CBM_10
taaaggtgctttaggttattcatgttgtaaatcatgtgatagtttcaattacaaagataatgatggtgaatggggtatagaaaatgatgcctggtgtggtattcc

SEQ ID NO: 16204 - DNA, 114 bp, Anaeromyces robustus; identical to SEQ ID NO: 15934
  CBM_10

SEQ ID NO: 16205 - DNA, 108 bp, Anaeromyces robustus; identical to SEQ ID NO: 15935
  CBM_10

SEQ ID NO: 16206 - DNA, 96 bp, Anaeromyces robustus; identical to SEQ ID NO: 15936
  CBM_10

SEQ ID NO: 16207 - DNA, 114 bp, Anaeromyces robustus; identical to SEQ ID NO: 15960
  CBM_10

SEQ ID NO: 16208 - DNA, 108 bp, Anaeromyces robustus; identical to SEQ ID NO: 15959
  CBM_10

SEQ ID NO: 16209 - DNA, 114 bp, Anaeromyces robustus; identical to SEQ ID NO: 15995
  CBM_10

SEQ ID NO: 16210 - DNA, 108 bp, Anaeromyces robustus; identical to SEQ ID NO: 15996
  CBM_10

SEQ ID NO: 16211 - DNA, 105 bp, Anaeromyces robustus; identical to SEQ ID NO: 15970
  CBM_10

SEQ ID NO: 16212 - DNA, 90 bp, Anaeromyces robustus; identical to SEQ ID NO: 15971
  CBM_10

SEQ ID NO: 16213 - DNA, 108 bp, Anaeromyces robustus; identical to SEQ ID NO: 16012
  CBM_10

SEQ ID NO: 16214 - DNA, 105 bp, Anaeromyces robustus
  CBM_10
atgtgaatttaatgctcttggttactcttgttgtccagatgctgctgttgtctttgaagatgatcacaaatggggttacgttaacaataaatggtgtggtgtttc

SEQ ID NO: 16215 - DNA, 111 bp, Anaeromyces robustus; identical to SEQ ID NO: 16013
  CBM_10

SEQ ID NO: 16216 - DNA, 102 bp, Anaeromyces robustus; identical to SEQ ID NO: 15972
  CBM_10

SEQ ID NO: 16217 - DNA, 105 bp, Anaeromyces robustus; identical to SEQ ID NO: 15973
  CBM_10

SEQ ID NO: 16218 - DNA, 96 bp, Anaeromyces robustus; identical to SEQ ID NO: 15962
  CBM_10

SEQ ID NO: 16219 - DNA, 105 bp, Anaeromyces robustus; identical to SEQ ID NO: 15961
  CBM_10

SEQ ID NO: 16220 - DNA, 105 bp, Anaeromyces robustus; identical to SEQ ID NO: 15976
  CBM_10

SEQ ID NO: 16221 - DNA, 111 bp, Anaeromyces robustus; identical to SEQ ID NO: 15975
  CBM_10

SEQ ID NO: 16222 - DNA, 108 bp, Anaeromyces robustus; identical to SEQ ID NO: 16003
  CBM_10

SEQ ID NO: 16223 - DNA, 109 bp, Anaeromyces robustus
  CBM_10
atgttggtcaaaggctcaaggttatgattgttgtgctgaaggaacttccgttttccttgaagatgaaagtggaaaatggggtgttactccaaatggtttatggtgtggc

SEQ ID NO: 16224 - DNA, 117 bp, Anaeromyces robustus; identical to SEQ ID NO: 16004
  CBM_10

SEQ ID NO: 16225 - DNA, 111 bp, Anaeromyces robustus; identical to SEQ ID NO: 16026
  CBM_10

SEQ ID NO: 16226 - DNA, 108 bp, Anaeromyces robustus; identical to SEQ ID NO: 16027
  CBM_10

SEQ ID NO: 16227 - DNA, 93 bp, Anaeromyces robustus; identical to SEQ ID NO: 16028
  CBM_10

SEQ ID NO: 16228 - DNA, 108 bp, Anaeromyces robustus; identical to SEQ ID NO: 16027
  CBM_10

SEQ ID NO: 16229 - DNA, 96 bp, Anaeromyces robustus; identical to SEQ ID NO: 16037
  CBM_10

SEQ ID NO: 16230 - DNA, 96 bp, Anaeromyces robustus; identical to SEQ ID NO: 16036
  CBM_10

SEQ ID NO: 16231 - DNA, 105 bp, Anaeromyces robustus; identical to SEQ ID NO: 16030
  CBM_10

SEQ ID NO: 16232 - DNA, 105 bp, Anaeromyces robustus; identical to SEQ ID NO: 16031
  CBM_10

SEQ ID NO: 16233 - DNA, 108 bp, Anaeromyces robustus; identical to SEQ ID NO: 16032
  CBM_10

SEQ ID NO: 16234 - DNA, 108 bp, Anaeromyces robustus; identical to SEQ ID NO: 16097
  CBM_10

SEQ ID NO: 16235 - DNA, 108 bp, Anaeromyces robustus; identical to SEQ ID NO: 16096
  CBM_10

SEQ ID NO: 16236 - DNA, 105 bp, Anaeromyces robustus
  CBM_10
ctggtcatctgcaatgggatatgcctgttgtaatggctgtgatgtagcatatgaagatggatctggaaaatggggtattgaaaataataattggtgtggtataga

SEQ ID NO: 16237 - DNA, 102 bp, Anaeromyces robustus; identical to SEQ ID NO: 16061
  CBM_10

SEQ ID NO: 16238 - DNA, 105 bp, Anaeromyces robustus; identical to SEQ ID NO: 16060
  CBM_10

SEQ ID NO: 16239 - DNA, 90 bp, Anaeromyces robustus; identical to SEQ ID NO: 16047
  CBM_10

SEQ ID NO: 16240 - DNA, 90 bp, Anaeromyces robustus; identical to SEQ ID NO: 16045
  CBM_10

SEQ ID NO: 16241 - DNA, 111 bp, Anaeromyces robustus; identical to SEQ ID NO: 16046
  CBM_10

SEQ ID NO: 16242 - DNA, 105 bp, Anaeromyces robustus; identical to SEQ ID NO: 16043
  CBM_10

SEQ ID NO: 16243 - DNA, 96 bp, Anaeromyces robustus
  CBM_10
taagaatggttatcctgtttgtaaaacaactactactgttgtctacaccgactctgataagtggggtgttgaaaatggtgaatggtgtattatgtg

SEQ ID NO: 16244 - DNA, 108 bp, Anaeromyces robustus
  CBM_10
atgtttcagtatttcacttggttacccatgctgtcaaggaaacacagttgtatataccgataaggatggcaaatggggattagaaaatggtcaatggtgtggtattgc

SEQ ID NO: 16245 - DNA, 108 bp, Anaeromyces robustus
  CBM_10
ttgctggtcagaatctttcggttacccatgctgtcacagttgttacgtttttgaaactgatgacaatggtaagtggggttttgaaaacaacacctggtgtggtattca

SEQ ID NO: 16246 - DNA, 105 bp, Anaeromyces robustus; identical to SEQ ID NO: 15977
  CBM_10

SEQ ID NO: 16247 - DNA, 117 bp, Anaeromyces robustus; identical to SEQ ID NO: 15978
  CBM_10

SEQ ID NO: 16248 - DNA, 93 bp, Anaeromyces robustus; identical to SEQ ID NO: 16052
  CBM_10

SEQ ID NO: 16249 - DNA, 99 bp, Anaeromyces robustus; identical to SEQ ID NO: 16053
  CBM_10

SEQ ID NO: 16250 - DNA, 108 bp, Anaeromyces robustus
  CBM_10
ttgttggtctaaatctttaggttacccatgttgtacctcaaaatctactgttatattcactgattctaacggtcaatggggtattgaaaatggtaactggtgtggtaa

SEQ ID NO: 16251 - DNA, 114 bp, Anaeromyces robustus
  CBM_10
ttgggctaaatctcttggttacaactgttgttctacaagtagttgtagaactgctcaattcagcgatgctgatggtcaatgggatgttgaaaatggtaattggtgtggtattac

SEQ ID NO: 16252 - DNA, 111 bp, Anaeromyces robustus; identical to SEQ ID NO: 16076
  CBM_10

SEQ ID NO: 16253 - DNA, 105 bp, Anaeromyces robustus; identical to SEQ ID NO: 16075
  CBM_10

SEQ ID NO: 16254 - DNA, 108 bp, Anaeromyces robustus
  CBM_10
ttgtttttctgaagcctctggatatggctgttgtaaaggatgtgatgtagcttatactgatgatagtggtgattggggtgttgaaaatggtgaatggtgtggtattcc

SEQ ID NO: 16255 - DNA, 105 bp, Anaeromyces robustus
  CBM_10
tactggtgcccaaggttacccatgttgtaaaactgctacccaagtttacttcagtgataatgatggtgactggagtgttgaaaacaataactggtgtttaattcc

SEQ ID NO: 16256 - DNA, 117 bp, Anaeromyces robustus; identical to SEQ ID NO: 16009
  CBM_10

SEQ ID NO: 16257 - DNA, 114 bp, Anaeromyces robustus; identical to SEQ ID NO: 16068
  CBM_10

SEQ ID NO: 16258 - DNA, 108 bp, Anaeromyces robustus
  CBM_10
atgttggtctcttgaatacggttacaaatgttgttcacactgtaaagttcttctcaaggatgactatggtaaatggggagaaatgaatggtcaatggtgtggtattga

SEQ ID NO: 16259 - DNA, 108 bp, Anaeromyces robustus; identical to SEQ ID NO: 15974
  CBM_10

SEQ ID NO: 16260 - DNA, 96 bp, Anaeromyces robustus
  CBM_10
tcatccagattatgaatgttgtaaaggatgtcaaacaattttaaccgatgatgaaggtaattggggtgctgaaaataatcaatggtgtttcattga

SEQ ID NO: 16261 - DNA, 108 bp, Anaeromyces robustus; identical to SEQ ID NO: 16050
  CBM_10

SEQ ID NO: 16262 - DNA, 108 bp, Anaeromyces robustus; identical to SEQ ID NO: 16051
  CBM_10

SEQ ID NO: 16263 - DNA, 102 bp, Anaeromyces robustus; identical to SEQ ID NO: 16049
  CBM_10

SEQ ID NO: 16264 - DNA, 105 bp, Anaeromyces robustus
  CBM_10
atgtttctctgacccagattatccatgttgtgaaggttgtaaagtaattcaagaagataaagatggtaaatggggttatgaaaataatgaatggtgtggtattaa

SEQ ID NO: 16265 - DNA, 75 bp, Anaeromyces robustus
  CBM_10
tagtacttgtagagtagtaacagttgatgataatatttattggggtgtagaaaacaatgactggtgcattgttcc

SEQ ID NO: 16266 - DNA, 105 bp, Anaeromyces robustus; identical to SEQ ID NO: 16079
  CBM_10

SEQ ID NO: 16267 - DNA, 96 bp, Anaeromyces robustus
  CBM_10
taacccagattatccatgttgtaataattgtgaagtaatttacgttgattcagatggagaatggggtgtagaaaataataattggtgtgctattga

SEQ ID NO: 16268 - DNA, 90 bp, Anaeromyces robustus
  CBM_10
tgattatccattctgtaagggttgtacagtagtatatactgataatgatggtgattggggtgtagaaaataatgattggtgtcttattaa

SEQ ID NO: 16269 - DNA, 102 bp, Anaeromyces robustus
  CBM_10
atcacttggttattcatgttgtagtgataataactgtactgtttatgccaccgatgaatctggtaaatggggtattgaaaatgaccaatggtgtggtatttc

SEQ ID NO: 16270 - DNA, 117 bp, Anaeromyces robustus; identical to SEQ ID NO: 16054
  CBM_10

SEQ ID NO: 16271 - DNA, 96 bp, Anaeromyces robustus
  CBM_10
gaatcttggatacaaatgttgtcaatattgtgatatagtatatactgatagtgatggtgattatggtttcgaaaataatgactggtgtggtattgc

SEQ ID NO: 16272 - DNA, 99 bp, Anaeromyces robustus; identical to SEQ ID NO: 16066
  CBM_10

SEQ ID NO: 16273 - DNA, 111 bp, Anaeromyces robustus; identical to SEQ ID NO: 16065
  CBM_10

SEQ ID NO: 16274 - DNA, 114 bp, Anaeromyces robustus; identical to SEQ ID NO: 16057
  CBM_10

SEQ ID NO: 16275 - DNA, 105 bp, Anaeromyces robustus; identical to SEQ ID NO: 16058
  CBM_10

SEQ ID NO: 16276 - DNA, 90 bp, Anaeromyces robustus
  CBM_10
ttacccatgctgtaaaactaacaagcaagtttacttcactgataatgatggtaactggagtttcgaaaacaacaactggtgtttaatcaa

SEQ ID NO: 16277 - DNA, 117 bp, Anaeromyces robustus
  CBM_10
ttccgctaagattcaagctcaaggttacaaatgctgttctgacaagaattgtactatcttctactccgataatgatggtaattggggtgttgaaaatggacaatggtgtggttgtga

SEQ ID NO: 16278 - DNA, 108 bp, Anaeromyces robustus
  CBM_10
ttggagtatgccagattaccaatgttgtagaaatactagagtaagtcaatacactgactcagctggtaatgaatggggtatcgaaaacaatcaatggtgtggtattat

SEQ ID NO: 16279 - DNA, 93 bp, Anaeromyces robustus
  CBM_10
tggttacaactgttgtagaaacacttgtagtatttcatacaaagatgatgatggtaattggggtattgaaaacggtaattggtgtggtattcc

SEQ ID NO: 16280 - DNA, 108 bp, Anaeromyces robustus; identical to SEQ ID NO: 16084
  CBM_10

SEQ ID NO: 16281 - DNA, 108 bp, Anaeromyces robustus
  CBM_10
ttgtttctccattgacatgggttacccatgttgttcaacttgtactgtagtctacactgatagtgatggaggttggggtgttgaaaatggtgaatggtgtggtgtccc

SEQ ID NO: 16282 - DNA, 111 bp, Anaeromyces robustus; identical to SEQ ID NO: 16122
  CBM_10

SEQ ID NO: 16283 - DNA, 102 bp, Anaeromyces robustus; identical to SEQ ID NO: 16121
  CBM_10

SEQ ID NO: 16284 - DNA, 114 bp, Anaeromyces robustus
  CBM_10
atgttggtcggaaaaattaggttatccatgttgtaaaaacagtaatactgatgttgcttatatcgatgcagacggtaaatggggtgttgaaaatcatgaatggtgtggtattac

SEQ ID NO: 16285 - DNA, 93 bp, Anaeromyces robustus; identical to SEQ ID NO: 16064
  CBM_10

SEQ ID NO: 16286 - DNA, 108 bp, Anaeromyces robustus
  CBM_10
ttggtcacaaccattaggatatccatgttgttctagtagtaataaaaatgtcatttacaccgataaagatggtgactggggtattgaaaataatggttggtgtggttt

SEQ ID NO: 16287 - DNA, 114 bp, Anaeromyces robustus
  CBM_10
ttctgatgctatattaaagaaaggatataaatgttgttcaaatgattgtttcgtaatctatactgatgatgatggtacatggggtattgaaaatgatcaatggtgtggttgtga

SEQ ID NO: 16288 - DNA, 117 bp, Anaeromyces robustus
  CBM_10
tccaacttctattacttctcaaggttatagatgttgtaaagaaaataactgttcagttattgaaactgatgactctggtaaatggggtattgaagatggacaatggtgtggtatttc

SEQ ID NO: 16289 - DNA, 108 bp, Anaeromyces robustus; identical to SEQ ID NO: 16116
  CBM_10

SEQ ID NO: 16290 - DNA, 111 bp, Anaeromyces robustus
  CBM_10
atgttggtcagaaaaattaggttatccatgttgttcatattctaaaaatgtattatttgaagataatgatggtcaatggagtgttgaaaatgataattggtgtggtattcc

SEQ ID NO: 16291 - DNA, 99 bp, Anaeromyces robustus
  CBM_10
tgctcaaggttatccttgctgtaggactgccacatttgtttactacaccgatagtgatggtaattggagtgttgaaaacaatgattggtgtttaattcc

SEQ ID NO: 16292 - DNA, 114 bp, Anaeromyces robustus; identical to SEQ ID NO: 16105
  CBM_10

SEQ ID NO: 16293 - DNA, 91 bp, Anaeromyces robustus
  CBM_10
aggttacccatgttgtaagaataataagactgtttatttcactgataattctggtaaatggagtgttgaaaataacaactggtgtttaatt

SEQ ID NO: 16294 - DNA, 117 bp, Anaeromyces robustus
  CBM_10
ttcttctaagattactaaacaaggttacaaatgttgttcatcaaagagctgtattgtttattacactgataatgccggtaattggggtgttgaaaatggagaatggtgtggatgtgc

SEQ ID NO: 16295 - DNA, 108 bp, Anaeromyces robustus
  CBM_10
atgttggtctagcggttatggttacccatgttgtgataactgtaaggtttattacattgataaaattggagaatggggtattaagaatggtaattggtgtggtattgt

SEQ ID NO: 16296 - DNA, 108 bp, Anaeromyces robustus
  CBM_10
atgttgggctagttggtatggttatggatgttgtaagggttgtaaggtaagagctactgatagtactggtgaatggggttatgaaaatggtaaatggtgtggtattga

SEQ ID NO: 16297 - DNA, 108 bp, Anaeromyces robustus
  CBM_10
ttgttggtctgaagaattaggatacaagtgttgtaagggttgtaaggtatacagtgttgatcgtaacggttcatggggtgttgaagataaacaatggtgtggtattga

SEQ ID NO: 16298 - DNA, 105 bp, Anaeromyces robustus
  CBM_10
ttgggctagttggtatggttatgaatgttgtaaaggttgtaaagtcaaaggtgaagatagtaaaggtaaatggggttgggaaaatggtaaatggtgtggtattga

SEQ ID NO: 16299 - DNA, 108 bp, Anaeromyces robustus
  CBM_10
atgttggtctgaatcaaagggttactcatgttgtaaaggatgtgatatctacaccaatgatagatttggtgcttggggtattgaaaagggaaaatggtgtggtattaa

SEQ ID NO: 16300 - DNA, 90 bp, Anaeromyces robustus
  CBM_10
tggatatccatgttgtaaaaagtgtgatgtttacagttacgatagacatggttactggggtattgaaaagggaaactggtgtggtattga

SEQ ID NO: 16301 - DNA, 84 bp, Anaeromyces robustus
  CBM_10
tccatgctgtagtcactgtaatggtatttaccatgataacgatggtgactggggtgttgaaaataaccaatggtgtttaattaa

SEQ ID NO: 16302 - DNA, 102 bp, Anaeromyces robustus
  CBM_10
tttcgctattaagttaggttataagtgttgtaataatgaagccgttgttcttgttgataatgatggtaaatggggttacaatggtgattggtgtggtattgg

SEQ ID NO: 16303 - DNA, 99 bp, Anaeromyces robustus
  CBM_10
taaatctacttcctacccatgttgttcaagctgtaatttaccagtttattctaccgatagtgatggtaaatggagtattgaaaacaataactggtgtaa

SEQ ID NO: 16304 - DNA, 108 bp, Anaeromyces robustus
  CBM_10
atgctggtcagaagaacttggctacaaatgctgtaaatattgtaatgtcttaatggaagatgaaaatggacaatggggttttgaaaatgatgaatggtgtggtataac

SEQ ID NO: 16305 - DNA, 105 bp, Anaeromyces robustus
  CBM_10
atgtttcgcttcaccaacatacccatgttgttcaaagtgtaatgttgtatacaccgatgatgagggtgattggggtttcgaaaaaggagcatggtgttctattag

SEQ ID NO: 16306 - DNA, 108 bp, Anaeromyces robustus; identical to SEQ ID NO: 16099
  CBM_10

SEQ ID NO: 16307 - DNA, 105 bp, Anaeromyces robustus
  CBM_10
taagggtgctcaaggatatccatgctgtgcctactcttgtgattcacttttcactgatagtgatggagaatggagtgttgaaaacgaaaattggtgtttaattaa

SEQ ID NO: 16308 - DNA, 111 bp, Anaeromyces robustus; identical to SEQ ID NO: 16071
  CBM_10

SEQ ID NO: 16309 - DNA, 108 bp, Anaeromyces robustus
  CBM_10
ctgctggtctgaagctttaggttatccatgttgtaaaggttgtgaaagtgcaaccactgattcatctggtgcttggggtattgaagatggtgaatggtgtggtattcc

SEQ ID NO: 16310 - DNA, 84 bp, Anaeromyces robustus
  CBM_10
atacagtaattgtaaaagtacttgcgaagtctcttatgaagatgaccaaaaatggggtattgaaaatggacaatggtgtattct

SEQ ID NO: 16311 - DNA, 108 bp, Anaeromyces robustus
  CBM_10
ttgctggtctattgcttttggttatggatgttgtgaaggatgtactactgtttacactgataaagatggtgcttggggatatgaaaatgaaaattggtgtggtattaa

SEQ ID NO: 16312 - DNA, 87 bp, Anaeromyces robustus
  CBM_10
tccatgctgttctaagggtgctgaagttatttacactgatgaatcaggtgattggggattagaaaatggtgactggtgctttattaa

SEQ ID NO: 16313 - DNA, 108 bp, Anaeromyces robustus
  CBM_10
ttgttggtctgctccttatggttatccatgctgtaagtcatgcgaaattcataccactaatgattccggaaaatggggtatggaaaataataaatggtgtggtattcc

SEQ ID NO: 16314 - DNA, 108 bp, Anaeromyces robustus
  CBM_10
ttgtactggtattgaggatggttatccatgttgtaagacatgtaatgctatttacaatgatgaacaaggaccatggggttatgaaaataatgaatggtgtggtatcaa

SEQ ID NO: 16315 - DNA, 99 bp, Anaeromyces robustus
  CBM_10
ttcaaaggatggttatccatgctgtaaaggttgttcagtaacttacgaagatgccagtggtaaatggggtgtcgaaaataatgcttggtgtggtattga

SEQ ID NO: 16316 - DNA, 111 bp, Anaeromyces robustus
  CBM_10
ttgctggtctactgctgaaggttacccatgctgtaccccaggtactgcagttacacttactgatagtaagggtaaatggggtattgaaaacggaagctggtgtggtattac

SEQ ID NO: 16317 - DNA, 108 bp, Anaeromyces robustus
  CBM_10
atgctgggcttcttctcttggttacggttgttgtaatggttgtgaagctattactgttgatggtagtggtaaatggggtttcgaaaatggagcctggtgtggtattat

SEQ ID NO: 16318 - DNA, 99 bp, Anaeromyces robustus; identical to SEQ ID NO: 16315
  CBM_10

SEQ ID NO: 16319 - DNA, 79 bp, Anaeromyces robustus
  CBM_10
ttgctggtctactgctgaaggttacccatgctgtaccccaggtactgcagttacacttactgatagtaagggtaaatgg

SEQ ID NO: 16320 - DNA, 114 bp, Anaeromyces robustus
  CBM_10
ttgctggtcaactaaattaggatatccatgttgtagtgccggtaacaaagatgtttattataatgacgatgatggattatggggtgttgaaaatggtgattggtgtggcattcc

SEQ ID NO: 16321 - DNA, 108 bp, Anaeromyces robustus
  CBM_10
ttgtttctccattgctcttggctatccatgctgtaaaggaaatacaattgtttacactgatgatagcggagactggggtgttgaaaataataactggtgtggtattcc

SEQ ID NO: 16322 - DNA, 96 bp, Anaeromyces robustus
  CBM_10
tggatatcaatgttgtaagaattcctctactgtagctgtttattcagataaggatggtgaatggggtgttgaaaataatgattggtgtattattcc

SEQ ID NO: 16323 - DNA, 78 bp, Anaeromyces robustus; identical to SEQ ID NO: 16119
  CBM_10

SEQ ID NO: 16324 - DNA, 114 bp, Anaeromyces robustus
  CBM_10
tccaggttatgaattaggatatgaatgttgtaataataatgaagttgtatatactgatgaaactggagattggggtttaactgatactgtacctcctcaatggtgtagtattgg

SEQ ID NO: 16325 - DNA, 105 bp, Anaeromyces robustus
  CBM_10
atgtttctcttatccattatatccatgttgtgaaggatgtaatgtttatgaagaaaccgaagaaggtaaatggggtattgaaaatgatgcttggtgtggtgttaa

SEQ ID NO: 16326 - DNA, 84 bp, Anaeromyces robustus
  CBM_10
atatgacgaatgtaaaggttgtactgtgtattatgaggatgatacaaaatggggtgttgaaaatgacgactggtgtattattcc

SEQ ID NO: 16327 - DNA, 111 bp, Anaeromyces robustus
  CBM_10
atgttggtctgaaagattaggttacccatgttgtaccagtggtgctcaagtttattacagtgatgctgatggtcaatggggtgttgaaaacaataactggtgtggtattat

SEQ ID NO: 16328 - DNA, 108 bp, Anaeromyces robustus
  CBM_10
tttcgccaccaaattaggttacccatgttgtactactactactgaagttgtttacactgatagtgatggtcaatggggtgttgaaaacaataactggtgtggtattaa

SEQ ID NO: 16329 - DNA, 105 bp, Anaeromyces robustus
  CBM_10
tttctcaattcaaatgggatatccatgttgtaatggttgtgatgttgtatcctttgatgatggtaaaccatggggtattgaaaacggaaattggtgtggtattaa

SEQ ID NO: 16330 - DNA, 108 bp, Anaeromyces robustus
  CBM_10
atgtttctcacttccagattacccatgttgttcttcatctgttggagtttccttcgttgatgaaagtggttcatggggtattgaaaatggtaattggtgtggtattcc

SEQ ID NO: 16331 - DNA, 108 bp, Anaeromyces robustus
  CBM_10
atgtttcgctgctaaacttaattacaagtgctgttctacttgtgatgtagcttatactgatggtgatggtgattggggtttcgaaaataatgaatggtgtggtattaa

SEQ ID NO: 16332 - DNA, 114 bp, Anaeromyces robustus
  CBM_10
atgtttttcccaaaagttaaatccatcctacccatgttgtgaaggtgatgtcgttgtctatgtcgataaagatggtgaatggggtgtagaaaatggaaattggtgtggtattgg

SEQ ID NO: 16333 - DNA, 108 bp, Anaeromyces robustus
  CBM_10
ttgtttttctgttgctcttggctatccatgttgtgaatcatcttgtaacgtatattacacagataatgatggtgaatggggtgtagaaaatggaaattggtgtggttt

SEQ ID NO: 16334 - DNA, 102 bp, Anaeromyces robustus
  CBM_10
ttggtctcttccagattacccatgttgtgaaggcactgatgttgtatacagtgatgcttctggtgattggggtgttgaaaatggtcaatggtgtggtattgt

SEQ ID NO: 16335 - DNA, 96 bp, Anaeromyces robustus
  CBM_10
tccagattacccatgttgtaaagaaggggccgaagctatctatgaagatgctcaaggaaaatggggtgtagaaaatggtcaatggtgtggaattga

SEQ ID NO: 16336 - DNA, 108 bp, Anaeromyces robustus
  CBM_10
atgctgggctttgcaatatggatatacatgttgtgaagatgatacaatagtatacactgatgaactcggtgattggggtgttgaagatggtcaatggtgtggtattaa

SEQ ID NO: 16337 - DNA, 111 bp, Anaeromyces robustus
  CBM_10
ctgctggtcgactgctcttaattatccatgttgtaaaaatagttgtgacgttgttatttcagatgacgatggtgattggggtgttgaagatggtcaatggtgtggtataac

SEQ ID NO: 16338 - DNA, 102 bp, Anaeromyces robustus
  CBM_10
ttgctggtctttaccagattacaagtgctgttcaggatgtgacattgtctacactgataaccacaactggggtgttgaaaatggtgaatggtgtggtattga

SEQ ID NO: 16339 - DNA, 105 bp, Anaeromyces robustus
  CBM_10
tgctgttctttctcaaggttacccatgttgtcaacaaacttgtgatgtcgtctatgtagatgactacaaatggggtgttgaaaatggtgaatggtgtggtattaa

SEQ ID NO: 16340 - DNA, 123 bp, Anaeromyces robustus
  CBM_10
ttgggctaaagcattaggatttaaatgttgtgatgaagaaaatccacaagtttattatacagatgaaagtggtgattggagtgttgaatttaaaggagattcaggtgaatggtgtggtattat

SEQ ID NO: 16341 - DNA, 111 bp, Anaeromyces robustus
  CBM_10
ttgttggtctcaacctcttggttacccatgttgtcaaagtacaagtgatgttatttacactgatagtgatggtgactggggtgttgaaaatggtaattggtgtggtataat

SEQ ID NO: 16342 - DNA, 108 bp, Anaeromyces robustus
  CBM_10
ttgttgggcaaatagacttggttaccaatgttgtaaaggtaatactgtagtatacactgatagtgatggaaaatggggtgttgaaaatggtaattggtgtggtatcgt

SEQ ID NO: 16343 - DNA, 102 bp, Anaeromyces robustus
  CBM_10
tgctggttacccagaatatccatgctgtaaaggttgtgatatttcttacagtgatgaaagtggtgattggggtgttgaaaatggcaaatggtgtggtattaa

SEQ ID NO: 16344 - DNA, 105 bp, Anaeromyces robustus
  CBM_10
ttgcttctctgaaccagattatccatgctgtaattcatgtaatattgttgaaaccgatgctcttggaagatggggtgttgaaaatggtgaatggtgtggaattcc

SEQ ID NO: 16345 - DNA, 111 bp, Anaeromyces robustus
  CBM_10
ttgttggtctaaaagtattggttacgaatgttgtaaagaaactactactgctatttataatgatgaaaatggtaaatggggatatgaaaacggagattggtgtggtattgt

SEQ ID NO: 16346 - DNA, 100 bp, Anaeromyces robustus
  CBM_10
  modified_base (70)..(70): a, c, t, g, unknown or other
ttgctgggctgaaaaattaggttactcttgctgtacttctacttcaccagttgtttacactgataatganggtaactggggtgttgaaaacggtaactgg

SEQ ID NO: 16347 - DNA, 42 bp, Anaeromyces robustus
  CBM_10
cggtgactggggtgttgaaaacggtaactggtgtggtattcc

SEQ ID NO: 16348 - DNA, 108 bp, Anaeromyces robustus
  CBM_10
tttttcagagagacttggctatccatgttgtgtatatactactaaagttgaatacgttgatgccgatggtgactggggtgttgaaaacggtaattggtgtggaatgcc

SEQ ID NO: 16349 - DNA, 111 bp, Anaeromyces robustus
  CBM_10
atgtttctctattaaattaggttacccatgttgtcaaaatacttctgatgttattcttactgatgaagatggtaaatggggagctgaaaacggtgactggtgtggtattaa

SEQ ID NO: 16350 - DNA, 108 bp, Anaeromyces robustus
  CBM_10
atgtttctctgttagtttaggttacccatgttgtcaaaagactactaaagttgttgtcgttgatgaagatggtgaatggggagctgaagatggtaattggtgtggtct

SEQ ID NO: 16351 - DNA, 105 bp, Anaeromyces robustus
  CBM_10
atgtttttcaagccctaattacccatgttgttctgaatgtaaaactatatatactgaccaaactggtgactggggatatgaaaatgaacaatggtgtggtattaa

SEQ ID NO: 16352 - DNA, 108 bp, Anaeromyces robustus
  CBM_10
atgctgggctgaaaaattaggatataaatgctgtgaaaaatgtacagtaacttttaatgatgaaaatggagattggggttttgaaaatggagattggtgtggtatttt

SEQ ID NO: 16353 - DNA, 111 bp, Anaeromyces robustus
  CBM_10
atgctgggcagaaaaacttggttatggatgttgtaaaactacaaccactcctattttagaagatgatgatggcaaatggggtgttgaaaatgacgaatggtgtggtattat

SEQ ID NO: 16354 - DNA, 108 bp, Anaeromyces robustus
  CBM_10
atgctgggctgaagctttaggatattcatgctgtaaaggttgtgatattatctacagtgataatgatggtgattggagtgttgaaaatgatgaatggtgtggtattat

SEQ ID NO: 16355 - DNA, 87 bp, Anaeromyces robustus
  CBM_10
tttctctgaagaaaaggatatgggttatccttgttgtgataattgtgaagttgtcactacagacagcgatggtggttgggggtatca

SEQ ID NO: 16356 - DNA, 93 bp, Anaeromyces robustus
  CBM_10
tggtgatgaatataaatgttgtaaaaagtgtaatgttgtatacagagatgattatgattggggtgtagaaaacaatgattggtgttctattcc

SEQ ID NO: 16357 - DNA, 117 bp, Anaeromyces robustus
  CBM_10
atgttggtctgaagcaagtggttattcatgttgtaaattaaaaacaacaactgttgaatttactgatagtaaaggtaacaaatatggtattgaaaatggtcatttttgtggtatcaa

SEQ ID NO: 16358 - DNA, 70 bp, Anaeromyces robustus; identical to SEQ ID NO: 16123
  CBM_10

SEQ ID NO: 16359 - DNA, 114 bp, Anaeromyces robustus; identical to SEQ ID NO: 16124
  CBM_10

SEQ ID NO: 16360 - DNA, 93 bp, Anaeromyces robustus
  CBM_10
aaatcaaggtttttcatgttgtgaaggatgtacaaaatattatagtgataatgatggtgattggggttttgaaaatgacaactggtgtggttt

SEQ ID NO: 16361 - DNA, 96 bp, Anaeromyces robustus; identical to SEQ ID NO: 16092
  CBM_10

SEQ ID NO: 16362 - DNA, 105 bp, Anaeromyces robustus
  CBM_10
ttgttggtctgaaccagaattcaaatgttgtaccaagagttgtactgtttacttcactgatgatcatgaatggggtgttgaagatgatgaatggtgtggtattcc

SEQ ID NO: 16363 - DNA, 105 bp, Anaeromyces robustus
  CBM_10
ttgtaagtctgcttcattctacccatgttgtgaaacttgtaatgtcttctctgaagaagatggtgaccgttggggtgttgaaaacgatcaatggtgtagtattaa

SEQ ID NO: 16364 - DNA, 84 bp, Anaeromyces robustus
  CBM_10
ctatgaagaatgtaaaggttgtgtcgtatattatgaagatgatacgaagtggggtattgaaaacgatgattggtgtattattcc

SEQ ID NO: 16365 - DNA, 105 bp, Anaeromyces robustus
  CBM_10
atgttttgcttacccattatatccatgttgtgaaggttgtgatgtatatgaagaatctgaagaaggtaaatggggtattgaaaaagatgcttggtgtggtattaa

SEQ ID NO: 16366 - DNA, 93 bp, Anaeromyces robustus
  CBM_10
ccacccaaattatccatgttgtaatggctgtgaagttgtttacactgatgtagacggagaatggggtgttgaaaatggtgcttggtgtttact

SEQ ID NO: 16367 - DNA, 108 bp, Anaeromyces robustus
  CBM_10
ttgtaatacagaaagtttaggttatccttgctgtacccattgtaatactatttacactgatgcagatggtgattggggtattgaaaatggtgattggtgtggtattaa

SEQ ID NO: 16368 - DNA, 111 bp, Anaeromyces robustus
  CBM_10
ttctgatatagctccaaatggttatccatattgtgttaattgtgtagttacagctactggaggtgatggttctctctggggatgggaaaatgaaaaatcatgtgttgttga

SEQ ID NO: 16369 - DNA, 111 bp, Anaeromyces robustus
  CBM_10
ctctgaaatggcaccaaatggttttccatattgtgaatattgtgaagtaggtgctactggtggtgatggttccctttggggttgggaaaatgaacaatcttgtgttgttgt

SEQ ID NO: 16370 - DNA, 108 bp, Anaeromyces robustus
  CBM_10
ttgtttcagtgttaatcttggtttcaaatgttgttcaggatgtaatgttatctatactgataatgatggtgactggggtgttgaaaatgatcaatggtgtggtattcc

SEQ ID NO: 16371 - DNA, 99 bp, Anaeromyces robustus
  CBM_10
agctccaaatggttatccatattgtgttaattgtgtagttacagctactggaggtgatggttctctctggggatgggaaaatgaaaaatcatgtgttgt

SEQ ID NO: 16372 - DNA, 96 bp, Anaeromyces robustus
  CBM_10
accaaatggttttccatattgtgaatattgtgaagtaggtgctactggtggtgatggttccctttggggttgggaaaatgaacaatcttgtgttgt

SEQ ID NO: 16373 - DNA, 108 bp, Anaeromyces robustus
  CBM_10
atgttggtcagaaaaacttggataccaatgttgtaagagtactaaagatattgttttcaccgataatgatggtaattggggtatagaaaatggtaattggtgtggtct

SEQ ID NO: 16374 - DNA, 114 bp, Anaeromyces robustus
  CBM_10
atgttggtcattaagattgggttataattgttgtaagtacagaagtactcctgtttatgaaaaggataatgatggtttatggggtattgaagataacgattggtgtggtgtcac

SEQ ID NO: 16375 - DNA, 123 bp, Anaeromyces robustus
  CBM_10
atgttggtcattaaaacgtaatcatccatacccatgttgtgaaaaatcagaaaccgaagtagtttatatttcatctaatggtgatgaatggggtactgaaaacggtgattggtgtggtattac

SEQ ID NO: 16376 - DNA, 105 bp, Anaeromyces robustus
  CBM_10
tccaagagatccaacacaagattatccatgttgtaaaggatgtatagtaaagtatgtagatgattatgaatggggtgtagaagaaaataattggtgttatattcc

SEQ ID NO: 16377 - DNA, 96 bp, Anaeromyces robustus
  CBM_10
tcatgaaaatggttatccatattgtaaaactacaactttagttctctatactgatgatttagaatggggttatgaaaatgatgaatggtgtgttat

SEQ ID NO: 16378 - DNA, 108 bp, Anaeromyces robustus
  CBM_10
atgttggtctgaaaaattaggttatccatgttgtacaaataaaaatgttgttcatgttgatgaaaatggtcaatggggaattgaaaatgatatgtggtgtggtattaa

SEQ ID NO: 16379 - DNA, 111 bp, Anaeromyces robustus
  CBM_10
tttcagtgaagaaaaaaatcttggttatccatgttgtaaatattgtgtcattgttgaaagtgattcctacggtgattatggtatagaaaatgatcaatggtgtagtattcc

SEQ ID NO: 16380 - DNA, 111 bp, Anaeromyces robustus; identical to SEQ ID NO: 16035
  CBM_10

SEQ ID NO: 16381 - DNA, 114 bp, Anaeromyces robustus; identical to SEQ ID NO: 16034
  CBM_10

SEQ ID NO: 16382 - DNA, 111 bp, Anaeromyces robustus; identical to SEQ ID NO: 16035
  CBM_10

SEQ ID NO: 16383 - DNA, 114 bp, Anaeromyces robustus; identical to SEQ ID NO: 16034
  CBM_10

SEQ ID NO: 16384 - DNA, 114 bp, Anaeromyces robustus
  CBM_10
atgttgggcagaagctaaaggatataagtgttgtcaagatccaaatactccagtttacgaaactgatagtgatggtaaatggggtattgaagatggtcaatggtgtggtatagt

SEQ ID NO: 16385 - DNA, 111 bp, Anaeromyces robustus; identical to SEQ ID NO: 16126
  CBM_10

SEQ ID NO: 16386 - DNA, 102 bp, Anaeromyces robustus
  CBM_10
gtctaaaaaattaggttatccattatgtaaagaatctaaagaagtattatatgaagataaagatggtaaatggggatatgaaaatgattggtgtggaattgc

SEQ ID NO: 16387 - DNA, 105 bp, Anaeromyces robustus
  CBM_10
taaaggtgctcaaggttatccatgttgtactaaatcatgtgattccatttatcaagatggagatggagactggagtcttgaaaataataactggtgtttaattga

SEQ ID NO: 16388 - DNA, 108 bp, Anaeromyces robustus
  CBM_10
ttggtcagaatctttaggttatagttgttgtaccttctgttctccaattatttattctgatgaaagtggtgattggggtgttataaataatgaatggtgtggtattcc

SEQ ID NO: 16389 - DNA, 108 bp, Anaeromyces robustus
  CBM_10
ctttgctgaagatttaggattcaaatgttgtagttatagtaccatggaagtttattcagatagtaatggtaaatggagtgttgaaagtggtgaatggtgtggtattga

SEQ ID NO: 16390 - DNA, 111 bp, Anaeromyces robustus
  CBM_10
ttgctgggcaaatgctttaggttatagatgttgtaaatcaagtcaagaagtaattgcaactgataaggatggtgaatggagtgttgaagatggtcattggtgtggtattcc

SEQ ID NO: 16391 - DNA, 108 bp, Anaeromyces robustus
  CBM_10
atgttgggccgaaaaacttggttattcatgttgtcaaggatgtcatgttatttatgttgataatgatggagaatggggtgttgaaaataatgcctggtgtggaattaa

SEQ ID NO: 16392 - DNA, 105 bp, Anaeromyces robustus
  CBM_10
tactggtaaacttcaaggttatcaatgttgtttaacatgtaatgttgtaacgactgatgcagatggaagatggggtattgaaaatggaaattggtgtggtattaa

SEQ ID NO: 16393 - DNA, 108 bp, Anaeromyces robustus
  CBM_10
atgtttctctattaaacttggttacccatgttgtcaaggtaatactgtttattatattgataatgatggacaatggggtttcgaaaataataattggtgtggaatgaa

SEQ ID NO: 16394 - DNA, 111 bp, Anaeromyces robustus
  CBM_10
ttgttggtctgaaaaacttggttatccatgttgtaacaatagttgttatgcttttaccactgataatgatggtgaatggggttatgaagatggtcattggtgtggtgttcc

SEQ ID NO: 16395 - DNA, 108 bp, Anaeromyces robustus
  CBM_10
atgttggtcaaagaaatatggttatgaatgttgtcaaggttgtactgcttatgaagttgatgaatttggaaaatggggttatgaaaaaaaccactggtgtggtattat

SEQ ID NO: 16396 - DNA, 108 bp, Anaeromyces robustus
  CBM_10
ctggtcattacctgattttccatgttgttccccagacaatacttatatattctttagtgataataatggtgattggggtattgaaaatggagattggtgtggtattat

SEQ ID NO: 16397 - DNA, 111 bp, Anaeromyces robustus
  CBM_10
gtgttggtctaaaaaattaggttttccatgctgtaaaactaataaagtagttttgtttgaagatgcagatggtaaatggggtgttgaaaatgataattggtgtggtataat

SEQ ID NO: 16398 - DNA, 114 bp, Anaeromyces robustus
  CBM_10
ttgggcatatgaattaggttatcaatgttgttttgaaactggtcctgaaaaagccagacaacaagatcaatatggtaaatggggtgttgaatggggaagatggtgtggtattat

SEQ ID NO: 16399 - DNA, 108 bp, Anaeromyces robustus
  CBM_10
ttggtcagcagtctttggttacccatgttgtaaatatactaaagttgtaagatctactgatgaaaatggagattggggtattgaatatgatcattggtgtggtattcc

SEQ ID NO: 16400 - DNA, 54 bp, Anaeromyces robustus
  CBM_10
tactgatgataatggtaaatggagtgttgaaaatgatgaatggtgtggtattgt

SEQ ID NO: 16401 - DNA, 105 bp, Anaeromyces robustus
  CBM_10
tccaaaatacaaacttggtaaatacaagtgttgtcaacaatgtaaagttagatatactgatgattatgaatggggtgttgaagatggtgaatggtgttcaattcc

SEQ ID NO: 16402 - DNA, 117 bp, Anaeromyces robustus
  CBM_10
atgttggtctttaaaacaaggttattcatgttgtcaaaataaaaatactaaagttagttacatttctaaaaatggtgacgaatggggtgttgaaaataatgaatggtgtggtattac

SEQ ID NO: 16403 - DNA, 108 bp, Anaeromyces robustus
  CBM_10
ttggtctgaaaagttcaacattccatgttgtcaatccacttctgaagtagttagaaaaacttatgacggtgaatggggtatagaagatggtaaatggtgtagtattgg

SEQ ID NO: 16404 - DNA, 105 bp, Anaeromyces robustus
  CBM_10
aactgatgcaaatggtaaactcatttgtaatgaatgtaatgtcgaatccactggtggtgatggttcattatggggctttgaaaatgaaaagtcttgtattgttga

SEQ ID NO: 16405 - DNA, 111 bp, Anaeromyces robustus
  CBM_10
ttgtggttttaataaaacaccacacccatggtgtagtggttgtgttgttactgcaactggtgaagatggtgctttatatggatgggaaagtcaagcttcatgtttaattaa

SEQ ID NO: 16406 - DNA, 108 bp, Anaeromyces robustus
  CBM_10
gaataatatagaagcttctacacccaaatgttcagattgtactgtttatgctacaggtaaagacggtacatcctggggttgggaaaatgattctttctgtaaacttcc

SEQ ID NO: 16407 - DNA, 93 bp, Anaeromyces robustus
  CBM_10
tggtaaactcatttgtaatgaatgtaatgtcgaatccactggtggtgatggttcattatggggctttgaaaatgaaaagtcttgtattgttga

SEQ ID NO: 16408 - DNA, 99 bp, Anaeromyces robustus
  CBM_10
tccaagacaaggtgaatataaatgttgtgaaagttgtaatgtagtttatactgatttccaaaaatggggttatgaagataatgaatggtgttctattcc

SEQ ID NO: 16409 - DNA, 102 bp, Anaeromyces robustus
  CBM_10
tttttctattaaatttggatatccatgttgtaatggatgtgatgtcatatacgtggatgaagatggtaaatggagtgtagaaaatgatagctggtgtggttt

SEQ ID NO: 16410 - DNA, 108 bp, Anaeromyces robustus
  CBM_10
ttgggcattaaaatataattacaaatgttgtattgaaacaactgatgtaattgaaactgatgaacatggtgattggggtgtagaaaatggtgattggtgtggtattgt

SEQ ID NO: 16411 - DNA, 99 bp, Anaeromyces robustus
  CBM_10
tactcaatatgcttgttgtaaagatccaaatacatatattagtaccaccgataaaactggagactggggtatagaaggtaattactggtgtttaattga

SEQ ID NO: 16412 - DNA, 93 bp, Anaeromyces robustus
  CBM_10
tgaatatgattgctgttctggatgtaccgtcgttgatcaaggtgatggtaaaatcaaatggggtgtcgaaaacaatcaatggtgtattattaa

SEQ ID NO: 16413 - DNA, 93 bp, Anaeromyces robustus
  CBM_10
taaatcatcaggttacccatgttgtgaaaactgtgaagtcatttacgatgatggaaacacaaaatggggtcttttaaataatgactggtgtgc

SEQ ID NO: 16414 - DNA, 108 bp, Anaeromyces robustus
  CBM_10
ttgctggtctaagaaattaggttatgaatgctgtgctggttgtagtgttgcttacaccgatagtgatggtgaatggggtcttgaaaacgaccaatggtgtggtattcc

SEQ ID NO: 16415 - DNA, 120 bp, Anaeromyces robustus
  CBM_10
atgttgggcagattcctatggttacccatgttgtagcgaaggtattttagctttaccattttacactgacgaaaaaggtaataaatggggtagagaaaatgatgattattgtggtatcat

SEQ ID NO: 16416 - DNA, 111 bp, Anaeromyces robustus
  CBM_10
ttggtctgaagtatttggctataaatgttgtagtgaagataacaaaaatgctgaatatactgatattaatggaaaatggggtgtagaaaatgatgattggtgtggtattat

SEQ ID NO: 16417 - DNA, 99 bp, Anaeromyces robustus
  CBM_10
caatggttatccatgttgtaaagatcaaagacctgaaaaaaaaacttacttagatatggatggtgattggactatagaagatggtaaatggtgtggatt

SEQ ID NO: 16418 - DNA, 105 bp, Anaeromyces robustus
  CBM_10
atgtttctcattcccagaatatatgtgttgtaaaggatgtgatgttgtagaagatgacggagaaacaactaaatggggtattgaaaataatgaatggtgtggtct

SEQ ID NO: 16419 - DNA, 90 bp, Anaeromyces robustus
  CBM_10
tgcttatagcaactgtcaaggttgtagagtcattcttgaagaaaacggtgttaaatggggtgttgaaaacaatgactggtgcattgtttc

SEQ ID NO: 16420 - DNA, 108 bp, Anaeromyces robustus
  CBM_10
ctgttggtctaaaggattaggatatgattgttgtaaaggatgtaatacaatttatactgatggaagtggtgattggggtgttgaaaacaatcaatggtgtggaattcc

SEQ ID NO: 16421 - DNA, 108 bp, Anaeromyces robustus
  CBM_10
ttgctggtcaaatgcattaggatatgaatgttgtaaaggatgtactgtaattgaaactgatggaagtggagattggggtgttgaaaataatcaatggtgtggtattcc

SEQ ID NO: 16422 - DNA, 108 bp, Anaeromyces robustus
  CBM_10
atgttgggctgaagctttaggttttgaatgttgtaagacctctgttccagttacttatactgataaagatggaaaatggggtgttgaaaatggaaactggtgtggttt

SEQ ID NO: 16423 - DNA, 114 bp, Anaeromyces robustus
  CBM_10
ttgttgggctgagccattaggatttaaatgttgtactggtactgatccaaagattgtttattcagatgaagatggtgattgggctattgaaaatggtcaatggtgtggtgttgt

SEQ ID NO: 16424 - DNA, 108 bp, Anaeromyces robustus
  CBM_10
ttttgctctttctgatggttatgaatgttgttttgataatgaagttgtttatgaagatgaaactggtaaatggggtattaatgaaaatggtgaatggtgtggtgtaga

SEQ ID NO: 16425 - DNA, 114 bp, Anaeromyces robustus
  CBM_10
atgttgggctgaaccattaggtttcaaatgttgttcttctcctgatgctcaaatattcacttctgatagtgatggtgattgggctattgaaaatggtcaatggtgtggtattat

SEQ ID NO: 16426 - DNA, 108 bp, Anaeromyces robustus
  CBM_10
tccagattatacaagtaaatatagatgttgtacagaatgtaatgttagttatacaggtagtgatggacatacttggggtattgaatatggtcaatggtgttccattcc

SEQ ID NO: 16427 - DNA, 120 bp, Anaeromyces robustus
  CBM_10
atgttgggctagttttgaaggttatccatgttgtgaagatccaaaaactcctgtttcctatgttaataaacaaacccgtgttgaatatggttttgaacatggggaatggtgtggtattag

SEQ ID NO: 16428 - DNA, 108 bp, Anaeromyces robustus
  CBM_10
ttgttggagtcaaagattaggtttcccatgttgtaatggatgtgatgttgcctatacggatagtgatggtgattggggacttgaaaataataattggtgtggtataga

SEQ ID NO: 16429 - DNA, 108 bp, Anaeromyces robustus
  CBM_10
atgtttctctcaatcattaggtttcccatgttgtaataattgtaatgttgtttacacggatgaaagtggatcatggggtgttgaaaataatgattggtgtggtattaa

SEQ ID NO: 16430 - DNA, 111 bp, Anaeromyces robustus
  CBM_10
atgttgggctgaagctcaaggttatcaatgttgtaagaatatttgtgatgttgtttacaccgatgattctggttcatggggtttagaaaacaatgactggtgtggtattcc

SEQ ID NO: 16431 - DNA, 111 bp, Anaeromyces robustus
  CBM_10
ttgggctcttgattatggttataaatgttgtaagggtgaaaatgtaattcctattgtcactgaatctgtaggtcaatggggtatagaaaatgatgattggtgtggtattgt

SEQ ID NO: 16432 - DNA, 111 bp, Anaeromyces robustus
  CBM_10
ttggtcacttgatcatggttataaatgttgtaaaggtgaaaatgttgaagttgaatatactgattctaaaggtcaatggggtaaagaaaatggtgaatggtgtggtattat

SEQ ID NO: 16433 - DNA, 114 bp, Anaeromyces robustus
  CBM_10
ttgttgggctgaagctttatcttataaatgttgttctaatccaaatacacctgttgtacttactgataaatcaggagaatggggtattgaaaatggtaattggtgtggtattat

SEQ ID NO: 16434 - DNA, 114 bp, Anaeromyces robustus
  CBM_10
ttgttgggctgaagctttacattataaatgttgtactgatccagatacacctgttaaaggtactgatgaattcggaaaatggggtaaggaaaatggtgaatggtgtggtattta

SEQ ID NO: 16435 - DNA, 114 bp, Anaeromyces robustus
  CBM_10
ttgttgggcagaaaaaatcagttataaatgttgtactgatccagatacagttgttattgaaactgatgaattaggaaaatggggtgttgaaaatggtgattggtgtggtataat

SEQ ID NO: 16436 - DNA, 114 bp, Anaeromyces robustus
  CBM_10
atgttgggcggaagctttaaattataaatgttgttctgatccagatacacctgttagatctactgatgaattcggaaaatggggtagagaaaatcatgaatggtgtggtattaa

SEQ ID NO: 16437 - DNA, 111 bp, Anaeromyces robustus
  CBM_10
ttggtcacttaattatggatataaatgttgtaaagatgaaaatgttgaagttattactactgatatttatggtcaatggggtaaagaagatggtaaatggtgtggtattat

SEQ ID NO: 16438 - DNA, 90 bp, Anaeromyces robustus
  CBM_10
caaataccaatgttgtaaagataagaaatctatatatactgatgatgatggtgattgggcatatactaatggtgaatggtgtggtgtcaa

SEQ ID NO: 16439 - DNA, 114 bp, Anaeromyces robustus
  CBM_10
atgtttttccaaaacattaactccttcttacccatgttgtaaaggtgataaagtcatctatactgataaaaatggagattggggtgttgaaaatggagaatggtgtggtattgg

SEQ ID NO: 16440 - DNA, 108 bp, Anaeromyces robustus
  CBM_10
ctgtttttctattgctcaaggatatccatgttgtcaatcctgtaaaataaaatatactgatgaatctggtaaatggggtgtagaagatggtaaatggtgtggtataaa

SEQ ID NO: 16441 - DNA, 108 bp, Anaeromyces robustus
  CBM_10
ttgtttttctgttgctatgggatatccatgttgtaaaagtaataaagttgtttatactgatgaaagtggagaatggggtatagaaaataatgaatggtgtggtattgg

SEQ ID NO: 16442 - DNA, 114 bp, Anaeromyces robustus
  CBM_10
ttggagtgaaagccttggtgttagatgttgtaagggtgctgaaaacattgtagaatacatggatcaagaaggatggtggggtgttactgaagaagatcaatggtgtggtattgt

SEQ ID NO: 16443 - DNA, 105 bp, Anaeromyces robustus
  CBM_10
ttggtcagaaaaattaggttataaatgttgtacaggatgtacagttattaccaccgatgaaagtggaaaatggggtattgaaaataatgaatggtgtggtattaa

SEQ ID NO: 16444 - DNA, 105 bp, Anaeromyces robustus
  CBM_10
ctgtttttccttaccagaatatccatgttgtaaaggtaatgtagtttattataccgatgaacaaggagcttggggtgttgaaaatggtaattggtgtggtattag

SEQ ID NO: 16445 - DNA, 93 bp, Anaeromyces robustus
  CBM_10
aggatatgaatgttgtccaataggttgtaaaatttattatacggatagttctggggattggggtatttataataatgattggtgtggatgtgg

SEQ ID NO: 16446 - DNA, 93 bp, Anaeromyces robustus
  CBM_10
tggttatccatgttgttctgaatgttccaccgtttattatcaggataaaaatggtgaatggggtattgaaaatggtgattggtgtggaatgcc

SEQ ID NO: 16447 - DNA, 105 bp, Anaeromyces robustus
  CBM_10
ttgggcacaaaaattaggatatccttgttgtacagaaaaggttatttattactctgatggtgatggtgattggggatttgaaaataaccaatggtgtggtataat

SEQ ID NO: 16448 - DNA, 96 bp, Anaeromyces robustus
  CBM_10
ttacagttatccatattgtaaaactacaaaagatgtagcatttgatgatggtacattacaatggggtgttgaaaatgataactggtgtataattaa

SEQ ID NO: 16449 - DNA, 117 bp, Anaeromyces robustus
  CBM_10
ttgtccatcttctattactaaccaaggttatccatgttgttcatcctgttcaactgtttattatgttgataatgatggtaaatggggtgttgaaaacaatgattggtgtggaatacc

SEQ ID NO: 16450 - DNA, 96 bp, Anaeromyces robustus
  CBM_10
tcttggttataaatgttgttctgttggttgtcaagtttcttatactgataatgatggagattggagttttgaaaatggtcaatggtgtggttgtgg

SEQ ID NO: 16451 - DNA, 117 bp, Anaeromyces robustus
  CBM_10
atgttggtcccttgctaaaggtttcccatgttgtgaaatgactaaagaagttacctttaatgatgaagctaatggtgaaatttggggtattgaaaatggtacttggtgtggaatgct

SEQ ID NO: 16452 - DNA, 99 bp, Anaeromyces robustus
  CBM_10
aggatatagatgttgtaaaaatcctaatacaaaaattgaatatattagtaaaaatggagatgaatggggtgttgaaaataatgattggtgtggtattac

SEQ ID NO: 16453 - DNA, 99 bp, Anaeromyces robustus
  CBM_10
aggaaccggttatccatgttgtatatttgatacaactaaagccgttcttcatgatgatgatggggattggggtatagaaggtgattattgtcttattgt

SEQ ID NO: 16454 - DNA, 111 bp, Anaeromyces robustus
  CBM_10
ttgtaaagctgaagaaattggatattcatgttgtaaaaaacaaaaagaagtaatttatactgatgatttaggtgaatggggtatagaaaatggtgattggtgtggtatttc

SEQ ID NO: 16455 - DNA, 90 bp, Anaeromyces robustus
  CBM_10
aggtgattatccagtttgtaaaacaacttctgaaatagttttcactgacacggaaaaatggggaatagaaaataatgaatggtgtatctt

SEQ ID NO: 16456 - DNA, 105 bp, Anaeromyces robustus
  CBM_10
ttctttcaatggttataaatgttgttctaatattaatgctgaagtacaatatcatgataaagatggtgattggagtattgaaaataatgaatggtgtattattaa

SEQ ID NO: 16457 - DNA, 114 bp, Anaeromyces robustus
  CBM_10
ttgggctgaaaaacttggtttcaaatgttgtgatccaaagaaatgtagagatgttgtttactttgattatgatggtcaatgggatgttgaaaatggtgaatggtgtggtattac

SEQ ID NO: 16458 - DNA, 111 bp, Anaeromyces robustus
  CBM_10
ttggggtgatgaaatgggttactcttgttgtaaggaaaagaaaactattgttatgtacactgatattagtggacgttggagtgttgaaggtggtaaatggtgtgctattaa

SEQ ID NO: 16459 - DNA, 117 bp, Anaeromyces robustus
  CBM_10
tccagctactattactgctcaaaattatccatgctgtagtgataataattgtgatgtatatgctgttgatgaatctggtaaatggggtcttgaaaataatcaatggtgtggtatttc

SEQ ID NO: 16460 - DNA, 99 bp, Anaeromyces robustus
  CBM_10
aaaacaaggttataaatgttgtccaagtggatgtattgttatttatactgatgatgatggtacttggggtataaataatggtgaatggtgtggatgtaa

SEQ ID NO: 16461 - DNA, 111 bp, Anaeromyces robustus
  CBM_10
taaaaacatacttaataaaggatattcatgttgtccatacaagtgtgaagttatttacactgatgaagatggtacttggggtatttatgataatgaatggtgtggatgcaa

SEQ ID NO: 16462 - DNA, 111 bp, Anaeromyces robustus
  CBM_10
atgttttagtactgttttaggttacccatgttgtaagaatactaaggaagtatctgttaaggattgtgatggttcatggggagtagaaaatgatcaatggtgtggtattgg

SEQ ID NO: 16463 - DNA, 111 bp, Anaeromyces robustus
  CBM_10
ttgggctaaaaaattaggttattcttgctgtgctagtaaatgcgctgaagtatactacactgatgccaacggcaaatggggtgtagagaatggtaaatggtgtggtattat

SEQ ID NO: 16464 - DNA, 84 bp, Anaeromyces robustus
  CBM_10
atacaaatgttgtaaaagttgtgatatagtttatactgatactactaattggggtgttgaaaataatgaatggtgttctattcc

SEQ ID NO: 16465 - DNA, 120 bp, Anaeromyces robustus
  CBM_10
ttgttggtcaactgaatatggttatccatgttgtgtattaaagtctacagttatcgaatacgatgatgttgagaatggaagaaaatatggtattgaagataacaaaatttgtggtattag

SEQ ID NO: 16466 - DNA, 102 bp, Anaeromyces robustus
  CBM_10
aagtggtgatctttataaatgttgtaaaaatacttgtaaagtttatcttgaagattcctcggattattggaatattgaaaatggggaatggtgttctatacc

SEQ ID NO: 16467 - DNA, 120 bp, Anaeromyces robustus
  CBM_10
ttgttggtcatctgctgaaggttatccatgttgtcaagataaaaaaactaaagtttcttatgtttctaaattaactggtaaaaaatacggtatagaaaataataaaaaatgtggtattgt

SEQ ID NO: 16468 - DNA, 102 bp, Anaeromyces robustus
  CBM_10
tgctcctgatggttataaatgttgtaaagaatcatgtgcttactatgataaagatagtaaaggttactggggacttgaaaataaagaatggtgttatattga

SEQ ID NO: 16469 - DNA, 105 bp, Anaeromyces robustus
  CBM_10
ttggtctgaaaaattaggatataaatgttgtagtacttgtggtcaagtttattatgctgataaagatggagaatggggttacaccaatgattggtgtggtattcc

SEQ ID NO: 16470 - DNA, 102 bp, Anaeromyces robustus
  CBM_10
ttggtcagcatctttaccatgttgtaaagaatgtaatgttgttgatgcatctgataaatctcgtcaatacggttgggaaaatgatcaatggtgtgctatacc

SEQ ID NO: 16471 - DNA, 114 bp, Anaeromyces robustus
  CBM_10
atgttgggcaacaaaattaggttatccatgttgtacaggaaaatatcctggtattagttatactgataaagatggatcatggtctattgaaaatggtcaatggtgtggtgttat

SEQ ID NO: 16472 - DNA, 114 bp, Anaeromyces robustus
  CBM_10
atgttgggcagaatctaaaggttatccatgttgtgatccaagtaataccaatgttataatggaagatattgatggtaaatggggattagaaaacaatcaatggtgtggtatagt

SEQ ID NO: 16473 - DNA, 120 bp, Anaeromyces robustus
  CBM_10
atgtccaggttatgccgaaggctataattgttgtaaaaattgtgaagttacctatatttcccattccgatccaaataaaaaatggggattcttttctaatggagattggtgttctattcc

SEQ ID NO: 16474 - DNA, 117 bp, Anaeromyces robustus
  CBM_10
ttgttggtctgaagcattaggttatccatgttgtcgtgatcctcgaaccaccatttataaaactgaaaaagatggtaaagaatggggtatagaatctaatcaatggtgtggtattaa

SEQ ID NO: 16475 - DNA, 111 bp, Anaeromyces robustus
  CBM_10
atgttggtctaatgaattaggttacccatgttgtaaatctactactgaaattgttttcactgatgatcgtggtaattggggtgttgaagataagaaatggtgtggagttat

SEQ ID NO: 16476 - DNA, 99 bp, Anaeromyces robustus
  CBM_10
aaaattaggttatccatgttgtagtaataaaaatggtaaagttgtatataaagatgaaaatggtaattggggtgttgaacatcatcaatggtgtatctt

SEQ ID NO: 16477 - DNA, 108 bp, Anaeromyces robustus
  CBM_10
tagttcaaaatctttaggttatccatgttgtaaatcatctaacaatgtagtctctactgatgaattaggaaaatggggtgttgaaaacggtgattggtgttacattaa

SEQ ID NO: 16478 - DNA, 108 bp, Anaeromyces robustus
  CBM_10
ctggtctgaaaaattaggttataaatgctgtaacacttgtttcccagtttattataccgataatgatggtcaatggggtatagtcaatggtgaatggtgtggtattgc

SEQ ID NO: 16479 - DNA, 108 bp, Anaeromyces robustus
  CBM_10
ttgggcattaaaattaggttcaccatgttgtactttcaataaagatgtttatgctattgatgaaaatggtaaatggagtgttgaaaatggaatttggtgtggtataat

SEQ ID NO: 16480 - DNA, 111 bp, Anaeromyces robustus
  CBM_10
atgttggtcattaaaattaggttcaccatgttgtactaccactaaggaaattatttataccgatgatgatggaaactggggtattgaaaataatgactggtgtggtataat

SEQ ID NO: 16481 - DNA, 111 bp, Anaeromyces robustus
  CBM_10
atgttgggcaaaaatattaggttctccatgctgtcttaccactaaagtagtcgttgaaattgatgactttggtaaatggggtattgaaaatggtgcatggtgtggtattat

SEQ ID NO: 16482 - DNA, 108 bp, Anaeromyces robustus
  CBM_10
ttgggcacacgcctataattacccatgttgtaagactaccaagaatttagttgaaactgattctaaaggtaataaatggggtattgaagacaatcattggtgtggtct

SEQ ID NO: 16483 - DNA, 114 bp, Anaeromyces robustus
  CBM_10
ttgtttttctgaaaaacttggttatccatgttgtgattcctcaaatgatattgttctctacactgacagtgatggtaagtggggtgtagaaaataataattggtgtggtattac

SEQ ID NO: 16484 - DNA, 117 bp, Anaeromyces robustus
  CBM_10
ttggtcgatgaaagaaggttatccatgttgtaaagatgaaaatacacccgtttcctatattagtaaaagtacaggtaaagaatggggtatggaaaatggagaatggtgtggtattgt

SEQ ID NO: 16485 - DNA, 90 bp, Anaeromyces robustus
  CBM_10
aggttataaatgttgtaaatccacctgtacagtatcttataccgatagtaataaatggggagttgaaaataatgaatggtgtattattcc

SEQ ID NO: 16486 - DNA, 111 bp, Anaeromyces robustus
  CBM_10
gtgctggtcattaaaacaaggatatccatgttgtgtaaaaaccgaaattgtagttatagaagatgaaaatggaaaatggggtgttgaaaatgatgattggtgtggtattat

SEQ ID NO: 16487 - DNA, 96 bp, Anaeromyces robustus
  CBM_10
aagtactggttataaatgttgtcctgatgctgaagtaaaagcaacatatggtaatagtacatggggtaaagtaaatggtgaatggtgtggtattaa

SEQ ID NO: 16488 - DNA, 111 bp, Anaeromyces robustus
  CBM_10
atgtccatttaatcaatatggttacccatgttgtaaaacgactaaagttgttgtatctatcgattcaatgggaaaatggggtattgaagatggtcaatggtgtggtatcgt

SEQ ID NO: 16489 - DNA, 105 bp, Anaeromyces robustus
  CBM_10
ctatgaaagaacatacccatgttgtagtccagataataaaaaaataaaatatgttgatcaacatggtcaatggggttttgaaaatggtgattggtgtggtatgcc

SEQ ID NO: 16490 - DNA, 114 bp, Anaeromyces robustus
  CBM_10
tttatctgaacttgtaggttatccatgttgtgctaaaggaattaaagctgtttatgctaaagatgaatatggtgaatggggttatgatttcaaaaagaatgaatggtgtggact

SEQ ID NO: 16491 - DNA, 108 bp, Anaeromyces robustus
  CBM_10
ttgttggtcagaaaaatatggttatccatgttgtaatggctgttatgtttttgaaactgatgatgatggtcaatggggatatgaaaacaatcaatggtgtggtattca

SEQ ID NO: 16492 - DNA, 105 bp, Anaeromyces robustus
  CBM_10
tagaagtgctttagaaggttatatgtgttgtaaaactcctggtaaagtcttttatagagatgattttggatcatggggtgtagaaaatgaacaatggtgtggttt

SEQ ID NO: 16493 - DNA, 93 bp, Anaeromyces robustus
  CBM_10
attatatgaaatttgtaaagaacaacatgatgtagtatttaaagataatgaaggagtatggagtgtagaaaatggaaattggtgtagtataca

SEQ ID NO: 16494 - DNA, 111 bp, Anaeromyces robustus
  CBM_10
ttgggctgaaaaattaggttatccatgttgtaaaggtaatgaaccaaaagttgaatttactgatgaacatggagattggagtatagaaaatggacaaaaatgtggtatttt

SEQ ID NO: 16495 - DNA, 105 bp, Anaeromyces robustus
  CBM_10
tttttctgaaaaattaggatatccatgttgttctggatgtactgttatttattctgataatgatggagaatggggtatagaaaatgataattggtgtggtattaa

SEQ ID NO: 16496 - DNA, 108 bp, Anaeromyces robustus
  CBM_10
tccttttgaatctattggttataaatgttgttcaaaaacatgtcttgtactttattctgacgaaagtggtgattggggtgtagaagatgatgaatggtgtggtattaa

SEQ ID NO: 16497 - DNA, 111 bp, Anaeromyces robustus
  CBM_10
atgctggtctacagaatatggatatccatgttgctcttcaccagatacaaaaagtaattcaactgacagtaaaggcacatggggttttgaaaatggagattggtgtggttt

SEQ ID NO: 16498 - DNA, 108 bp, Anaeromyces robustus
  CBM_10
ttgggcagatgaattaggttttagttgttgtgaaaatgacaacggaaaaatagtaattggggataataatggtctttggggtaaagaaaatggtaactggtgtggttt

SEQ ID NO: 16499 - DNA, 108 bp, Anaeromyces robustus
  CBM_10
ttggtctttagctttaggttatccatgttgtcaatcatctactaaagttcatactacagatgaaaatggttcatggggtatagaaaataatcaatggtgtggtattcc

SEQ ID NO: 16500 - DNA, 114 bp, Anaeromyces robustus
  CBM_10
tttctcagaacctgattatccatgttgttccaattgtgatgtcgaaataatttggaatgatgaaaataaaggacaatcttggagtattgaaaataataattggtgtggtatatt

SEQ ID NO: 16501 - DNA, 96 bp, Anaeromyces robustus
  CBM_10
tggtaatatttataaatgttgtaaaaaatcttgtaaagtttatcgtgaagaagatggtgattattggaatgttgaaaataatgaatggtgttcttt

SEQ ID NO: 16502 - DNA, 111 bp, Anaeromyces robustus
  CBM_10
ttgggctagaaaattaggatacccatgttgtgaaaaatgcccattattaactctttacaaagattctaacggatcatggggacttgaacatcttcgttggtgtggtattat

SEQ ID NO: 16503 - DNA, 114 bp, Anaeromyces robustus
  CBM_10
tatggctgaagttattggttatccatgttgtacatcaaaacaaactaaagtttaccgtactgatgaatatggtgattggagtttcaacttcttaaagttacaatggtgtggttt

SEQ ID NO: 16504 - DNA, 114 bp, Anaeromyces robustus
  CBM_10
tttatctgaacttgtaggttatccatgttgtgctaaaggaattaaagttgtttatgcaaaagatgaatatggtgaatggggttatgatttcaaaaagaatgaatggtgtggact

SEQ ID NO: 16505 - DNA, 108 bp, Anaeromyces robustus
  CBM_10
atgttggtcagaaaaatatggttatccatgttgtaatggctgttatgtttttgaaactgatgatgatggtcaatggggatatgaaaacaatcaatggtgtggtattca

SEQ ID NO: 16506 - DNA, 93 bp, Anaeromyces robustus
  CBM_10
atatggttataaatgttgtccgaatgctactgcactactcgaagatgattatggatcttggtctatagttaatggagaatggtgtggtgttga

SEQ ID NO: 16507 - DNA, 111 bp, Anaeromyces robustus
  CBM_10
atgttggtcattaaatttaggtttcccatgttgtgaagaaactaaaaatgtcattgaaattgatgataatggtaaatggggtatagaaaacaataactggtgtggtataac

SEQ ID NO: 16508 - DNA, 111 bp, Anaeromyces robustus
  CBM_10
atgttggtcattaaaaaaaggattcccatgttgtgaaacaacaaaggctattatctataccgatgaagatggtaattggggtactgaaaataacaattggtgtggtataaa

SEQ ID NO: 16509 - DNA, 111 bp, Anaeromyces robustus
  CBM_10
atgctggtcattaaatttaggttttccatgttgtgaagaaactcaaaatgtcattgaaattgatgataatggtaaatggggtatagaaaacaataattggtgtggtataat

SEQ ID NO: 16510 - DNA, 87 bp, Anaeromyces robustus
  CBM_10
aagtccttgctgtgaaaataatgatggtgaaatattatattatgatatggatggtgattggggttatgaaaatggtttatggtgtgc

SEQ ID NO: 16511 - DNA, 111 bp, Anaeromyces robustus
  CBM_10
atgttggtcattaagacttggttccccatgttgtactactactgataaagttatctatactgatggtgatggtaattggggttatgaaaataatgagtggtgtggtataat

SEQ ID NO: 16512 - DNA, 108 bp, Anaeromyces robustus
  CBM_10
ttgggcaaaagccaaaggttatccatgttgtgataatgatgaaggttatttacaaagttatgatatggatggtaaatggggttatgaaaataatgcctggtgtggata

SEQ ID NO: 16513 - DNA, 108 bp, Anaeromyces robustus
  CBM_10
atgttggtcaatgccattaggttacccatgttgtgtaggaaatgatgtttataagaaagatgtttatggtttatggggtattgaaaatgataattattgtggtatagc

SEQ ID NO: 16514 - DNA, 111 bp, Anaeromyces robustus
  CBM_10
ttctagaattcaaaaccaaggttttaaatgttgttccaataattgtatggtattctattctgatggtgatggtaactggggttatgaagatggagaatggtgtggatgtaa

SEQ ID NO: 16515 - DNA, 90 bp, Anaeromyces robustus
  CBM_10
atacgcttgttgtaagagtagtgatgttaaaatttatgaaaccgatgaatatggtaaatggggtgttgaagataataaatggtgtttatt

SEQ ID NO: 16516 - DNA, 108 bp, Anaeromyces robustus
  CBM_10
atgtttctcaattgctttaggttatccatgttgtcaaggtaacgaaattgtttatactgataatgatggtaattggggtgtagaaaatggtcaatggtgtggtattgg

SEQ ID NO: 16517 - DNA, 108 bp, Anaeromyces robustus
  CBM_10
ttgtttctctgaagctttaggttatccatgttgtacatcatgtaatgtaatctttactgacagtgatggtaaatggggtgttgaaaataatagttggtgtggtattaa

SEQ ID NO: 16518 - DNA, 117 bp, Anaeromyces robustus
  CBM_10
ttggtcaatcgctgaaggttatccatgttgtcaaaatcctgaaaccaccgtttcctatactagtaaatcttcaggaaaattatggggtgttgaaaataatgaatggtgtggtattac

SEQ ID NO: 16519 - DNA, 96 bp, Anaeromyces robustus
  CBM_10
tacttcctattcctgttgtgtctttagagataccgctgtttatagtaccgatgaaactggtacatggggtattgaaggtaatcgttggtgtctttt

SEQ ID NO: 16520 - DNA, 102 bp, Anaeromyces robustus
  CBM_10
atgtgttaaaaataagaatggattaaaatgttgtagtacttgtgaaattgctttaactgatgctactggtagatatggttatgaaaatggtgaatggtgtaa

SEQ ID NO: 16521 - DNA, 105 bp, Anaeromyces robustus
  CBM_10
ttggtcacgttctattggttttgtttgttgtgataaatgtaatgttctttatgttgatgaacaaggtaaatggggtattgaagatgaatactggtgtggtattaa

SEQ ID NO: 16522 - DNA, 90 bp, Anaeromyces robustus
  CBM_10
tggtgactatccagtttgtaaggaaactaccaaggtgatgtataccgatacggaaaaatggggtgtagaacatggagaatggtgtgtcct

SEQ ID NO: 16523 - DNA, 108 bp, Anaeromyces robustus
  CBM_10
ttttgctagtagtggttacccatgttgtactgatcctcacaccaaagttgtctaccatgatgatgaaggtgactggggggtggaaaataaagaatggtgctttattcc

SEQ ID NO: 16524 - DNA, 108 bp, Anaeromyces robustus
  CBM_10
taatagtgaaaaatatggttattcctgttgtaaaacagagcaaaaagttgtttatacggatagccaaggggattggggaattgaagatggaaattggtgtggtattta

SEQ ID NO: 16525 - DNA, 105 bp, Anaeromyces robustus
  CBM_10
aagacaaggatatccatgttgtgaagaaaataattgtaatatctatttcaaggatggtgatggtgactggggtattagttcaaaatctaattggtgtggtattag

SEQ ID NO: 16526 - DNA, 102 bp, Anaeromyces robustus
  CBM_10
attcaatcaaatgggatacaaatgctgtaatggatgtaatgttattttaacagacgaaactggtaaatggggtgttgaaaataatgaatggtgtggtattcg

SEQ ID NO: 16527 - DNA, 117 bp, Anaeromyces robustus
  CBM_10
atgttcttctcgtattttaaatcaaggttataaatgttgttccgataattgtaaggtagtttataccgatgaagatggtacatggggttatgaaaataatcaatggtgtggatgtac

SEQ ID NO: 16528 - DNA, 105 bp, Anaeromyces robustus
  CBM_10
tacttcacttggttattcatgttgtagtgataataattgtgttgtctataccgtagattcaaccggtaattggggtgtagaaaataatgaatggtgtggtatttc

SEQ ID NO: 16529 - DNA, 114 bp, Anaeromyces robustus
  CBM_10
tttggctgaattaataggttatccatgttgtccatctataattaaaacaatttatgcccaagatgaatatggagattggggatttgatttcaaaaaacaagaatggtgtggact

SEQ ID NO: 16530 - DNA, 108 bp, Anaeromyces robustus
  CBM_10
atgttggtcaaaaatatatggatactcatgttgtaaaagatgtatggtatatgaaactgatgaaaatggtaaatggggttttgaatctaatcaatggtgtggtattcc

SEQ ID NO: 16531 - DNA, 114 bp, Anaeromyces robustus
  CBM_10
atgttgggcatttgatttaggttatccatgttgttcagatcctaatagtataatatgggaaacagatagtaatggtagttggagtattgaaaataatgaatggtgtggaattat

SEQ ID NO: 16532 - DNA, 108 bp, Anaeromyces robustus
  CBM_10
ttgggcttatcaatatggattccaatgttgtttctattacacaaaaccatatcttgtcgatgaacgtggttcatggtcatttgaacgtggtaattggtgtggtattgt

SEQ ID NO: 16533 - DNA, 111 bp, Anaeromyces robustus
  CBM_10
atgttggtcaaaaaaattaggctattcatgttgtgaagaatcaaaagaagttttctatgaagatcaagatggtaaatggggttatgaaaaagataattggtgtggtatagt

SEQ ID NO: 16534 - DNA, 114 bp, Anaeromyces robustus
  CBM_10
ttgttggggggaaaaattaggatacccttgttgtccaccaacaaattgtagaattttttatgttaatgatgatggtgactggggatttcataattataaatggtgtgccattga

SEQ ID NO: 16535 - DNA, 111 bp, Anaeromyces robustus
  CBM_10
ttgggcaaaaaaatttggttatgaatgctgtccacctggagtttgtgaagtttctcaaaaagatgaaaatggttcatggggtgcatatgatggagaatggtgtggaattat

SEQ ID NO: 16536 - DNA, 93 bp, Anaeromyces robustus
  CBM_10
aggttatccatgttgtaaaagatgtgattcatttttacttacagacgatgatgctaattggggtgttgaaaattcagaatggtgtattataaa

SEQ ID NO: 16537 - DNA, 114 bp, Anaeromyces robustus
  CBM_10
ttggtcagaatctcttggttataaatgttgttcagcaggatgtaaagcagcttctatttttgtagattcagatggttcatggggtgttgaaaatggagaatggtgtggtattcc

SEQ ID NO: 16538 - DNA, 114 bp, Anaeromyces robustus
  CBM_10
tttagctgaattattaggatattcttgttgttcacctgaaaatactaacatatatttacaagatgaaaatggtgattggggttttgattttgaaaaaaatgaatggtgtggtct

SEQ ID NO: 16539 - DNA, 111 bp, Anaeromyces robustus
  CBM_10
ttgttggtctgaagaaataggttatccatgttgtaaaacatgtgatgtattttacgaagaagattatgaaggtaggtggggtatagaaaatgataattggtgtggtattcc

SEQ ID NO: 16540 - DNA, 108 bp, Anaeromyces robustus
  CBM_10
atgttggtcagaaagattaggttacccatgttgtaagggtaatgtagttgtcacctccgatgctgatggtgattggggtgttgaaaacaacaattggtgtggtattat

SEQ ID NO: 16541 - DNA, 117 bp, Anaeromyces robustus
  CBM_10
ttgttggtccgaagctcttggtttcccatgttgtagtactaacggttgtcaagtcgtttattacactgataccgatggtaagtggggtgttgaaaacaacaattggtgtggtattac

SEQ ID NO: 16542 - DNA, 111 bp, Anaeromyces robustus
  CBM_10
ttgctggtctgagactttaggttatacttgttgtaagagttcttgtgatatttattatactgatcaagatggccattggggtgttgaaaataatcaatggtgtggtataat

SEQ ID NO: 16543 - DNA, 111 bp, Anaeromyces robustus
  CBM_10
atgtaatacatataataataaatatccatgttgtagtcactgtaatgtttatcacacagatactgatggcagcagatggggtattgaaaatgataactggtgttctattaa

SEQ ID NO: 16544 - DNA, 111 bp, Anaeromyces robustus
  CBM_10
ttgggctgaaaaattaggttatccatgttgtaaaggtaatgaaccaaaagttgaatttactgatgaatatggagattggagtaccgaagatggtcaaaaatgtggtatttt

SEQ ID NO: 16545 - DNA, 93 bp, Anaeromyces robustus
  CBM_10
aggttatgatacttgtaaagaacaacatgaatacatatataaagataatgaaggattatggagtatagaaggtggaaaatggtgtggtataca

SEQ ID NO: 16546 - DNA, 108 bp, Anaeromyces robustus
  CBM_10
ttgtagaagtgctttaaatggttatatgtgttgtaaaaatactgataaagttgtttacagagatgattttggatcatggggtatagaaaatggacaatggtgtggttt

SEQ ID NO: 16547 - DNA, 81 bp, Anaeromyces robustus
  CBM_10
ttatccatattgtgatggatgtgaaacaaattatactgataaagatggtggttggtattacactaataaaacttggtgtaa

SEQ ID NO: 16548 - DNA, 96 bp, Anaeromyces robustus
  CBM_10
aggatatcaatgttgtaaagattcttctactaaagttatctctgaagataatgatggtacttggggtattgaaaataaaaaatggtgtcttattca

SEQ ID NO: 16549 - DNA, 114 bp, Anaeromyces robustus
  CBM_10
atgttggtctgaagttttcggttacccatgttgtcaaagttgttatgtatatgaagaagatgaaaatggcaaatggggttatgatttcaatgaatctacctggtgtggtattca

SEQ ID NO: 16550 - DNA, 114 bp, Anaeromyces robustus
  CBM_10
ttgggttgaacaatttggttatccatgttgtcaaaaaaatgctaaagtttatgctgtagatgatgaaggtgaatggggttataatttcaaaactcaagaatggtgtggtattac

SEQ ID NO: 16551 - DNA, 105 bp, Anaeromyces robustus
  CBM_10
atgtccagattatgccacaggatattcctgttgttatgaatgtaatattgtttataatgatggacatgattggggaattgaaaatggtaaatggtgttccattcc

SEQ ID NO: 16552 - DNA, 105 bp, Anaeromyces robustus
  CBM_10
atgtttttcttatccacaatatccatgttgtgaaggctgtacagttattgaagaaacagctgaaggtaaatggggtattgaaaatagtcaatggtgtggtattaa

SEQ ID NO: 16553 - DNA, 87 bp, Anaeromyces robustus
  CBM_10
ctatgatgaatgtaaatcttgcttaacatattacattgaagatggtgtcaaatggggtgttgaaaacaatgactggtgtcttattcc

SEQ ID NO: 16554 - DNA, 105 bp, Anaeromyces robustus
  CBM_10
ttgggctggtcaattaggttacccatattgtacttctactactagagaagtttataaggataatgatggtaaatggggtattgaaaacaataattggtgttgttt

SEQ ID NO: 16555 - DNA, 108 bp, Anaeromyces robustus
  CBM_10
tttttcaagtaaattaggttatccatgttgttcatcaactaaagttattgtttatcaagataatagtggtaattggggtgttgaaaataatgaatggtgtggaattga

SEQ ID NO: 16556 - DNA, 84 bp, Anaeromyces robustus
  CBM_10
taaatgttgtcaaaaatgtgaaatagtatatgaagataaagaaggtaaatggggagttgaaaatgatgaatggtgtgtcatagg

SEQ ID NO: 16557 - DNA, 108 bp, Anaeromyces robustus
  CBM_10
ttgttttgcaactagattaggttatgaatgttgtaattataatgaaattctttattcagatgatgatggagattggggtgttaatgataatcgttggtgtggtatcgg

SEQ ID NO: 16558 - DNA, 114 bp, Anaeromyces robustus
  CBM_10
ttggtctttaaaatatggttatccatgttgtaaagaaaatgctactactattcgtaaagataaaaatggtgaatggggatttgattttcaaaaatttagatggtgtggtatcca

SEQ ID NO: 16559 - DNA, 111 bp, Anaeromyces robustus
  CBM_10
ttgtttttcattggaaataggattcccatgttgtagagaaggagaaaaaattgtttattctgatgatgatggttattggggtgtagaaaatggtgaatggtgtggtattga

SEQ ID NO: 16560 - DNA, 108 bp, Anaeromyces robustus
  CBM_10
atgtttttcactttcagaaggatatccatgttgtgaattttgtatggtagaacaatgtattgataataatttatggggtgtagaaaatggacaatggtgtggtattgc

SEQ ID NO: 16561 - DNA, 108 bp, Anaeromyces robustus
  CBM_10
atgtttctcaattaaattaggatacccatgttgtaaaaaaactactgaagtagctcatattgataaaaatggtaaatggggtattgaagataatcattggtgtggttt

SEQ ID NO: 16562 - DNA, 105 bp, Anaeromyces robustus
  CBM_10
ttggtctgaacaatatggttatccatgctgtgattctaatgatgttttcttagaagatgaattaggtaaatggggtgttatgaatggttcatggtgtggtattcc

SEQ ID NO: 16563 - DNA, 99 bp, Anaeromyces robustus
  CBM_10
tgaagatcttggttttaaatgttgttcacattgtgttcatatctatgatgataaaactggtttatggggtgtcgaagccaatgaatggtgtggtatctc

SEQ ID NO: 16564 - DNA, 114 bp, Anaeromyces robustus
  CBM_10
ttgctggtcttcttctttaggttacccatgttgttccaatagtaacacccttgttgaatatacagataatgatggagaatggggtatagaaaatggtatatggtgtggtatagc

SEQ ID NO: 16565 - DNA, 108 bp, Anaeromyces robustus
  CBM_10
ttttgccgctaattcaaattatccagtttgtaaatataatagtatagtttatttcactgatgaagatggtcaatggagtgttgaaaatgataattggtgtttaattcc

SEQ ID NO: 16566 - DNA, 117 bp, Anaeromyces robustus
  CBM_10
atgctggtcacttagtcaaggttatccatgttgtgtaaataaaaacacaaaaataaaatctacttctagtaatggagatgaatggggtgttgaaaataatgaatggtgtggtataac

SEQ ID NO: 16567 - DNA, 93 bp, Anaeromyces robustus
  CBM_10
ttcaggttatagttgttgtgtttctacaactaaagttttatcaggagatggtacaggtgattggggtgttgaatttaatgactggtgtttatt

SEQ ID NO: 16568 - DNA, 114 bp, Anaeromyces robustus
  CBM_10
atgttggtctatagctgaaggttttccatgttgtgaaaataaagatactataatttccattattcaatcaggaagaggatggggtgttgaaaatggtcattggtgtggtattat

SEQ ID NO: 16569 - DNA, 102 bp, Anaeromyces robustus
  CBM_10
tccaagttctggaaattataaatgttgtaaatcatcttgcagtgtttattatgttgatacggaagaatggggttatgaacatggtgaatggtgtttaattcc

SEQ ID NO: 16570 - DNA, 90 bp, Anaeromyces robustus
  CBM_10
tggggattatccttgttgtaaaggttgtgatgtttattatactgatgatgtagaatggggtattgaaaatggtgattggtgttctattcc

SEQ ID NO: 16571 - DNA, 108 bp, Anaeromyces robustus
  CBM_10
atgttggtcagaaatatatggatactcatgttgtaaaggatgtattatttatgaatcggatgaaaatggtaaatggggttataaaaatggtaaatggtgtggtattcc

SEQ ID NO: 16572 - DNA, 117 bp, Anaeromyces robustus
  CBM_10
ttgggctgaattaattggttatccatgttgtccatcccacaacaaaatagtatacagtcatgatgaaaatggagattggggatatgattataaaactaatcaatggtgtggtattac

SEQ ID NO: 16573 - DNA, 105 bp, Anaeromyces robustus
  CBM_10
cttttctatcgccttgggatatccatgttgtaaaaaatgtgatgtattattcgttgataaagatggtcaatggggtgtagaagataatgagtggtgtggtataaa

SEQ ID NO: 16574 - DNA, 114 bp, Anaeromyces robustus
  CBM_10
atgtttttctcaagcacttaatccatcttacccatgttgtaaaagtaataaagtcgtctatactgataaaagtggggattggggtgtagaaaatgatcaatggtgtggtattgg

SEQ ID NO: 16575 - DNA, 99 bp, Anaeromyces robustus
  CBM_10
taataaaaataatgaatatgaatgttgtgaaacttgtacagagtattttagcgataatactggcagatatggatatgaaaatgaaaaatggtgtcttct

SEQ ID NO: 16576 - DNA, 108 bp, Anaeromyces robustus
  CBM_10
atgttggtctgaagagcaaggctttccatgttgtaaaggatgtgtagttatttatactgaaaataatgaaaaatggggaatagaaaatgatgaatggtgtggtattaa

SEQ ID NO: 16577 - DNA, 93 bp, Anaeromyces robustus
  CBM_10
aggttataattgttgtattcatgattgtatttatattacttcagatgaaaatagaaattggagtgttgaaaatggagaatggtgttggtgtat

SEQ ID NO: 16578 - DNA, 111 bp, Anaeromyces robustus
  CBM_10
atgttggtcggaaagattaggttatccatgttgtaccactacaaaaaaagcttatacagaagattcggatggtaaatggggggttgaaaaaggtaattattgtggtattat

SEQ ID NO: 16579 - DNA, 108 bp, Anaeromyces robustus
  CBM_10
ctggtcaattccacttggttatccatgttgttctaattcctatcttccaacactttttacagatgataatggtgaatggagtgttgaaaatgataattggtgtggtaa

SEQ ID NO: 16580 - DNA, 114 bp, Anaeromyces robustus
  CBM_10
ctgttggtctattcaatatggttatgaatgttgtaaagatccagaaactccagtatatagtaaagatagtactggggaatggggtattgaaaacaataattggtgtggaattgt

SEQ ID NO: 16581 - DNA, 108 bp, Anaeromyces robustus
  CBM_10
tttttcagtgaaattaggttatccatgttgtcaatatacagatgaagtagtttatgttgatgatgatggggattggggtgttgaaaataatgactggtgtggtattgg

SEQ ID NO: 16582 - DNA, 96 bp, Anaeromyces robustus
  CBM_10
gaaattgggatatagatgttgtaatacatgtaaaattgaatatattgataataatattaaatatggttatgaaaatggtgaatggtgtggtattcc

SEQ ID NO: 16583 - DNA, 96 bp, Anaeromyces robustus
  CBM_10
aacaagatttggatatccctgttgtgatacatgtaaattagaatatattgatgattttggtgattggggattcgaaaatgataattggtgtggtct

SEQ ID NO: 16584 - DNA, 90 bp, Anaeromyces robustus
  CBM_10
aggttatgaatgttgtgaaggatgtacagttgaatctgaagaagataatattaaatggggttatgaaaatagaaattggtgtgtaattcc

SEQ ID NO: 16585 - DNA, 108 bp, Anaeromyces robustus
  CBM_10
atgttggtcagaaattatcggatattcatgttgtaagggttgtaccgtttatgaagaagatgaatttggtaaatggggttatgaaaagaaccactggtgtggtattca

SEQ ID NO: 16586 - DNA, 117 bp, Anaeromyces robustus
  CBM_10
atgttgggctgaatttattggatatccatgttgttcagaaaaggatacatatgtttacgatacagatagttatggtgattggagttatgatttcgataataatgaatggtgtggtct

SEQ ID NO: 16587 - DNA, 108 bp, Anaeromyces robustus
  CBM_10
ttggtcagcaaaacttggttacccatgttgtaaatcaactacagcagtcgaaatgtcagatagtgatggtcaatggggtgttgaaaatggacaatggtgtggtattca

SEQ ID NO: 16588 - DNA, 108 bp, Anaeromyces robustus
  CBM_10
ttgggcaacacgtcttggttttccatgttgtgaatattctgcacaagttttttatacagataatgatggtaagtggagtattgaaaatggtgaatggtgtggtataat

SEQ ID NO: 16589 - DNA, 108 bp, Anaeromyces robustus
  CBM_10
ttggtcagtttcagaaggatataaatgttgtagcttaggtactaaaacagtacttactgatagtaaaggtaaatggggtattgaaaataatgaatggtgtggtatttc

SEQ ID NO: 16590 - DNA, 105 bp, Anaeromyces robustus
  CBM_10
ttgggctacttctataggttatggatgttgtaatcactgtaattctatatatacagatggtacatacagatggggtgttcaaaataatcaatggtgtggtattat

SEQ ID NO: 16591 - DNA, 102 bp, Anaeromyces robustus
  CBM_10
tgctacaaagcttggatattcttgttgtaaaacttgtatggtagctttaactgataaagatggtaaatggggtgttgaaaataagaactggtgtggaattga

SEQ ID NO: 16592 - DNA, 117 bp, Anaeromyces robustus
  CBM_10
atgttgggcccaaaaattaggatttaaatgttgtaagaatccaaatgcaacagttattaacattgatgaagacggtacaaaatggggtattgaaaatgatgaatggtgtggtatttt

SEQ ID NO: 16593 - DNA, 108 bp, Anaeromyces robustus
  CBM_10
taaatctgacaaagaagaagataattgctgtaaaaccaatactgaaattctctattcagatgatgaaggtgcatggggttatgaaaatgatgcctggtgtattgtaag

SEQ ID NO: 16594 - DNA, 114 bp, Anaeromyces robustus
  CBM_10
atgttgggctgaaaaatacggaagaccttgttgtaaaaacagttcaactaaaaatgtttatactgataatgaaggtatgtggggtgttgaaaatgatgaatggtgtggtataac

SEQ ID NO: 16595 - DNA, 117 bp, Anaeromyces robustus
  CBM_10
atgtaaatctgaaaaactcggtattgaatgttgtaaagatatttcaactgaaaatgtttatactgatgatgaaggtattaagtttggtgttgaaaaagatgattggtgtggtattaa

SEQ ID NO: 16596 - DNA, 114 bp, Anaeromyces robustus
  CBM_10
atgttgggccaaaaaatacggaagaccttgttgtttaaataatttaactgaatatgtttatgctgatgatgaaggtatgtggggtgttgaaaacggtgattggtgtggtataaa

SEQ ID NO: 16597 - DNA, 93 bp, Anaeromyces robustus
  CBM_10
tgatccacaatatccatgttgtaatggctgtgatgttaaatacactgataacagtggtaaatggggtgttgaaaataataattggtgtaaaat

SEQ ID NO: 16598 - DNA, 108 bp, Anaeromyces robustus
  CBM_10
atgtaaatttgaagctcttggttacccatgctgttcacactgtgagtctatttatgaagataattcaggtaaatggggtgttgaaaataataattggtgtggtattcc

SEQ ID NO: 16599 - DNA, 108 bp, Anaeromyces robustus
  CBM_10
ttggtctcttaaattaggttattcatgttgtacatcaaatgatattattttatattctgatgcagatggtgattggagtgtagaaaataatgagtggtgtggtataat

SEQ ID NO: 16600 - DNA, 117 bp, Anaeromyces robustus
  CBM_10
atgttgggctgattattttaattataaatgttgtagtaccagaaattgtagaagcgtttatcttacagatgcaaatggagattgggatatagaagatggtcaatggtgtggtattac

SEQ ID NO: 16601 - DNA, 105 bp, Anaeromyces robustus
  CBM_10
ttggtcaaaagaattaggttttccatgttgtaaaggatgtttagttattgataaagatgaatttggatcatggggatttgaattagatcattggtgtggtattca

SEQ ID NO: 16602 - DNA, 120 bp, Anaeromyces robustus
  CBM_10
atgttgggcacaattagtaggttatggatgttgtccagaaggtacaaatgatgtatattatgaagatagttatggtaaatggggtatagatcttaaaaaggaagattggtgtggtattac

SEQ ID NO: 16603 - DNA, 114 bp, Anaeromyces robustus
  CBM_10
ttgttgggctgaacttttaggatataattgttgtaaaagtaagaatccaattattattcaaactgatgaatatggtgattgggcaattgaaaagaataattggtgtggtattcc

SEQ ID NO: 16604 - DNA, 111 bp, Anaeromyces robustus
  CBM_10
atgttgggcaagtagtttaggtttcccatgttgtcaatcctctaaagtagttttccgtacggattctaatggttcatggagtcttgaaaatgatgaatggtgtggtattat

SEQ ID NO: 16605 - DNA, 114 bp, Anaeromyces robustus
  CBM_10
atgttgggctaaaagtttaggatttaaatgttgtactggttcaaaaccaaccgtagtttatacagataataatggagattggagtgtagaaaatgatgaatggtgtggtattat

SEQ ID NO: 16606 - DNA, 99 bp, Anaeromyces robustus
  CBM_10
taataaatacccatgttgtaaaaattcaaaagccaaaatgcaagcatttgaaatggacggatttcttggtgttgaaaataattcttattgtggtataaa

SEQ ID NO: 16607 - DNA, 105 bp, Anaeromyces robustus
  CBM_10
ttgggctaataaatttggatatgattgttgtaaatcaggtgccgtatttgttactaaagatagtgatggagattggggtattgaaaatggtaaatggtgtggatt

SEQ ID NO: 16608 - DNA, 114 bp, Anaeromyces robustus
  CBM_10
atgttgggctaaaaaaattggatatgaatgttgtaaagattctaaaacttatgccatatataccgataataatggagattggggtgttgaaaatgaagtatggtgtggtattat

SEQ ID NO: 16609 - DNA, 111 bp, Anaeromyces robustus
  CBM_10
atgttgggctaaatctttaggttataaatgttgtaccagtaaagccatttattatgcctccgataatgatggtgattggggtattgaaaatgatgattggtgtggtattat

SEQ ID NO: 16610 - DNA, 102 bp, Anaeromyces robustus
  CBM_10
ttgttgggcttatcaattaggttataaatgttgtaaaaaaagtgaaacagtagaagtagaaagtggttatggtgtacttaatggtaattggtgtggtattat

SEQ ID NO: 16611 - DNA, 105 bp, Anaeromyces robustus
  CBM_10
ttggtcagaagtatttggttatccatgttgtgaaagttgttacgtttttgaaactgatgattatggaaaatggggttatgaaaataatcattggtgtggtattca

SEQ ID NO: 16612 - DNA, 117 bp, Anaeromyces robustus
  CBM_10
atgttgggctgaacttgctggttacccatgttgttctgaaagaataaagattgtttatgaacatgatgaatttggtgattggggttatgattactctattaaacaatggtgtggtct

SEQ ID NO: 16613 - DNA, 105 bp, Anaeromyces robustus
  CBM_10
ctggtcaaaaaaattaggatattcatgttgtgaaggatgtaaagttattgaaacagatgaagatggatcatggggatatgaatatgatcaatggtgtggtattcc

SEQ ID NO: 16614 - DNA, 111 bp, Anaeromyces robustus
  CBM_10
tttatcagaattaatcggatatgcatgttgttcattagaattaacatccatttatactgatgaatatggagattggggttatgattataataaaaaagaatggtgtggcct

SEQ ID NO: 16615 - DNA, 114 bp, Anaeromyces robustus
  CBM_10
atgttggtctaagaaacttggttataattgttgtactgcaaaatgcccaaaagaatattatattgataatgatggaagttggggtgttgaaaataataattggtgtggtattct

SEQ ID NO: 16616 - DNA, 111 bp, Anaeromyces robustus
  CBM_10
atgttggtcacttaaacttggatataaatgctgtaagaaaaacaatatggttgttttaactgatacagatggtcaatggggtgtagaaaataatgaatggtgtggaattgt

SEQ ID NO: 16617 - DNA, 117 bp, Anaeromyces robustus
  CBM_10
atgttggtctgaagctttaggttacaaatgttgttcaaaaggttgtgatgctgtagttttagctattgacaatagtggtaactggggagctgaaaatggtgaatggtgtggtattca

SEQ ID NO: 16618 - DNA, 108 bp, Anaeromyces robustus
  CBM_10
atgtccaggaaagaaatatggttattcatgttgtgaaacctgtgatgtttatttaaatgatgatgaaggtaaatggggtgttgataatggatattggtgcagtattaa

SEQ ID NO: 16619 - DNA, 111 bp, Anaeromyces robustus
  CBM_10
atgttggtcagaaatttttggttatccatgttgtaaaagttgtgttgtttatgaagaagaagaagaatatggtaaatggggttatgaaaataatcaatggtgtggtattca

SEQ ID NO: 16620 - DNA, 108 bp, Anaeromyces robustus
  CBM_10
ttgggcaaataatttaggttatccatgttgttcaagtaatactcaagtaatttatacagataataatggtcaatggggtgttgaaaacaataattggtgtggtattgt

SEQ ID NO: 16621 - DNA, 105 bp, Anaeromyces robustus
  CBM_10
cttttcaactagattaggttacccatgctgtactaaaactacagctgttgtttaccatgacaatgatggtgactggggtgttgaagacaatcattggtgtggtct

SEQ ID NO: 16622 - DNA, 108 bp, Anaeromyces robustus
  CBM_10
atgttggtcagaatctcaaggttacaagtgttgtaaaacatgtgttgttgtttacgttgatgaatttggatcttggggtgttgaaaatgatcaatggtgtggtgttaa

SEQ ID NO: 16623 - DNA, 108 bp, Anaeromyces robustus
  CBM_10
ttgttggtcaagcggttatggctacccatgttgtactacatgtaaggtttattacgaagattactctggtgaatggggtgtagaaaatggcgattggtgtggtatcgt

SEQ ID NO: 16624 - DNA, 111 bp, Anaeromyces robustus
  CBM_10
ttgctgggctgaaaaattaggttactcttgctgtacttctacttctcaagttgtttacactgatggtgatggtaactggggtgttgaaaacggtaactggtgtggtattcc

SEQ ID NO: 16625 - DNA, 111 bp, Anaeromyces robustus
  CBM_10
tttttctgaatctttaggatatccatgttgtagaaaacaaaatccaaaagtttattatactaatgaagatggagaatggagtgttgaaaatggtaaatggtgtggtgttat

SEQ ID NO: 16626 - DNA, 108 bp, Anaeromyces robustus
  CBM_10
ctgggctacagctcatggatataactgttgttcaggatgtaaagtaatttttgaagaaactgaaacaatgaaatggggtgttgaaaatcatgaatggtgtggtattgt

SEQ ID NO: 16627 - DNA, 84 bp, Anaeromyces robustus
  CBM_10
tggatacccatgttgtaatgattgtagagttgtttaccaagatgaatataactggggtgttttaaataaccaatggtgtgtaac

SEQ ID NO: 16628 - DNA, 111 bp, Anaeromyces robustus
  CBM_10
atgcttttcatcaaaattaggttatccatgttgtacatctactacagatatttattattctgataatgatggaaaatggggtattgaaaatggtaattggtgtggaattgt

SEQ ID NO: 16629 - DNA, 114 bp, Anaeromyces robustus
  CBM_10
ttgggctgaagtacttggattcccatgttgtagcaccgataaatgtagaactgtctatttcactgatgatgatggtgaatgggatgttgaaaacaataattggtgtggtattac

SEQ ID NO: 16630 - DNA, 108 bp, Anaeromyces robustus
  CBM_10
ttgggctactgctttaggatacccatgttgtacaactactactgatgttgtctttactgacaatagtggtgattggggtgttgaaaaaggtaattggtgtggtattgt

SEQ ID NO: 16631 - DNA, 90 bp, Anaeromyces robustus
  CBM_10
tgaaaaatataaatgttgtaaaagttgtgatatattttatgttgataattataaatggggtgttgaaaataatgaatggtgttctattcc

SEQ ID NO: 16632 - DNA, 120 bp, Anaeromyces robustus
  CBM_10
atgttggtcagaagttcatggttatccatgttgtgaattaaaaaccactcaagttgaatttacagatagtagtaccggtgaacaatatggaattgaaaatggccgtatttgtggtataaa

SEQ ID NO: 16633 - DNA, 93 bp, Anaeromyces robustus
  CBM_10
ttcttacccatgctgtgaaaatacttgtgctgttcaatatactgacgctgatggtcaatggggtattgaaaatggaaattggtgtggtatgag

SEQ ID NO: 16634 - DNA, 93 bp, Anaeromyces robustus; identical to SEQ ID NO: 16633
  CBM_10

SEQ ID NO: 16635 - DNA, 108 bp, Anaeromyces robustus
  CBM_10
atgtttttctgaaaatcttggttataaatgttgtaaaggtaatacaatttattacactgataataatggtgcatggggtattgagaatggtgaatggtgtggtattga

SEQ ID NO: 16636 - DNA, 105 bp, Anaeromyces robustus
  CBM_10
tttttcagtaaaacttggttttaaatgttgtaaaggtaataatattatttatactgataaagatggtgattggggtgttgaagatgatgaatggtgtggtatttc

SEQ ID NO: 16637 - DNA, 111 bp, Anaeromyces robustus
  CBM_10
ttgggctaaaacatatggttttgaatgttgtacaagagaagaagctgatatcgttcttgttgatgaattaggtccatggggtattaaagacgataagtggtgtggtattat

SEQ ID NO: 16638 - DNA, 108 bp, Anaeromyces robustus
  CBM_10
ttgttggtctgaaatttttggttattcatgttgtaaaggatgtactatttatgaagttgataatgatggttcatggggttatgaaaatggagaatggtgtggtattca

SEQ ID NO: 16639 - DNA, 114 bp, Anaeromyces robustus
  CBM_10
tattgctgaattaattggttataaatgttgttcaccaaataatactaaagtatatgcacatgatgaaaatggtgattggggttatgattttaaaaaaggagaatggtgtggtct

SEQ ID NO: 16640 - DNA, 100 bp, Anaeromyces robustus
  CBM_10
ttggtctgttgatttaggttatccatgttgtaaatctactaatgaagtttatgtaactgatgaaaatggtaaatggggtttagaaaataataactggtgt

SEQ ID NO: 16641 - DNA, 111 bp, Anaeromyces robustus
  CBM_10
atgtttctccttagcattaggttattcttgttgtcaaaaaactactgccgttatttatgaagataaagatggtaaatggggtattgaaaataatcaatggtgtggtattaa

SEQ ID NO: 16642 - DNA, 114 bp, Anaeromyces robustus
  CBM_10
atgttggtctacagctttaggttacccatgttgtactaatgcaaatttagatgtacttttcactgatgatgatggtgattggtctatcgaaaataataactggtgtggtataag

SEQ ID NO: 16643 - DNA, 108 bp, Anaeromyces robustus
  CBM_10
atgctggtctcttatattaggttataagtgctgtagttcatgcttacctattgtggaaacagatagtagtggtaattggagtattgaagataatcaatggtgtggtct

SEQ ID NO: 16644 - DNA, 108 bp, Anaeromyces robustus
  CBM_10
tttttcagaacgtttaggtttcccatgttgtccacctggtacaaaagttgaatactctgatgaggaaggggattggggtattataaacgaagaatggtgtggtattag

SEQ ID NO: 16645 - DNA, 114 bp, Anaeromyces robustus
  CBM_10
ttgggctgaagaatttggttatccatgttgttcaaatcttaataataaaattgtttattacattgatgaatatggtaataaatggggtgttgaaaatgatgattggtgtggttt

SEQ ID NO: 16646 - DNA, 108 bp, Anaeromyces robustus
  CBM_10
ttgggcagaaaaattaggttatccttgttgttcttcttctaaaaatgtattatttgaagataatgatggtcaatggagtgttgaaaatgataattggtgtggtattcc

SEQ ID NO: 16647 - DNA, 108 bp, Anaeromyces robustus
  CBM_10
ttggtctgaagctttaggttacccatgttgttctacttgttccagtcctgtctacagtgataatgatggtaactggggtgttgaaaatggtgactggtgtggtattac

SEQ ID NO: 16648 - DNA, 109 bp, Anaeromyces robustus
  CBM_10
taaaaatcaaactaatggttgtccaaagactgattatccatgttgtagtcattgtgatgtattatttactgatagaactgctcgttggggtattgaaaacaatgattgg

SEQ ID NO: 16649 - DNA, 108 bp, Anaeromyces robustus
  CBM_10
ttgggctgctgccttaggttataaatgttgtaatcattgtaatgtagttgaaactgatgatcaagatcatgaatggggttcattgaatggtgaatggtgtggtattaa

SEQ ID NO: 16650 - DNA, 108 bp, Anaeromyces robustus
  CBM_10
tttttcagagagacttggttatccatgttgtaaatacactagcaaagttgaatacgttgatgccgatggtgactggggtgttgaaaacggtgactggtgtggtatgcc

SEQ ID NO: 16651 - DNA, 108 bp, Anaeromyces robustus; identical to SEQ ID NO: 16650
  CBM_10

SEQ ID NO: 16652 - DNA, 108 bp, Anaeromyces robustus
  CBM_10
atgttgggctgaagcttatggttatagttgttgtagtaaatgtgttaaagttattgatacctcatataataaaaaatggggtttagaaaatggaaaatggtgtggtct

SEQ ID NO: 16653 - DNA, 90 bp, Anaeromyces robustus
  CBM_10
ttctccagcttataaatgttgttcatcatgtattgtttatttcgaagataattataaatggggaactatgaatggtgaatggtgtagtct

SEQ ID NO: 16654 - DNA, 81 bp, Anaeromyces robustus
  CBM_10
taaatgttgtaatagttgtgatatagtttatacggattttcaatattggggttatgaaaataatgaatggtgttctattcc

SEQ ID NO: 16655 - DNA, 108 bp, Anaeromyces robustus
  CBM_10
ttgtttttctttagcccaaggttatccatgttgtcaatcgtgcaaagtattatacactgataaatctggtaaatggggtgtagaaaatggtaaatggtgtggtataaa

SEQ ID NO: 16656 - DNA, 108 bp, Anaeromyces robustus
  CBM_10
ttgtttttctgttgctatgggatacccatgttgtacaggaaataaaattgtctatacggataaaagtggaaattggggtatagaaaataataaacggtgtggtattgg

SEQ ID NO: 16657 - DNA, 114 bp, Anaeromyces robustus
  CBM_10
atgtttttctaaaacattaaaaccttcttatccatgttgtaaaggtaataaagttgtttataccgataaaaatggaaattggggtttcgaaaataataaatggtgtggtattgg

SEQ ID NO: 16658 - DNA, 111 bp, Anaeromyces robustus
  CBM_10
atgttggtcaaaggctcaaggttatgattgttgtgctgaaggaacttccgttttccttgaagatgaaagtggtgattggagtgctgacaatggtgaatggtgcggtgttat

SEQ ID NO: 16659 - DNA, 117 bp, Anaeromyces robustus
  CBM_10
ttgttggtctgagaccctgggttatccatgttgtaatactaatggatgtcaaactatttatttcatcgattcaaatggtatgtggagtgttgaaaatgataattggtgtggtataac

SEQ ID NO: 16660 - DNA, 111 bp, Anaeromyces robustus
  CBM_10
ttgggctcatagattaggttttcaatgttgtaaaaattataaaattgaagttgcctattctgattctgatggtgattggggtatcgaaaatggtgaatggtgcggtattga

SEQ ID NO: 16661 - DNA, 93 bp, Anaeromyces robustus
  CBM_10
aggatacaaatgctgttctgataattgtataatttattataatgatgaagatggtgattggggtgtcgaaaatggtgaatggtgtggttgtgg

SEQ ID NO: 16662 - DNA, 117 bp, Anaeromyces robustus
  CBM_10
atgttctgctaatattcttaaacaaggttataaatgttgtccagataactgtgtagtaacatatgtagatgctgatggtgattggagtatcgatggtcaagaatggtgtggttgtgg

SEQ ID NO: 16663 - DNA, 93 bp, Anaeromyces robustus; identical to SEQ ID NO: 16661
  CBM_10

SEQ ID NO: 16664 - DNA, 117 bp, Anaeromyces robustus; identical to SEQ ID NO: 16662
  CBM_10

SEQ ID NO: 16665 - DNA, 117 bp, Anaeromyces robustus
  CBM_10
tttttcaaaatttttaggatctccatatccatgttgtagtccagacaatcaaaaaatagaatttattgatcatgatggtttatggggtagagaaaacggtaaatggtgtggaataat

SEQ ID NO: 16666 - DNA, 96 bp, Anaeromyces robustus
  CBM_10
aagttctggttataaatgttgtcctaacgctaaagaagtacaatcagatgataatggatcatggggttatgttgatggtcaatggtgtggtattag

SEQ ID NO: 16667 - DNA, 114 bp, Anaeromyces robustus
  CBM_10
ttgctggtcaactaaattaggatatccatgttgtagtgccggtaacaaagatgtttattataatgacgatgatggattatggggtgttgaaaataataactggtgtggtattcc

SEQ ID NO: 16668 - DNA, 63 bp, Anaeromyces robustus
  CBM_10
ttgctggtcaactaaattaggatatccatgttgtagtgccggtaacaaagatgtttattataa

SEQ ID NO: 16669 - DNA, 99 bp, Anaeromyces robustus
  CBM_10
aaatggatatcaatgttgtaaagattcatccactcaagttatcttaacagatgatgatggtacttggggtattgaaaataatcattggtgtcatattaa

SEQ ID NO: 16670 - DNA, 108 bp, Anaeromyces robustus
  CBM_10
ttgttggtcaaatgcattaggatatgaatgttgtaaaggatgtactgtaattgaatcggatgcaagtggtgattggggtattgaaaataatcaatggtgtggtattcc

SEQ ID NO: 16671 - DNA, 111 bp, Anaeromyces robustus
  CBM_10
atgctggtcattaaaacatggatatccatgttgtcaaaaaactaaagttgttactcttgaagatgaaaatggaaaatggggtgttgaaaatgatgattggtgtggtattat

SEQ ID NO: 16672 - DNA, 111 bp, Anaeromyces robustus
  CBM_10
atgtccatttgaaaaatatggttatccatgctgtgaaataactaatattgttgtatacacagatgatatgggtaaatggggtattgaaaatgatgtatggtgtggtattgt

SEQ ID NO: 16673 - DNA, 108 bp, Anaeromyces robustus
  CBM_10
ttgtaccgctcaagaccaaggatataaatgttgttctacctgtaatgtagtttacactgatgaatctggtgactggggtgttgaaaataatgaatggtgtttaattaa

SEQ ID NO: 16674 - DNA, 111 bp, Anaeromyces robustus
  CBM_10
atgttggtcagaaagatttggttatccatgttgtacttcttcatgtcatgtttatgaaactgatgataatggtgaatggggttatgaaaatcaacactggtgtggtatttt

SEQ ID NO: 16675 - DNA, 111 bp, Anaeromyces robustus
  CBM_10
atgttggtctgaagtttttggttttccatgttgtacttcttcatgtcatgtttatgaaattgatgatagtggtgaatggggttatgaagataatcattggtgtggtattcc

SEQ ID NO: 16676 - DNA, 106 bp, Anaeromyces robustus
  CBM_10
atgttgggctaatgaacttggttacaaatgttgtccaaaaggttgtgatgctactgtcgttgttgaagatgatctcggtaaatggggtatccttggtggtgaatgg

SEQ ID NO: 16677 - DNA, 114 bp, Anaeromyces robustus
  CBM_10
ttgttggtctgaaaaattaggttacccatgttgtccagctaatcgttgtagagtttatactaccgataaggatggaaaatggggttacactaaaaacagttggtgtggtattga

SEQ ID NO: 16678 - DNA, 120 bp, Anaeromyces robustus
  CBM_10
atgttggtcagaattaattggatatccatgttgtgattcttccgtaacaaccgtatttgttcaagatgattatggagattggggatatgattttaataaaaatgaatggtgtggaataac

SEQ ID NO: 16679 - DNA, 102 bp, Anaeromyces robustus
  CBM_10
aggttcaggttatgcttgttgtaaatttaatactactactgttactactaccgattatactggtaaatggggtattgaaggtttaagatattgtcttatcga

SEQ ID NO: 16680 - DNA, 99 bp, Anaeromyces robustus
  CBM_10
aggatatccatgttgtactaaaaagacaagtaatgttaattatattagtaaaaatggagatcaatatggttatgaaaataataaatggtgtggtataac

SEQ ID NO: 16681 - DNA, 90 bp, Anaeromyces robustus
  CBM_10
tgaaaaatacaagtgttgtaattcttgtaaagttcgttacaccgataattatgaatggggtgttgaagatggtgaatggtgttctattcc

SEQ ID NO: 16682 - DNA, 90 bp, Anaeromyces robustus
  CBM_10
tgaaaaatacaagtgttgtaattcttgtaaagttcgttacaccgatgactatgaatggggtgttgaaggtggtgaatggtgttctattcc

SEQ ID NO: 16683 - DNA, 120 bp, Anaeromyces robustus
  CBM_10
atgttggtcagaattaattggatataaatgttgtgctcctaatgttactgcaatttatgcaagtgatgaatatggatattggggttatgactttgaaaataatgaatggtgtggtattac

SEQ ID NO: 16684 - DNA, 69 bp, Anaeromyces robustus
  CBM_10
ttggtcacaaaaatatggttatccatgttgtcaaacttgtatagtatatcataatgataatgaaggttc

SEQ ID NO: 16685 - DNA, 105 bp, Anaeromyces robustus
  CBM_10
ttggtcacaaaaatatggttatccatgttgtcaaacttgtatagtatatcataatgataatgaaggttcatggggatatgaatataacggttggtgtggtattcc

SEQ ID NO: 16686 - DNA, 120 bp, Anaeromyces robustus; identical to SEQ ID NO: 16683
  CBM_10

SEQ ID NO: 16687 - DNA, 105 bp, Anaeromyces robustus
  CBM_10
atgttggtctgaaaaaatcggatataaatgttgtactgatgcagaaatttatttaacagacacatttggacattggagtattgaagatggagaatggtgtcttgt

SEQ ID NO: 16688 - DNA, 111 bp, Anaeromyces robustus
  CBM_10
ttgttttgccgaaaaattaggttattcatgttgtatatctccttcatcggctgttttacatgaagataaagatggtaaatggggtattgaatatggtaaatggtgtggttt

SEQ ID NO: 16689 - DNA, 114 bp, Anaeromyces robustus
  CBM_10
atgttggtctgaaaaaattggatataaatgttgtagttcacctaatgcagtccttcaattaacagatatatttggatattggagtgttgaagaggatgaatggtgttttataag

SEQ ID NO: 16690 - DNA, 108 bp, Anaeromyces robustus
  CBM_10
tttttctgaaaaattaggttttccttgttgttcagatccttcaactgttatagtatttgtagatgaaagtggtgaatggggcgtcgaaaatgatggatggtgtggttt

SEQ ID NO: 16691 - DNA, 108 bp, Anaeromyces robustus
  CBM_10
tttttctgaaaaattaggttttccttgttgttcagatccttcaactgttgtagtatttgtagatgaaagtagtgaatggggcgtcgaaaatgatggatggtgtggttt

SEQ ID NO: 16692 - DNA, 111 bp, Anaeromyces robustus
  CBM_10
atgttggtctaaaataattggatatgaatgttgtagttcaccgaatccacatatttatgtaacagacatattgggtcattggagtattgaaaatggtgattggtgttatgt

SEQ ID NO: 16693 - DNA, 105 bp, Anaeromyces robustus
  CBM_10
atgtttctcagaaccatattttccatgttgtaaagaaaataaagttgtattagttgatgaagaaggtgaatggggtatagaaaataaaaaatggtgtggtatttc

SEQ ID NO: 16694 - DNA, 108 bp, Anaeromyces robustus
  CBM_10
atgtttttcattaagtcatgggtataaatgctgtgaaacatgtaatgttgtagaaaagggaaaagaaggtgattggggaattgaaaatcataaatggtgtggaataaa

SEQ ID NO: 16695 - DNA, 111 bp, Anaeromyces robustus
  CBM_10
atgttggtcagaagaacaaggatattcatgttgtcaaggatgtaatattcttttagttgaagaaggacaacaaaaatggggatttgaaaataataaatggtgtggaattgt

SEQ ID NO: 16696 - DNA, 63 bp, Anaeromyces robustus
  CBM_10
atgttggtcaatgccattaggttacccatgttgtgtaggaaatgatgtttataagaaagatgt

SEQ ID NO: 16697 - DNA, 117 bp, Anaeromyces robustus
  CBM_10
ttgttcaacttcaattttaaatcaaggttacagttgttgttcatctgaatgtattgttgttcttaccgatagcgatggtacatggggttatgaaaataataaatggtgtggatgtaa

SEQ ID NO: 16698 - DNA, 93 bp, Anaeromyces robustus
  CBM_10
aggttataaatgttgttctgacaattgtcttgttgtatatactgatgatgatggtacatggggttatgaaaatgataaatggtgtggatgtga

SEQ ID NO: 16699 - DNA, 96 bp, Anaeromyces robustus
  CBM_10
aggttattcatgttgtagtgaaaataactgtaaaataagatatgtagatgaagatggtaattggggtgctgaaaacggccaatggtgcggtatttc

SEQ ID NO: 16700 - DNA, 105 bp, Anaeromyces robustus
  CBM_10
ttggtccaatgaatataattatccttgttgtaaaacttgtatagtatatgaaatagatgataaaggatcatggggttatgaaaataatgaatggtgtggtattcc

SEQ ID NO: 16701 - DNA, 96 bp, Anaeromyces robustus
  CBM_10
acaaggttataaatgttgtagttctatttgtaaacaaccatatgttgatgaaaatggtgaatggggtgttgaagatggtaaatggtgtggatgtat

SEQ ID NO: 16702 - DNA, 109 bp, Anaeromyces robustus
  CBM_10
ttgtccatcaaccattactaacaaaggttattcatgttgttcaacatgttccaaagttcgttatgttgatgaagatggtaaatggggtgttgaaaaccatcaatggtgt

SEQ ID NO: 16703 - DNA, 114 bp, Anaeromyces robustus
  CBM_10
atgttgggctaaagaatttggttataactgttgttccaaggataaccaaaatgttatttacactgaagaaatgtattcatggggttatgaaaatgataattggtgtggtattgt

SEQ ID NO: 16704 - DNA, 114 bp, Anaeromyces robustus
  CBM_10
atgttgggctaaagaatttggttataactgttgttccaaggataaccaaaatgttatttacactgaagatatgtattcatggggttatgaaaaagatgaatggtgtggtattgt

SEQ ID NO: 16705 - DNA, 114 bp, Anaeromyces robustus
  CBM_10
atgttgggctagagaatcaggttatgattgttgttccgaagataaccaaaaggttatttacactgatgaaatgggttcatggggttatgaaaatgataattggtgtggtattat

SEQ ID NO: 16706 - DNA, 112 bp, Anaeromyces robustus
  CBM_10
tccatttgctattacttcccaaggatacaaatgttgttcaaaggattgtttcatagtttttactgatgatgatggtacatggggtattgaaaatgatcaatggtgtggttgt

SEQ ID NO: 16707 - DNA, 57 bp, Anaeromyces robustus
  CBM_10
ttttactgatgatgatggtacatggggtattgaaaatgatcaatggtgtggttgtga

SEQ ID NO: 16708 - DNA, 105 bp, Anaeromyces robustus
  CBM_10
tcctggtataaaattaggttattcatgttgtgaaaaatgtaatagtttaattactaataaagatggttcatggagtttagaaaattttaaaatatgtagtattaa

SEQ ID NO: 16709 - DNA, 73 bp, Anaeromyces robustus
  CBM_10
tttttcaattaattttggatttccatgttgtagtagttgtgtttattattatgaagatgatgatggaaaatgg

SEQ ID NO: 16710 - DNA, 108 bp, Anaeromyces robustus
  CBM_10
atgttgggctcaaaatcaaggttatcaatgttgtacttcatgtgatattgtttatgaagataatgatggttcatggggaattgaaaatggtgattggtgtggaattaa

SEQ ID NO: 16711 - DNA, 108 bp, Anaeromyces robustus
  CBM_10
ttgtactggtattgaggatggttatccatgttgtaagacatgtaatgctatttacaatgatgaacaaggaccatgggagatggaaaataataaatggtgtggtattcc

SEQ ID NO: 16712 - DNA, 111 bp, Anaeromyces robustus
  CBM_10
aacaggtagggcaccaaatggttatccatattgtaaaggttgtattgttacagctaccggtggtagaaattcatattggggatgggaaaataatgcttcatgttttattaa

SEQ ID NO: 16713 - DNA, 111 bp, Anaeromyces robustus
  CBM_10
tgctgatatggctcctaatggtttcccttattgtgaaggttgtgaaattggtgctactagtagtgatggtactatttggggttatgaaaatgaacaatcttgtgttattaa

SEQ ID NO: 16714 - DNA, 105 bp, Anaeromyces robustus
  CBM_10
cttggcaccaaatggttatccatattgtaaaaaatgtgatattactgctactggtagtggacgttctctttggggatgggaaaataatgcttcatgttttattga

SEQ ID NO: 16715 - DNA, 99 bp, Anaeromyces robustus
  CBM_10
accaaatggttatccatattgtaaaggttgtattgttacagctaccggtggtagaaattcatattggggatgggaaaataatgcttcatgttttattaa

SEQ ID NO: 16716 - DNA, 99 bp, Anaeromyces robustus
  CBM_10
tcctaatggtttcccttattgtgaaggttgtgaaattggtgctactagtagtgatggtactatttggggttatgaaaatgaacaatcttgtgttattaa

SEQ ID NO: 16717 - DNA, 99 bp, Anaeromyces robustus
  CBM_10
accaaatggttatccatattgtaaaaaatgtgatattactgctactggtagtggacgttctctttggggatgggaaaataatgcttcatgttttattga

SEQ ID NO: 16718 - DNA, 111 bp, Anaeromyces robustus
  CBM_10
atgtttttcagttaaattaggatatccatgttgtactaaaactaatgaagttatttacactgatgaacaaggtcaatggggtgttgaagattatcattggtgtggtattga

SEQ ID NO: 16719 - DNA, 120 bp, Anaeromyces robustus
  CBM_10
gtgttggtcattaaaattacaaccagcttatccatgttgttatatgagaaataaagaagttgtatccattgattctaatggtaaatggagtactgaacatggtacatggtgtggcataat

SEQ ID NO: 16720 - DNA, 75 bp, Anaeromyces robustus
  CBM_10
ttgttggtccactagattaggttacccatgttgtgaagatagtaatgttgtttacgctgttgatgaaaatggtat

SEQ ID NO: 16721 - DNA, 111 bp, Anaeromyces robustus
  CBM_10
ttgttggtccactagattaggttacccatgttgtgaagatagtaatgttgtttacgctgttgatgaaaatggtatttggggttatgaaaataaacattggtgtggtattat

SEQ ID NO: 16722 - DNA, 111 bp, Anaeromyces robustus
  CBM_10
ttgtttttctattgaattaggatatccatgttgtcaaacatcatgtgaggtatactacattgatgaagatggtgattggggaatagaagataatcattggtgtggtatagg

SEQ ID NO: 16723 - DNA, 106 bp, Anaeromyces robustus
  CBM_10
ttgtttttctgttgctcttggctatccatgttgtgaatcatcttgtaacgtatattacacagataatgatggtgaatggggtgtagaaaatggaaattggtgtggc

SEQ ID NO: 16724 - DNA, 66 bp, Anaeromyces robustus
  CBM_10
taacgtatattacacagataatgatggtgaatggggtgtagaaaatggaaattggtgtggtattgg

SEQ ID NO: 16725 - DNA, 114 bp, Anaeromyces robustus
  CBM_10
ttgctgggctactaagcttggttataagtgttgtactgctaaatgtccagaagtttcttacgttgaccaagatggtgcttggggtattgaaaatggtaattggtgtggtattat

SEQ ID NO: 16726 - DNA, 102 bp, Anaeromyces robustus
  CBM_10
agaaaaattaggttatccatgttgtagtgaaactactgatgttgtatctgttgatgctaatggaaaatggggtttagaaaatggtactatctgtggtattaa

SEQ ID NO: 16727 - DNA, 105 bp, Anaeromyces robustus
  CBM_10
atgtttctcattcccaaactatctttgttgtaatgaatgtaatgttgtattagaagatgaagaaggtaaatggggttatgaaaacaacagatggtgtggtatcaa

SEQ ID NO: 16728 - DNA, 96 bp, Anaeromyces robustus
  CBM_10
taatgcttacaataactgtactcacacttgtagagtattagttactgaagacggtgttgaatggggagctgaaaataatgactggtgcattattga

SEQ ID NO: 16729 - DNA, 105 bp, Anaeromyces robustus; identical to SEQ ID NO: 16727
  CBM_10

SEQ ID NO: 16730 - DNA, 96 bp, Anaeromyces robustus; identical to SEQ ID NO: 16728
  CBM_10

SEQ ID NO: 16731 - DNA, 108 bp, Anaeromyces robustus
  CBM_10
ttggtcaaaggtattaggttatccatgttgcacagtcaatacttatgtttactatattgatgataatggtatgtggggtattgaaaacgacaactggtgtggtattaa

SEQ ID NO: 16732 - DNA, 96 bp, Anaeromyces robustus
  CBM_10
attcttatataattgttgtaaaaatacctgtaaattagttgccatacaagataaaatacaattaggtattgaaaatggtgaatattgttctatacc

SEQ ID NO: 16733 - DNA, 69 bp, Anaeromyces robustus
  CBM_10
atgtttttcagttaaattaggatatccatgttgtactaaaactaatgaagttatttacactgatgaaca

SEQ ID NO: 16734 - DNA, 108 bp, Anaeromyces robustus
  CBM_10
ttgttggtcaaaagattatggatacccatgttgtaagagttgttttgtttttgaagaaactgaagaaggtaaatggggttatgaagataatcattggtgtggtattca

SEQ ID NO: 16735 - DNA, 105 bp, Anaeromyces robustus
  CBM_10
tttctctcttccagaatacccatgttgtacttcaactaaaactgtaatgtatactgatgaaaagggaccatggggtattgaaaatggtaactggtgtggtattaa

SEQ ID NO: 16736 - DNA, 60 bp, Anaeromyces robustus
  CBM_10
tgttatattcactgattctaacggtcaatggggtattgaaaatggtaactggtgtggtaa

SEQ ID NO: 16737 - DNA, 91 bp, Anaeromyces robustus
  CBM_10
ttgggctaaatctcttggttacaactgttgttctacaagtagttgtagaactgctcaattcagcgatgctgatggtcaatgggatgttgaa

SEQ ID NO: 16738 - DNA, 106 bp, Anaeromyces robustus; identical to SEQ ID NO: 16723
  CBM_10

SEQ ID NO: 16739 - DNA, 91 bp, Anaeromyces robustus
  CBM_10
atgctgggctttgcaatatggatatacatgttgtgaagatgatacaatagtatacactgatgaactcggtgattggggtgttgaagatggt

SEQ ID NO: 16740 - DNA, 106 bp, Anaeromyces robustus
  CBM_10
tccatttgctattacttcccaaggttacaagtgttgtaaagaagataactgttcagtttttgaaactgatgatgatggtacatggggtattgaaaatgatcaatgg

SEQ ID NO: 16741 - DNA, 63 bp, Anaeromyces robustus
  CBM_10
tgtaatttaccatgataacgatggtgactggggtgttgaaaataaccaatggtgtttaattaa

SEQ ID NO: 16742 - DNA, 82 bp, Piromyces finnis
  CBM_10
ttttgctgaaaatctaggttaccaatgttgttctgatcctgaaactattgttattaccactgatgaatatggtgaatggggt

SEQ ID NO: 16743 - DNA, 106 bp, Piromyces finnis
  CBM_10
ttggagttcaaaatacggctatggatgctgtttcaatgataatgatgatgttatatatagagatgaaaaaggatcttggggaattgaaaataatcaatggtgtggt

SEQ ID NO: 16744 - DNA, 111 bp, Piromyces finnis
  CBM_10
atgctggtcagaaaaattaggtttcaagtgttgtagaattgatatacaaccgatattctctgattatgaagggatttggggagttgaagatgatcaatggtgtggtataat

SEQ ID NO: 16745 - DNA, 111 bp, Piromyces finnis
  CBM_10
ttcatttgaagtattaggatatcattgttgttcatctattaatccaaaagttgtcaaagaagattcatatggaaaatggggtgaagaagatggagaattatgtggtattgg

SEQ ID NO: 16746 - DNA, 91 bp, Piromyces finnis
  CBM_10
ttgctggtctgaagaattaggttatccatgttgtacctctactactaaggttgtttacactgatgaaagtggtaattggggtgttgaaaac

SEQ ID NO: 16747 - DNA, 105 bp, Piromyces finnis
  CBM_10
atgttggtctgaaccagaatatccatgttgtaaggaatcttgtacagtttactacgttgacgatcatcaatggggtattgaaaacggagaatggtgtggtattcc

SEQ ID NO: 16748 - DNA, 88 bp, Piromyces finnis
  CBM_10
tttatctgctgctgattacccatgttgtgaacaatgtaatattgtatctgaagaagaaggtgacttctggggtgtcgaaaacaatgaa

SEQ ID NO: 16749 - DNA, 99 bp, Piromyces finnis
  CBM_10
aaagcaaggattcccaatttgtaaagaatgtattataactgcaactggatctgatggtatatcattatggggatgggaaaatagtgagtcatgtcgtat

SEQ ID NO: 16750 - DNA, 105 bp, Piromyces finnis
  CBM_10
ttggtcctcttactatggttattcttgttgtagccactgtaatattttccttaccgatgaacttggtgactggggtgttgaaaacaaaaaatggtgtggtattaa

SEQ ID NO: 16751 - DNA, 108 bp, Piromyces finnis
  CBM_10
atgttggtctgaagaattaggttattcctgctgttctcattgtactgttcttcttaaggatgaatctggtttatggggtgctgaagatggtaagtggtgtggtattcc

SEQ ID NO: 16752 - DNA, 102 bp, Piromyces finnis
  CBM_10
caaggctcaaggttacccatgctgtaaatcctgtggtcaagttgtatatgttgacgaagatggtaaatggggtgtagaaaacaatgattggtgtggaattcc

SEQ ID NO: 16753 - DNA, 96 bp, Piromyces finnis
  CBM_10
tcaaggctacccatgttgttcaaaagaaactcaagtttattacactgatgaaagtggtgaatggggtgtcgaaaataacaattggtgtggaatatt

SEQ ID NO: 16754 - DNA, 114 bp, Piromyces finnis
  CBM_10
atgttgggcaacatctttaggatatccatgttgtaaagaagctaatccaataatattctacaaggatgaagacggtgattggggtattgaaaataattcctggtgtggaattat

SEQ ID NO: 16755 - DNA, 91 bp, Piromyces finnis
  CBM_10
tgaaagtggtgagcaatacaaatgttgtaaaaaatgtaacatttatgtaaatgaactcggtcaagattggggtattgaaaataatgattgg

SEQ ID NO: 16756 - DNA, 90 bp, Piromyces finnis
  CBM_10
aggttatgactgctgtgaaggttgtacaatagaaacagaagaagatggtataaaatggggttacgaaaatagaaattggtgtgtaattcc

SEQ ID NO: 16757 - DNA, 99 bp, Piromyces finnis
  CBM_10
cacaagatttggttttccttgttgcaacacatgtgaactccaatatattgatgactttggaaattggggttttgaaaatgataattggtgtggtatttc

SEQ ID NO: 16758 - DNA, 93 bp, Piromyces finnis
  CBM_10
attaggctatagatgttgtgattcatgtgaaattaaatttattgatgaaaatataaagtacggttatgaaaatggagaatggtgtggcattcc

SEQ ID NO: 16759 - DNA, 108 bp, Piromyces finnis
  CBM_10
tttttctgtaaaaatgggttatccatgctgtactcaaaattcagagattgtatatacagatagtactggtagttggggtcttcaaaatggtgattggtgtggtgtaaa

SEQ ID NO: 16760 - DNA, 106 bp, Piromyces finnis
  CBM_10
atgtttttcaaaagatcttggttttccatgttgttcaaagtacgctgaagttgttactaaagattataatggttcttggggtattgaaaatggtaaatggtgtggt

SEQ ID NO: 16761 - DNA, 114 bp, Piromyces finnis
  CBM_10
atgtttttcaaaagctctcggctatccatgttgctccgtcggtaacagtgatgttgcatttattgataacaatggtaaatggggtatagaaaatggcaattggtgtggaataac

SEQ ID NO: 16762 - DNA, 111 bp, Piromyces finnis
  CBM_10
atgttggtcagaacaatataattttccttgctgttcgccaggagtaaagattgactttactgataatagaggttcttggggtttagaaaattatagctggtgtggtattat

SEQ ID NO: 16763 - DNA, 105 bp, Piromyces finnis
  CBM_10
gtgtgccaaaaacaagaataatttaccatgctgttcaacatgtgaaattgcattgattgatggctctggtagatatggttatgaaaatggtcaatggtgtaatat

SEQ ID NO: 16764 - DNA, 105 bp, Piromyces finnis
  CBM_10
ttggtctcgtgctattggttttgtatgttgtgataaatgtaatgtactctttgttgatgaacaaggtaaatggagtgtcgaagatggttactggtgtggtattaa

SEQ ID NO: 16765 - DNA, 97 bp, Piromyces finnis
  CBM_10
atgcttttctgaaaatttaggatattcttgttgtgaagaatgtaatgtggtttataccgataatgatggtaagtggggatatgaaaataatgaatgg

SEQ ID NO: 16766 - DNA, 108 bp, Piromyces finnis
  CBM_10
atgcttttctgaggttttaggatatccttgttgtaatgaatgctctattatttattctgatgctgatggcgactggggatatgaaaatggaatgtggtgtggaattaa

SEQ ID NO: 16767 - DNA, 108 bp, Piromyces finnis
  CBM_10
atgttggtctgaaaaatttggaataccttgttgtaaggaggcactaatgccacttcgtactacttacgatggtggatggagtcaagaaaatggtgaatggtgtggttt

SEQ ID NO: 16768 - DNA, 99 bp, Piromyces finnis
  CBM_10
tacttcttactcttgttgtatctttgatgataccctaatcattacttccgatagcactggaaattggggttttgaaggagatagatggtgtttaattaa

SEQ ID NO: 16769 - DNA, 120 bp, Piromyces finnis
  CBM_10
gtgttgggctaaagctcaaggttataattgttgtgaaaaacgtactaccgccgttacctacgttgataaaaagactggtgaagaatggggttatgaaggtggaaaatggtgtggtattac

SEQ ID NO: 16770 - DNA, 102 bp, Piromyces finnis
  CBM_10
cagtgatgaatatgcttgttgtaaaggatgtgacgtagtatccgtcacttccaatggtaatagtaaatggggtgtagaaaataaaaaatggtgttctattcc

SEQ ID NO: 16771 - DNA, 108 bp, Piromyces finnis
  CBM_10
tttttcacttaaattgggttacccatgttgttctactactacaacagtagttacttcagatagtgatggcgattggggtattgaaaataatagttggtgtggtattga

SEQ ID NO: 16772 - DNA, 108 bp, Piromyces finnis
  CBM_10
atgctggtcattaaaacaaggttattcatgttgtagaggttgtaaagttcaaactaaagatgaatatggaaagtggggtatagaaaataatgaatggagtggtattcc

SEQ ID NO: 16773 - DNA, 102 bp, Piromyces finnis
  CBM_10
tttctctttcccagaatatatgtgctgtgaaggatgtgaagttgttgaagaaaccgctgaaggaaagtggggtattgaaaagaacaattggtgtggtattaa

SEQ ID NO: 16774 - DNA, 108 bp, Piromyces finnis
  CBM_10
ctggtctgaaccattaggtttcccatgctgttctgaatgtgttgaaccagaacgtgttgatgacaatggtgaatggggtattgaaaacaatgaatggtgcggtattta

SEQ ID NO: 16775 - DNA, 99 bp, Piromyces finnis
  CBM_10
ccaaggttataagtgttgtaagtctggatgccaagttgtttaccaagatgctgatggtgattggggtgttaactcccaaggatactggtgtggtattcc

SEQ ID NO: 16776 - DNA, 117 bp, Piromyces finnis
  CBM_10
ttggagtgaagaacttggttacagatgctgtaacaatggtgaaagtattgttgaatacattgatgaaagtggatggtggggtgttactaaggacacaaaggaatggtgtggtattat

SEQ ID NO: 16777 - DNA, 73 bp, Piromyces finnis
  CBM_10
ctgttggtctcttgctttaggctattcatgttgtaaatcttgtataggtactgtttacactgatgaaagtggt

SEQ ID NO: 16778 - DNA, 51 bp, Piromyces finnis
  CBM_10
tgatgaaagtggtaattggggtattgaaaaggatgattggtgtggtattcc

SEQ ID NO: 16779 - DNA, 102 bp, Piromyces finnis
  CBM_10
tggtgctcaaggttactcatgctgtaaatctagttgtaccgtttactttgaagattctgatggtaaatggagtattgaaaatgacgactggtgtttaattaa

SEQ ID NO: 16780 - DNA, 102 bp, Piromyces finnis
  CBM_10
tttctccttcccagattattcatgttgtgaaggttgtgaggttatcgaagaaactgaagaaggtaaatggggtatagaaaattacgcatggtgtggtattaa

SEQ ID NO: 16781 - DNA, 94 bp, Piromyces finnis
  CBM_10
cccagcttctattactaaacaaggttacaaatgttgtaaggcaggatgtgaagttatttacactgatgccgatggtgattggggtgttgaaaac

SEQ ID NO: 16782 - DNA, 85 bp, Piromyces finnis
  CBM_10
ttgctgggctgatgctattggttacccatgttgtaagggatgtgatgttattactactgatgatgatggtgattggggtgttgaa

SEQ ID NO: 16783 - DNA, 84 bp, Piromyces finnis
  CBM_10
tgatgtatgtgaaggctgtgaagttttagttactgatttagaaggtaagtggggtgctcaagatggtaaatggtgccatatcga

SEQ ID NO: 16784 - DNA, 87 bp, Piromyces finnis
  CBM_10
ttatgaatgctgtactggttgtaaaccaattgttgctgatgatgaaggaagatggggagctcaaaatggtgaatggtgtttaattga

SEQ ID NO: 16785 - DNA, 82 bp, Piromyces finnis
  CBM_10
gagtggatataaatgttgctcagcttcttgtgaagttatttacacagattccgatggtacttggggtgttgaaaacaatgaa

SEQ ID NO: 16786 - DNA, 111 bp, Piromyces finnis
  CBM_10
ctgtaatatcaattcaactccttactcatggtgtaagggttgtgtcgttactgaatatggtggtgatggtgctgcatttggttgggaaaatgaacaatcttgccttgttaa

SEQ ID NO: 16787 - DNA, 111 bp, Piromyces finnis
  CBM_10
tgtaagtaacgttgaagctgcttatccaaaatgttctgattgtattgttttcgccactggtaaggatggttctctttggggttgggaaaatgaatctttttgtagaatttc

SEQ ID NO: 16788 - DNA, 105 bp, Piromyces finnis
  CBM_10
aactaatgctcgtggtcaaatgatttgtaatgcttgtactgttactgctacaggtggtgacaattctttatggggatatgaagatgataagtcatgtgttattga

SEQ ID NO: 16789 - DNA, 93 bp, Piromyces finnis
  CBM_10
aggtaacttaatttgcaatggatgtaatgttactgaaactggtggtgaccaatctctttggggttatgaagataatgcatcttgtatcattga

SEQ ID NO: 16790 - DNA, 87 bp, Piromyces finnis
  CBM_10
ttatccaaaatgttctgattgtattgttttcgccactggtaaggatggttctctttggggttgggaaaatgaatctttttgtagaat

SEQ ID NO: 16791 - DNA, 111 bp, Piromyces finnis; identical to SEQ ID NO: 16787
  CBM_10

SEQ ID NO: 16792 - DNA, 111 bp, Piromyces finnis; identical to SEQ ID NO: 16786
  CBM_10

SEQ ID NO: 16793 - DNA, 93 bp, Piromyces finnis; identical to SEQ ID NO: 16789
  CBM_10

SEQ ID NO: 16794 - DNA, 105 bp, Piromyces finnis; identical to SEQ ID NO: 16788
  CBM_10

SEQ ID NO: 16795 - DNA, 87 bp, Piromyces finnis; identical to SEQ ID NO: 16790
  CBM_10

SEQ ID NO: 16796 - DNA, 96 bp, Piromyces finnis
  CBM_10
aaaactaggttatccatgttgtaaatattgtactattattgaaagtgattcctatggagactatggtgttgaaaataatgcctggtgtagtatatc

SEQ ID NO: 16797 - DNA, 108 bp, Piromyces finnis
  CBM_10
ttgttggtcagaatccttaggctatccatgttgtcatcatcaagatatcatctacaccgatgaaagtggaccatggggattagaaaataatcaatggtgtggtattca

SEQ ID NO: 16798 - DNA, 94 bp, Piromyces finnis
  CBM_10
aaatggttatccatgttgtaaaactaataagacagttgtattcactgatgaatacggaaaatggagtgttgaaaataacgattggtgtttaatt

SEQ ID NO: 16799 - DNA, 114 bp, Piromyces finnis
  CBM_10
ttgctcttccaaaattacccaacaaggttacaaatgttgttcaaagaactgtgtcgtctattacactgatagtgatggtaactggggttatgaaaacgactggtgtggttgtgc

SEQ ID NO: 16800 - DNA, 114 bp, Piromyces finnis; identical to SEQ ID NO: 16799
  CBM_10

SEQ ID NO: 16801 - DNA, 94 bp, Piromyces finnis; identical to SEQ ID NO: 16798
  CBM_10

SEQ ID NO: 16802 - DNA, 73 bp, Piromyces finnis
  CBM_10
ctatccatattgtaaaaccacctctgatgttgtttacaccgataccatggaatggggtgttgaaaataatgaa

SEQ ID NO: 16803 - DNA, 108 bp, Piromyces finnis
  CBM_10
atgttggtctgaagcattaggttataaatgttgtaagaaatgtaatgctctctatagagattctaacggtttatggggtattgaaaattttaagagatgtggtattcc

SEQ ID NO: 16804 - DNA, 117 bp, Piromyces finnis
  CBM_10
atgtatgtctgaacttaaaggttatccttgttgttccaaggaaataagcattgttcttaaacatgatcaatacggtgactggggttatgattttaaaaaaggaaaatggtgtggtct

SEQ ID NO: 16805 - DNA, 108 bp, Piromyces finnis; identical to SEQ ID NO: 16803
  CBM_10

SEQ ID NO: 16806 - DNA, 117 bp, Piromyces finnis; identical to SEQ ID NO: 16804
  CBM_10

SEQ ID NO: 16807 - DNA, 123 bp, Piromyces finnis
  CBM_10
ctgttgggtatctgttcatggttatccatgttgtgaaggtgaatctctcgaaaaagtctatgctgaagatgttgatggaaaatggggttatgatttcgttaaaaagacatggtgtggtatttc

SEQ ID NO: 16808 - DNA, 105 bp, Piromyces finnis
  CBM_10
ttggtctcttaaagaaggatataactgttgtataggttgtgctgtctatgctattacagatgaaggttcttggggtgttgaaaatggaaaatggtgtggtattcc

SEQ ID NO: 16809 - DNA, 129 bp, Piromyces finnis
  CBM_10
atgttggtctgaaagtcttggattcccatgttgtagcgatgaaaataccattatcgtagaatcagatggagatggcgattggggtattgaactaaatagtaataatgaatgggaatggtgtggtataaa

SEQ ID NO: 16810 - DNA, 126 bp, Piromyces finnis
  CBM_10
atgttggtcattatcccaaggctacccatgttgtgatccagatgccgaaactatttactccgatgaatccggtgattggggtcttgcattaaacagtaataatgaattggattggtgtggtattat

SEQ ID NO: 16811 - DNA, 94 bp, Piromyces finnis
  CBM_10
ttgggccactttaataaatttatcatacaagtgttgttcacctaatgcatcatactattccgttgatcaagatggtgaatggggtgttgaaaat

SEQ ID NO: 16812 - DNA, 108 bp, Piromyces finnis
  CBM_10
ttatagtaagggttcaggatttccatgttgtaaaaagaataccaagattatatatatggatggtgaaggagattggggtgtcaataatggtgaatggtgtatagtaaa

SEQ ID NO: 16813 - DNA, 70 bp, Piromyces finnis
  CBM_10
ttgcttctctgaagccttaggatatgaatgctgtaaaggttgcactgtaatcacaactgatgaaagtggt

SEQ ID NO: 16814 - DNA, 108 bp, Piromyces finnis
  CBM_10
ctgtttcgccactaaattaggatacccatgttgtaagaacaaccaaattgtttacactgattcagatggtgactggggatttgaaaacaacgaatggtgtggtattgg

SEQ ID NO: 16815 - DNA, 108 bp, Piromyces finnis; identical to SEQ ID NO: 16814
  CBM_10

SEQ ID NO: 16816 - DNA, 108 bp, Piromyces finnis; identical to SEQ ID NO: 16814
  CBM_10

SEQ ID NO: 16817 - DNA, 111 bp, Piromyces finnis
  CBM_10
ttgggctgaatcattaggttatccatgttgtaaagaaaaaacaccaaatgttgaatatgttgatgaatccggttcatggggtatagaaaatgacatttggtgtggtataat

SEQ ID NO: 16818 - DNA, 108 bp, Piromyces finnis
  CBM_10
gtgttgggctgaagcacaaggttatccatgctgtgaaatcactaaagaagttgtttatgttgatgattacctatggggtattgaaaatgaagaatggtgtggtataat

SEQ ID NO: 16819 - DNA, 103 bp, Piromyces finnis
  CBM_10
ctgttggtcagaacgtcttggttataaatgttgctcatactcaactgaggttatctacactgataatgatggaaaatggagtattgaaaataatgaatggtgt

SEQ ID NO: 16820 - DNA, 106 bp, Piromyces finnis
  CBM_10
atgttggtcttctgtctttggatacgaatgttgtgaaaattgtaatgttattgaatctgatgaacatggtgattggggtgttaagaatggtgaatggtgtggtatt

SEQ ID NO: 16821 - DNA, 109 bp, Piromyces finnis
  CBM_10
ttggtctgaagctcttggttataaatgttgttctagtggatgtaattctatcgtaatattcactgatgaaaacggttcatggagtgctgaaaataatgaatggtgtggt

SEQ ID NO: 16822 - DNA, 61 bp, Piromyces finnis
  CBM_10
actcggttatttatgttgtagtctaccatgtactgttatttatactgatgatgatggtgat

SEQ ID NO: 16823 - DNA, 51 bp, Piromyces finnis
  CBM_10
tgatgatgatggtgattgggcatttcaaaataatgagtggtgtggttgtgg

SEQ ID NO: 16824 - DNA, 79 bp, Piromyces finnis
  CBM_10
atgttggtctaccgaatttggttttccatgttgtaaaggaaataccattgttttcaccgatgaaaatggtgattggggt

SEQ ID NO: 16825 - DNA, 105 bp, Piromyces finnis
  CBM_10
atgcttttcaattaatttaggctatccatgttgtagtacttgtactttatactttgaaaattctattggaagatggggcattgaaaataatgagtggtgtggtct

SEQ ID NO: 16826 - DNA, 108 bp, Piromyces finnis
  CBM_10
atgttgggcagaggaacaagggtatcaatgttgttctgattgtgatgttatctatgaagacaataatggtttgtggggaatagagaatggtacttggtgtggtattaa

SEQ ID NO: 16827 - DNA, 111 bp, Piromyces finnis
  CBM_10
ttgctttgcaaagtctatgggttatgcttgctgtagtgtcggtaccgaagtagtttacactgataatgatggtcaatggggtattgaaaatggccaatggtgtggtattgg

SEQ ID NO: 16828 - DNA, 67 bp, Piromyces finnis
  CBM_10
tgattacgcctgctgtagtggatgtgaatcagtctatgttgacaatgatggtaaatggggtgttgaa

SEQ ID NO: 16829 - DNA, 97 bp, Piromyces finnis
  CBM_10
atgttttgccataaaattaggatactcttgctgtcaacaaaccaccaaggttgtctatgaagattctgatggagaatggggtgttgaaaatggtgaa

SEQ ID NO: 16830 - DNA, 117 bp, Piromyces finnis
  CBM_10
atgttggtcagaattattaggaagtccatgttgtccaccaaaggttacaattgtttacagtcatgatgaatatggagattggggatatgattttaagcgtaaggaatggtgtggact

SEQ ID NO: 16831 - DNA, 96 bp, Piromyces finnis
  CBM_10
acttggttataaatgttgttctagttttattaagattgatcatacagataaaataggtacttggggatatgaaaatggtgaattgtgtggtattcc

SEQ ID NO: 16832 - DNA, 102 bp, Piromyces finnis
  CBM_10
tttctccttcccagaatacttatgttgtgatggttgtaatgttgttgaagaaactgctgaaggtaaatggggtgttgaaaacaacaaatggtgtggtattcc

SEQ ID NO: 16833 - DNA, 66 bp, Piromyces finnis
  CBM_10
tggtgttgtattagaagaagatggtattaaatggggtgttgaaaataatgattggtgtattatccc

SEQ ID NO: 16834 - DNA, 120 bp, Piromyces finnis
  CBM_10
atgttggtctgaaaatattggttatccatgttgtcaaaataaggataccaaggtaacctatcattccaaatctcttaataaagactatggtactgaaaatggagaatggtgcggtattaa

SEQ ID NO: 16835 - DNA, 99 bp, Piromyces finnis
  CBM_10
cggtactagttacaactgctgtaaaattccagctaacgtcgatacagtagatgatgttggttactgggctattcaaaatggtcaatggtgttttattga

SEQ ID NO: 16836 - DNA, 102 bp, Piromyces finnis
  CBM_10
tccaaagggtggtagtaaatacaagtgttgtgaaacttgtaaagtttcctacactgattccacaaagtggggtgttgaacatggtaaatggtgttctattcc

SEQ ID NO: 16837 - DNA, 91 bp, Piromyces finnis
  CBM_10
tcatagttctggatatgattgttgcttatccactaaagccatcgtaacatcagatgtcgttggtgattggggtattgaaaataatgactgg

SEQ ID NO: 16838 - DNA, 99 bp, Piromyces finnis
  CBM_10
tccaagttatggtatttatcaatgttgtcaatcctgcgatattgtctttaccgatactgaggattggggtttcgaaaatggtaattggtgttctattcc

SEQ ID NO: 16839 - DNA, 123 bp, Piromyces finnis
  CBM_10
ttggtcattatcctatggaacaggttatccatgttgtaaagataaaaacaccaaagttaactatgtttctaaatctactggaaaagaatggggtgtagaaaatggtaattggtgtggaataac

SEQ ID NO: 16840 - DNA, 97 bp, Piromyces finnis
  CBM_10
ttctcaatctattttaaatcaaggttattcatgctgctccagcggttgtgaagttatctataccgattctgatggtacttggggtgttgaaaataat

SEQ ID NO: 16841 - DNA, 111 bp, Piromyces finnis
  CBM_10
ttgctggtctgaaagattaggatacagatgttgtagttttactaatgatgttattttagaggatagtgatggtaagtggggtgtagaaaataatgactggtgtggcattca

SEQ ID NO: 16842 - DNA, 111 bp, Piromyces finnis
  CBM_10
atgttggtcatcaagcctaggttatccatgttgtactaatactaatgaagtaatttatgaagatagtgatggtaagtggggtatcgaaaacaataactggtgtggtataat

SEQ ID NO: 16843 - DNA, 85 bp, Piromyces finnis
  CBM_10
tgttgctctttatttaggttatccatgttgttcaccagacaacacctatgttgtataccaagatgaaagtggtgattggggtgtt

SEQ ID NO: 16844 - DNA, 88 bp, Piromyces finnis
  CBM_10
ttgtttcagtattaaatttggatataactgttgtaatgaatgcaatgtttattatactgataacgatggtaaatggggagttgaaaat

SEQ ID NO: 16845 - DNA, 123 bp, Piromyces finnis
  CBM_10
ttgggcatcatctttaggttataaatgttgtactaaaacaactaaagttgaatatgttgatgctaatggtgaatggggtgctgaacgtgatgaatttggtgtaagaaattggtgtggtattat

SEQ ID NO: 16846 - DNA, 117 bp, Piromyces finnis
  CBM_10
ttggtcagagaatttaccagatccatatccatgctgttcaagtgaccaagtccaaagaatagactcaacctatgatggtgactggggtaaagaaaatggtaaaaagtgtggtatagt

SEQ ID NO: 16847 - DNA, 108 bp, Piromyces finnis
  CBM_10
ttgctggtctgaaaaattcaatattccatgttgtcaaaccactaaggaagttgttagaaccacttatgatggtatctggggtatggaaaatggtgaatggtgtggtct

SEQ ID NO: 16848 - DNA, 91 bp, Piromyces finnis
  CBM_10
ctccttccttccagattatccatgttgccaaccaggagccgaagtagtctatgttgatgaaactggtaattggggtgttgaaaatggtaac

SEQ ID NO: 16849 - DNA, 88 bp, Piromyces finnis
  CBM_10
ttcaaaggatggttacccagtttgtaagactactactactgttgtatacactgactctgaaaagtggggtgttgaaaatggtaactgg

SEQ ID NO: 16850 - DNA, 108 bp, Piromyces finnis
  CBM_10
atgtttcagtgttgctttaggttacccatgttgtagtggaaacaatgttgtttacagtgactctgatggtaagtggggatttgaaaataatagctggtgtggtattgc

SEQ ID NO: 16851 - DNA, 108 bp, Piromyces finnis
  CBM_10
ttgtttctcgattaaacttggttatccatgttgtaacagcaatattgtatattatgttgacaatgatggtcaatggggatttgaaaataataattggtgtggtattat

SEQ ID NO: 16852 - DNA, 108 bp, Piromyces finnis
  CBM_10
ctgtacaggaaaagatcaaggctaccaatgttgtaattcctgttctgtatactatgttgataatgacggtagatggggaatagagaatggcgaatggtgtggaattaa

SEQ ID NO: 16853 - DNA, 111 bp, Piromyces finnis
  CBM_10
atgctatggtgctactacaggaaaatacccatgctgtcaaggatgtatagtagtcaccactgataaaaatggtagatggggtgttgaaaacaatgcctggtgctccattag

SEQ ID NO: 16854 - DNA, 108 bp, Piromyces finnis
  CBM_10
atgttggtctgaaaagttaggttatacctgttgtcaaggatgtaaagtctatgaaaaggattccgatggatcatggggatatgaattaaatcaatggtgtggtattcc

SEQ ID NO: 16855 - DNA, 93 bp, Piromyces finnis
  CBM_10
tgaatattcatgttgtagttcatgtatagatattgttgagcaagatgatgatagtagctggggtattgaaaatggacaatggtgttcaatccc

SEQ ID NO: 16856 - DNA, 84 bp, Piromyces finnis
  CBM_10
cgattgttgtccagatggtactgaagttgcctatgtcgatgaatatggtgaatggggtataattaatggagaatggtgtggttt

SEQ ID NO: 16857 - DNA, 108 bp, Piromyces finnis
  CBM_10
atgtttctctcttgctttaggtcatccatgttgtgattcctgtgatgttgttagcactgatgaaaatggtctttggggtgtcaaagataatgattggtgtggtattaa

SEQ ID NO: 16858 - DNA, 94 bp, Piromyces finnis
  CBM_10
tgttggattaaatttaggttatccttgttgttcttcatgcaacattgcgtatagtgacgaaacaggaaattggggaattgaaaataatgaatgg

SEQ ID NO: 16859 - DNA, 111 bp, Piromyces finnis
  CBM_10
atgcttttctactaaattaggatataaatgttgttcatcttgtactgatgttatatatattgataatgatggacagtggggattagaaaacgacaattggtgtggaatagc

SEQ ID NO: 16860 - DNA, 108 bp, Piromyces finnis
  CBM_10
ttgtttttctatggcattgggtttttcatgttgtgaaggcaacaaaatagtttatactgatgatgatggtgattggggatatgaaaatggcgaatggtgtggtattat

SEQ ID NO: 16861 - DNA, 91 bp, Piromyces finnis
  CBM_10
cttctcaattgctcttggattcccatgttgtaagggtaatgacattgtatacactgacaatgatggtccatggggtgttgaaaatggtgaa

SEQ ID NO: 16862 - DNA, 109 bp, Piromyces finnis
  CBM_10
atgttgggcttcagaacaaggttatgattgttgtgaaagttgtaacgttgtctttgtcgaagaaaatggccaaaaatggggtgttgaaaataaccaatggtgtggtatt

SEQ ID NO: 16863 - DNA, 90 bp, Piromyces finnis
  CBM_10
ttacgaatgttgtttcgataatgaagttgtttatgaagatgaaagtggtaaatggggtattaatgaaaagggagaatggtgtggtgttga

SEQ ID NO: 16864 - DNA, 90 bp, Piromyces finnis
  CBM_10
cccatgttgtcaaaacactaatttctcctactacactgattccgctggtaatgaatggggtattgaaaacaacaactggtgtggtattaa

SEQ ID NO: 16865 - DNA, 114 bp, Piromyces finnis
  CBM_10
ttcttcaaaaattactaagcaaggatataaatgttgttcaaagggatgtgaaatttattatgttgatgctgatggcgattggggttttgaaagtggtgattggtgtggatgtgg

SEQ ID NO: 16866 - DNA, 94 bp, Piromyces finnis
  CBM_10
ttgcccatcaaaaattactagtcaaggatacaaatgctgtaaggataattgtattatatattatactgatgcagatggtgattggggtgttgaa

SEQ ID NO: 16867 - DNA, 111 bp, Piromyces finnis
  CBM_10
cttttctgaggttttaggttatccatgttgctctgatccaaatgctgatgttgttactactgatgaatatggtcaatggggtatcgaaaataatttatggtgtggtatact

SEQ ID NO: 16868 - DNA, 99 bp, Piromyces finnis
  CBM_10
acttggatacaaatgttgttatgatcaaaacactaaagtcgaatatattgatgaatttggtaattggggtatagaaaatggtaaattgtgtggtattgg

SEQ ID NO: 16869 - DNA, 108 bp, Piromyces finnis
  CBM_10
atgtcactctaaagctggttatccatgctgttctcctgaaattactgaagttatatacactgatgatgaaggcaattggggttctgaaaataacaattggtgtcttat

SEQ ID NO: 16870 - DNA, 99 bp, Piromyces finnis
  CBM_10
tggttatccatgttgttcttcagtaaatcctgaagttcaatatactgatgataatggtaataaatggggtgttgaagatggcgaatggtgcggtattgg

SEQ ID NO: 16871 - DNA, 111 bp, Piromyces finnis; identical to SEQ ID NO: 16867
  CBM_10

SEQ ID NO: 16872 - DNA, 108 bp, Piromyces finnis; identical to SEQ ID NO: 16869
  CBM_10

SEQ ID NO: 16873 - DNA, 99 bp, Piromyces finnis; identical to SEQ ID NO: 16870
  CBM_10

SEQ ID NO: 16874 - DNA, 99 bp, Piromyces finnis; identical to SEQ ID NO: 16868
  CBM_10

SEQ ID NO: 16875 - DNA, 103 bp, Piromyces finnis
  CBM_10
ctgggctaaatctctcggctataaatgctgtgcaagtaaatgtgcagaagtttatagtaccgacgccagtggaaaatggagtattgaaaataatgaatggtgt

SEQ ID NO: 16876 - DNA, 111 bp, Piromyces finnis
  CBM_10
ctgctttagtacttcaatgggttacccttgctgcaaagatactagtagagttgtaactactgattgtgatggtaaatggggtgttgaaaatggagaatggtgtggtattgg

SEQ ID NO: 16877 - DNA, 111 bp, Piromyces finnis; identical to SEQ ID NO: 16876
  CBM_10

SEQ ID NO: 16878 - DNA, 103 bp, Piromyces finnis; identical to SEQ ID NO: 16875
  CBM_10

SEQ ID NO: 16879 - DNA, 99 bp, Piromyces finnis
  CBM_10
aaaaggctacaaatgttgtagtaataaccattgtagatcaaaatatgaagatgaagatggtatttggagtatagaaaatggcgaatggtgtggtgtgtc

SEQ ID NO: 16880 - DNA, 67 bp, Piromyces finnis
  CBM_10
atataaatgttgttcagataattgtgaagttacccattctgacgaaaatggtgattggggttatgaa

SEQ ID NO: 16881 - DNA, 85 bp, Piromyces finnis
  CBM_10
ttggtctgatgttcttggttattcatgttgtagtaaatgcctcgaagccgtttatgaagatcaagatggtaaatggggtgttgaa

SEQ ID NO: 16882 - DNA, 114 bp, Piromyces finnis
  CBM_10
atgttggtctaaaaaatttggttatgattgttgtgttttaccagaaactagagccatctacagtgatgcaaatggaaagtatggtgtagaatttaaacaaaaatgtggtattgt

SEQ ID NO: 16883 - DNA, 111 bp, Piromyces finnis
  CBM_10
tgataatggtggattagattatgaatgctgttctagcttaaatgttaaattacaatccattgatgctgatgctaaatggggttttgaaaatggtaaatggtgtattattga

SEQ ID NO: 16884 - DNA, 96 bp, Piromyces finnis
  CBM_10
atttaattatccatgttgtgttaaaactgaaaaaggaacatacagtgatggagatggtgactgggctcaagaaaacggtgattggtgtactataag

SEQ ID NO: 16885 - DNA, 91 bp, Piromyces finnis
  CBM_10
ttgttggtcaaaagcattaggctatccatgttgttctacatgtaccactgttattgattcagacagtgatggtgattggggtattgaaaat

SEQ ID NO: 16886 - DNA, 42 bp, Piromyces finnis
  CBM_10
tggtaaatggagtgttgaaaatggtgattggtgtttaattga

SEQ ID NO: 16887 - DNA, 88 bp, Piromyces finnis
  CBM_10
ttgtaaattcgaagctcttggttacagttgctgttccaactgtggaccagtttacttcactgattctgatggtaagtggggtgttgaa

SEQ ID NO: 16888 - DNA, 96 bp, Piromyces finnis
  CBM_10
tcacccaagttacccatgttgtaacggttgtgatgttacctacgttgataacgaaggtgaatggggtgttcaaaacaacaactggtgtttcatcga

SEQ ID NO: 16889 - DNA, 88 bp, Piromyces finnis
  CBM_10
cttttctgaaactttaggatactcatgttgtgaaaacacaactgaagttgttcatgttgatgaaaatggtgaatggggtattgaaaat

SEQ ID NO: 16890 - DNA, 111 bp, Piromyces finnis
  CBM_10
atgtttctctcttaaatttggtgttccatgttgtaaacaaacaaaggatgttgtttatgttgatagtaatggtgaatggggtgttgaaaataacaactggtgtggtatgaa

SEQ ID NO: 16891 - DNA, 120 bp, Piromyces finnis
  CBM_10
atgttgggttgctcaattcggttatccatgctgtgctaaaaacaacaagattgtttatgatgttgatgctgatggtgaatggggttacaactttaaaactaaggaatggtgtggtattac

SEQ ID NO: 16892 - DNA, 114 bp, Piromyces finnis
  CBM_10
atgctggtctgaagactttggttacccatgttgtaagggttgcattgtttatgaagaagatgaacatggtcaatggggttatgactttactgaagctacctggtgtggtattca

SEQ ID NO: 16893 - DNA, 99 bp, Piromyces finnis
  CBM_10
atgtcatccaaattatgaatgttgtaatggatgtgatgtagtctatacagatgccgaaggtaaatggggtgttgaaaacaacaattggtgcataattaa

SEQ ID NO: 16894 - DNA, 96 bp, Piromyces finnis
  CBM_10
tccaactcaatatccatggtgtaatggatgtaaggtctattatacagatgctgaaggtaattggggtgttgaaaacaatgattggtgtttaattaa

SEQ ID NO: 16895 - DNA, 99 bp, Piromyces finnis; identical to SEQ ID NO: 16893
  CBM_10

SEQ ID NO: 16896 - DNA, 96 bp, Piromyces finnis; identical to SEQ ID NO: 16894
  CBM_10

SEQ ID NO: 16897 - DNA, 85 bp, Piromyces finnis
  CBM_10
atgctggtctttaccagattacccatgttgttctacttgtgatgttgtttacactgatgatcataactggggtgttgaaaacggt

SEQ ID NO: 16898 - DNA, 103 bp, Piromyces finnis
  CBM_10
atgctgggctcaagaacaaggcttcccatgttgtagagaagcaacagaagtattatatagcgaaaatggaaataattggtctatggaaaatggtgaatggtgt

SEQ ID NO: 16899 - DNA, 108 bp, Piromyces finnis
  CBM_10
atgcccaggtatcaagtacggttatgaatgctgtgaaaaatgtgatgtagttgaaactgatgaacttggacaatggggtgccattaatggtgaatggtgtagtattaa

SEQ ID NO: 16900 - DNA, 108 bp, Piromyces finnis
  CBM_10
ttgctggagtcaaggattaggtttccaatgctgttctggatgtaatgttgaatatgtcgacagtgatggtgaatggggtttagaaaacggtgaatggtgtggtattcc

SEQ ID NO: 16901 - DNA, 105 bp, Piromyces finnis
  CBM_10
atgtccaggtaaaaaatatggatatccatgttgtgaaaaatgtgatgtatttttaactgataaagatggtgcatggggtgtccaaaacagtaattggtgtagtgt

SEQ ID NO: 16902 - DNA, 105 bp, Piromyces finnis; identical to SEQ ID NO: 16901
  CBM_10

SEQ ID NO: 16903 - DNA, 108 bp, Piromyces finnis; identical to SEQ ID NO: 16900
  CBM_10

SEQ ID NO: 16904 - DNA, 112 bp, Piromyces finnis
  CBM_10
atgttggtcagaagtttttggttataaatgttgttcaaaaggatgcaattctaaagtatatttaattgatgaagctggatattggggtgctgaaaacggtgaatggtgtggt

SEQ ID NO: 16905 - DNA, 111 bp, Piromyces finnis
  CBM_10
ttgttggtcattatcattaggttataattgctgttctgctggtgctgaagtcattttagtagatgaaaatggagaatggggctttgaaatgaatgaatggtgtggtattat

SEQ ID NO: 16906 - DNA, 91 bp, Piromyces finnis
  CBM_10
ttgttggtctgaaaaacttggttatagatgttgtaaatctagctatccagtttattatactgatgccgatggtcaatggggtattgaaaat

SEQ ID NO: 16907 - DNA, 102 bp, Piromyces finnis
  CBM_10
taaaagtggaggcggtgaatataaatgttgtaaaggttgtcaaattatttacactgataatgaggattggggtgtagaaaatgataattggtgttccattcc

SEQ ID NO: 16908 - DNA, 114 bp, Piromyces finnis
  CBM_10
ctggtcaaccaatctcggttttccatgttgtcaattaaagacaactaaagttcaatatggtgataatactaatagtcaatttggtattgaaaatggtcaattatgtggtattaa

SEQ ID NO: 16909 - DNA, 108 bp, Piromyces finnis
  CBM_10
ttggtcaagaaaattaggatacccatgttgctcggaaggagctttagttgttaatgttgatgaaaatggaaaatggggtatagataaagataattggtgtggtatatt

SEQ ID NO: 16910 - DNA, 114 bp, Piromyces finnis
  CBM_10
atgttggtctttagaaagaggttatccatgttgtgaaactaatactgaagtattctatacttcttctaatggtaaaacttggagtattgaaaataatgactggtgcggtattaa

SEQ ID NO: 16911 - DNA, 99 bp, Piromyces finnis
  CBM_10
tactggttatccatgttgtagtgatccaaaggcctctattattaccaatgatatttcaggtgattggggtattgaaggtaatacatggtgtttaattga

SEQ ID NO: 16912 - DNA, 78 bp, Piromyces finnis
  CBM_10
ttactgtggaggatgtgatgttacagccactggtgatgatggttcttactggggatgggaaaatggaaaatcgtgtga

SEQ ID NO: 16913 - DNA, 78 bp, Piromyces finnis
  CBM_10
ttgtagaaaatgtgatgttacagctactggtgatgatggttcatattggggatgggaaaatggtacatcatgtaaaat

SEQ ID NO: 16914 - DNA, 87 bp, Piromyces finnis
  CBM_10
ctacagtgactgtaaaaattgtagagtcgttactgttgaagatggtgtcagttggggtgtagaaaacaacgactggtgtgttatcaa

SEQ ID NO: 16915 - DNA, 82 bp, Piromyces finnis
  CBM_10
atgtttctcatacccagattatccatgctgttctggttgtgatgctatttacgaagacgatgatggtaaatggggtgttgaa

SEQ ID NO: 16916 - DNA, 111 bp, Piromyces finnis
  CBM_10
atgttgggcctcttctgaaggttacaaatgctgtcaaaacacttgtgatgctatttactctgaaggtagcaagaagtggggtttcgaaaatggtgactggtgtggtattgt

SEQ ID NO: 16917 - DNA, 94 bp, Piromyces finnis
  CBM_10
atgctgggccgctgctgaaggttatgcttgttgtagctcaggaactccagttactcttactgatagcaagggtaagtggggtattgaaaacggt

SEQ ID NO: 16918 - DNA, 102 bp, Piromyces finnis
  CBM_10
tttcaaaaatcaaggttattcctgttgtaagggttgctcagttgtcgacactgatgcaactggtgactggggtgttgaaaacggccaatggtgtggtatcga

SEQ ID NO: 16919 - DNA, 102 bp, Piromyces finnis
  CBM_10
tttcaaaaatcaaggttattcctgttgtaagggttgctcagttgtcgacactgatgcaactggtgactggggtgttgaaaacggccaatggtgtggttgtgg

SEQ ID NO: 16920 - DNA, 111 bp, Piromyces finnis
  CBM_10
aaaggccattaccaaccaaggttacaagtgctgttccggttgttcctacgtttactacgaagaccaagatggtaaatggggtgttgaaaacaatgactggtgtggtatcaa

SEQ ID NO: 16921 - DNA, 108 bp, Piromyces finnis
  CBM_10
ttggtctcttgcagaaggttataaatgttgtagtgaaggtactcctgttgtacttacagatagtaagggtaaatggggtattgaaaataatgattggtgcggtatagt

SEQ ID NO: 16922 - DNA, 97 bp, Piromyces finnis
  CBM_10
ttgctgggcagctagtgaaggttacaaatgttgtagtggctgtgaagctatatttacagatggtgaaaagaaatggggtgttgaaaatggtcaatgg

SEQ ID NO: 16923 - DNA, 91 bp, Piromyces finnis
  CBM_10
tgcttcaaagcaaggttatccttgttgtaaatcctgtacagttgccttcgttgatggaaatgaaaaatggggtgttgaaaacaacgactgg

SEQ ID NO: 16924 - DNA, 103 bp, Piromyces finnis
  CBM_10
ttgggctaatgctgaaggttataattgttgtaaatctactacacaagttgttctcactgatagtaaaggaaaatggggtattgaaaataatcaatggtgtggt

SEQ ID NO: 16925 - DNA, 84 bp, Piromyces finnis
  CBM_10
taaatgttgtaaaaattgtaatgttgttttagatgataatactggtaaatggggtgtcgaaaataatcaatggtgtggtattga

SEQ ID NO: 16926 - DNA, 111 bp, Piromyces finnis
  CBM_10
ttgggccgaagctcttggttacaagtgttgttcagctggtaactacatggttcttcttacagatgaaagtggagcctggggtgccgaaaatggagaatggtgtggtattgt

SEQ ID NO: 16927 - DNA, 108 bp, Piromyces finnis
  CBM_10
tttcgccaagtctgatggttacgaatgttgtttcgataatgaagttgtttatgaagatgaaagtggtaaatggggtattaatgaaaagggagaatggtgtggtgttga

SEQ ID NO: 16928 - DNA, 82 bp, Piromyces finnis
  CBM_10
ttgttggtctcgtccattaggttatgaatgttgtgaaacctgttcctacattgttcttagtgatgctgatggtgattggggt

SEQ ID NO: 16929 - DNA, 111 bp, Piromyces finnis; identical to SEQ ID NO: 16926
  CBM_10

SEQ ID NO: 16930 - DNA, 108 bp, Piromyces finnis; identical to SEQ ID NO: 16927
  CBM_10

SEQ ID NO: 16931 - DNA, 82 bp, Piromyces finnis; identical to SEQ ID NO: 16928
  CBM_10

SEQ ID NO: 16932 - DNA, 103 bp, Piromyces finnis
  CBM_10
ttgttcatttgagagcataggttacagttgctgtaaattaaattgtgatgttatctacactgatgaatctggtgattggagtgttgaaaacgatgaatggtgt

SEQ ID NO: 16933 - DNA, 105 bp, Piromyces finnis
  CBM_10
ttggtcattaccagattaccaatgctgtgctgatggtactgaagtaatttatactgacgaatctggagattggggtgttattaatgatgaatggtgtggtattaa

SEQ ID NO: 16934 - DNA, 105 bp, Piromyces finnis
  CBM_10
ctgctggtcacttccagactacccatgctgtgaaggtgataccgtaatttacagtgatgaaagtggtgactggggtgttgaaaacgacgaatggtgtggtattgt

SEQ ID NO: 16935 - DNA, 105 bp, Piromyces finnis
  CBM_10
cttttctacaagtatgggatacccatgttgttcaggatgtgaagatatctatgaagatgatgatggtaaatggggtgtagaaaatgatgattggtgtggtattga

SEQ ID NO: 16936 - DNA, 103 bp, Piromyces finnis
  CBM_10
ttgggctgaagcattaggatatgaatgttgtagtacttgtcaaccatcacaatataaagatgaaagtggtgaatggggtgttgaaaatggtgaatggtgtggt

SEQ ID NO: 16937 - DNA, 60 bp, Piromyces finnis
  CBM_10
tatatttacagatggtgaaaagaaatggggtgttgaaaatggtcaatggtgtggtatgcc

SEQ ID NO: 16938 - DNA, 111 bp, Piromyces finnis
  CBM_10
ttgctgggccaatgccttaaattacccatgttgtaagaccaccactgaagttgttttaactgataatgatggtaagtggggtattgaaaataatgaatggtgtggtattaa

SEQ ID NO: 16939 - DNA, 60 bp, Piromyces finnis
  CBM_10
tatatttacagatggtgaaaagaaatggggtgttgaaaatggtcaatggtgtggtattat

SEQ ID NO: 16940 - DNA, 90 bp, Piromyces finnis
  CBM_10
tcttggttatccatgttgtcaatcaacttcttctgtagttttcactgataacactggaaaatggggtatagaaaataatgattggtgtga

SEQ ID NO: 16941 - DNA, 111 bp, Piromyces finnis; identical to SEQ ID NO: 16938
  CBM_10

SEQ ID NO: 16942 - DNA, 102 bp, Piromyces finnis
  CBM_10
tttatctgctgctgattacccatgttgtgaacaatgtaatattgtatctgaagaagaaggtgacttctggggtgtcgaaaacaatgaatggtgtagtattaa

SEQ ID NO: 16943 - DNA, 105 bp, Piromyces finnis; identical to SEQ ID NO: 16747
  CBM_10

SEQ ID NO: 16944 - DNA, 102 bp, Piromyces finnis; identical to SEQ ID NO: 16942
  CBM_10

SEQ ID NO: 16945 - DNA, 105 bp, Piromyces finnis
  CBM_10
ttgggcaaataaattaggttacgattgttgcaaaactagtaaggaagtatatgaagatgtagagggaaagtggggtgtagaaaatggaaattggtgtggtatcgt

SEQ ID NO: 16946 - DNA, 105 bp, Piromyces finnis; identical to SEQ ID NO: 16747
  CBM_10

SEQ ID NO: 16947 - DNA, 108 bp, Piromyces finnis
  CBM_10
atgctggtctattccattcggttacaaatgctgtgatcactgtaaagtcctcttaactgatgaaagtggtaaatggggtgaattaaacggtgaatggtgtggtattga

SEQ ID NO: 16948 - DNA, 114 bp, Piromyces finnis
  CBM_10
atgttggtctcttaagtatggttatgaatgctgttctccaaataacactagagttgttgtcaccgatgaaagtggaaagtggggtgttgaaaacagtgattggtgtggtattgt

SEQ ID NO: 16949 - DNA, 105 bp, Piromyces finnis; identical to SEQ ID NO: 16945
  CBM_10

SEQ ID NO: 16950 - DNA, 108 bp, Piromyces finnis; identical to SEQ ID NO: 16947
  CBM_10

SEQ ID NO: 16951 - DNA, 114 bp, Piromyces finnis; identical to SEQ ID NO: 16948
  CBM_10

SEQ ID NO: 16952 - DNA, 102 bp, Piromyces finnis; identical to SEQ ID NO: 16942
  CBM_10

SEQ ID NO: 16953 - DNA, 105 bp, Piromyces finnis; identical to SEQ ID NO: 16747
  CBM_10

SEQ ID NO: 16954 - DNA, 100 bp, Piromyces finnis
  CBM_10
ttctgccgctatcttagcccaaggttacaaatgctgttctagtaattgtcaaataacttacgttgatgaaagtggtacatggggtgttgaaaatggtgaa

SEQ ID NO: 16955 - DNA, 100 bp, Piromyces finnis; identical to SEQ ID NO: 16954
  CBM_10

SEQ ID NO: 16956 - DNA, 99 bp, Piromyces finnis
  CBM_10
ccaaggatattcatgttgtgctggtaataattgttctgttgttctcacggatgaatctggaagatggggagttgaaaataatcaatggtgtggtatttc

SEQ ID NO: 16957 - DNA, 117 bp, Piromyces finnis
  CBM_10
ttctgctaatattttgaaacaaggatacaagtgttgttcctccaccaactgtacaatagttttcactgataatgatggcacttggggtgttgaaaataatcaatggtgtggatgtgc

SEQ ID NO: 16958 - DNA, 102 bp, Piromyces finnis
  CBM_10
tttctccttcccagaatacttatgttgtgatggttgtaatgttgttgaagaaactgctgaaggtaaatggggtattgaaaacaactattggtgtggtattaa

SEQ ID NO: 16959 - DNA, 90 bp, Piromyces finnis
  CBM_10
ggcttatgactactgtaatgcttgtggtgttgttttagaagaagacggagttaaatggggtgttgaaaataacgattggtgtattatccc

SEQ ID NO: 16960 - DNA, 84 bp, Piromyces finnis
  CBM_10
tgcaccaatatgtaatggttgtaatgttacctatactagtgatgatgccagtttatggggttgggaaaataatacctcatgtga

SEQ ID NO: 16961 - DNA, 108 bp, Piromyces finnis
  CBM_10
atgttggactagccccttaggctatgaatgttgtgattcttgtgatgttatatatgaagataataatggacagtggggtgttaaaaataataaatggtgtggcatttt

SEQ ID NO: 16962 - DNA, 120 bp, Piromyces finnis
  CBM_10
atgtgaagctgaagaatatggatacatttgttgtccaaattatctgacagaggttctttatcaagatgaagaaggagattgggcatatgattacgtcatggaggattggtgtattatcaa

SEQ ID NO: 16963 - DNA, 120 bp, Piromyces finnis
  CBM_10
atgttgggctgaattcattggatatcaatgttgttcagctgaaaacaccgatgtctatttacacgacagcaatggtgattggggttatgatttcgatacaaatgaatggtgtggtattac

SEQ ID NO: 16964 - DNA, 114 bp, Piromyces finnis
  CBM_10
atgctggtcagaagaacttggttatccatgttgtaaagattgtacagtttatgaaactgatgaaagtggagaatggggttatgattttaaaaacatgcaatggtgtggtattca

SEQ ID NO: 16965 - DNA, 106 bp, Piromyces finnis
  CBM_10
ttgctgggctcaaagtcaaggttacagttgctgtagcaacccaggtagcaccaaggtcgaattcactgacgccagtggtaactggggtattgaaaacggtaactgg

SEQ ID NO: 16966 - DNA, 106 bp, Piromyces finnis; identical to SEQ ID NO: 16965
  CBM_10

SEQ ID NO: 16967 - DNA, 76 bp, Piromyces finnis
  CBM_10
tttttcatacccagcttatccatgctgtaaaggaaacaccgtagtttatactgataacgaaggtagttggggtgta

SEQ ID NO: 16968 - DNA, 76 bp, Piromyces finnis; identical to SEQ ID NO: 16967
  CBM_10

SEQ ID NO: 16969 - DNA, 114 bp, Piromyces finnis
  CBM_10
atgctgggccgaaaaattaggttataaatgttgtccagacgatgtatgtacaacacttcatagtgacgctaacggagaatggagtattgtaaatgatgaatggtgtggtattat

SEQ ID NO: 16970 - DNA, 114 bp, Piromyces finnis
  CBM_10
atgttgggcaaaaaaattaaattatccatgttgtaaaaaagataattgtatgaaattttatgtaaatgatgatggagcttggggttttgagaattggaaatggtgtggtattga

SEQ ID NO: 16971 - DNA, 114 bp, Piromyces finnis; identical to SEQ ID NO: 16969
  CBM_10

SEQ ID NO: 16972 - DNA, 114 bp, Piromyces finnis; identical to SEQ ID NO: 16970
  CBM_10

SEQ ID NO: 16973 - DNA, 114 bp, Piromyces finnis
  CBM_10
atgttggtcaaaaccacttggttatgattgttgtgttgatccatacattcaaatagcatattctgatgatgatggtgattggggttatgaaaatgatgaatggtgtggtattat

SEQ ID NO: 16974 - DNA, 114 bp, Piromyces finnis; identical to SEQ ID NO: 16973
  CBM_10

SEQ ID NO: 16975 - DNA, 108 bp, Piromyces finnis
  CBM_10
atgttggtctgaaaaattaggttataaatgttgtaaatcttgtgatattattcttaaagatgcttcaggaaaatggggtgttgaagatggtaaatggtgtggtattcc

SEQ ID NO: 16976 - DNA, 117 bp, Piromyces finnis
  CBM_10
tactagtaattgcatgggtgttggaggttacccatgctgtaaaagatcctgtattgttgtcgaagaaaatgcatctggtaaatggagtcttgaaaagcatgattggtgtttaattga

SEQ ID NO: 16977 - DNA, 114 bp, Piromyces finnis; identical to SEQ ID NO: 16970
  CBM_10

SEQ ID NO: 16978 - DNA, 114 bp, Piromyces finnis; identical to SEQ ID NO: 16969
  CBM_10

SEQ ID NO: 16979 - DNA, 88 bp, Piromyces finnis
  CBM_10
atgttggtcagaagtccaaggttatccatgttgtacccaaacaactgaagttgcctatactgacagtgatggtgattggggtgttgaa

SEQ ID NO: 16980 - DNA, 108 bp, Piromyces finnis
  CBM_10
ttggtcaataaaacttggttatccatgttgtcctgaagatactactataattaccactgatgatgatggagattggggaatttataatgaaaattggtgtggaatact

SEQ ID NO: 16981 - DNA, 126 bp, Piromyces finnis
  CBM_10
atgctggtccttagctttatcaattccatgttgtaacaaaaataaagaaatctactccaaggatcaagatggtaactggggtataacaacggatgaaaatggaaattcaatatggtgtggtataag

SEQ ID NO: 16982 - DNA, 108 bp, Piromyces finnis
  CBM_10
ttggtccagagctggtggatatccatgttgtgaaggtggtgaatctattgctttaattgatcaagatggtatatggggtcaaaatgctaatggcaattggtgtggatt

SEQ ID NO: 16983 - DNA, 114 bp, Piromyces finnis
  CBM_10
ttggtcagaaaaattaggttacccatgttgtccagaagaaataactcagcctaattataaagatagtgaaggcgattgggtttttaatagtaatggtgaatggtgtggcataag

SEQ ID NO: 16984 - DNA, 108 bp, Piromyces finnis; identical to SEQ ID NO: 16982
  CBM_10

SEQ ID NO: 16985 - DNA, 114 bp, Piromyces finnis; identical to SEQ ID NO: 16983
  CBM_10

SEQ ID NO: 16986 - DNA, 88 bp, Piromyces finnis
  CBM_10
gtgttgggctagtctattaggttacaaatgttgtgttggaactaatccagcagtagtttttgttgatgatgatggtaaatggggtgta

SEQ ID NO: 16987 - DNA, 105 bp, Piromyces finnis
  CBM_10
ctggtcttctgctttaggttaccaatgttgtaagggatgctccgtaatttctgaagatgctgatggcaaatggggttttgaagacaaacactggtgtggtattgt

SEQ ID NO: 16988 - DNA, 108 bp, Piromyces finnis
  CBM_10
ctgctggtcactcccagactatccatgttgtaagactaccagcctcgttgtctcatctgatgctgaaggtgactggggttatgaagacaaccaatggtgtggtatcgt

SEQ ID NO: 16989 - DNA, 102 bp, Piromyces finnis
  CBM_10
ctggtctcttccacattaccaatgttgtaagggtaatgttgttgttcaatctgatagcaatggtgattggggttacgaagacggtcaatggtgtggtatcat

SEQ ID NO: 16990 - DNA, 108 bp, Piromyces finnis; identical to SEQ ID NO: 16988
  CBM_10

SEQ ID NO: 16991 - DNA, 105 bp, Piromyces finnis
  CBM_10
ctggtcttctactatgggataccaatgttgtaaaagttgttcagtcattgctgaagatagtgatggtaaatggggttttgaagacaaacactggtgtggtattgt

SEQ ID NO: 16992 - DNA, 102 bp, Piromyces finnis; identical to SEQ ID NO: 16989
  CBM_10

SEQ ID NO: 16993 - DNA, 102 bp, Piromyces finnis
  CBM_10
ttggtctcttccacattaccaatgttgtaagggtaatgaagttgttttcactgatcataacggtgactggggtttcgaaaataaccaatggtgtggtattgt

SEQ ID NO: 16994 - DNA, 87 bp, Piromyces finnis
  CBM_10
cccatgttgtaaaaatactagtcttgttgttgcttctgatgcacaaggtgactggggttatgaagataatcaatggtgtggtattgt

SEQ ID NO: 16995 - DNA, 91 bp, Piromyces finnis
  CBM_10
atgttggtcagaaccagattatccatgttgtaagaatagttgttacgttgttcttaatgatggtcaagaatggggttctgaaaatggtgaa

SEQ ID NO: 16996 - DNA, 91 bp, Piromyces finnis
  CBM_10
atgttggtctgaaccaaattacccatgttgtaaatatacttgtactgtcattcttaatgatggatccgaatggggttctgaaaatggtgaa

SEQ ID NO: 16997 - DNA, 105 bp, Piromyces finnis
  CBM_10
tttaggttatccagattatccatgttgcccaacttgcgacgttttcttaactgaagaagatggtaatcgttggggtgttctatatgataactggtgtagtattaa

SEQ ID NO: 16998 - DNA, 111 bp, Piromyces finnis
  CBM_10
tccatcttctattacaagtcaaggttatgcttgttgtagaggttgtgacgttgtatatactgatgaaaatggtgattggggtatagaaaatgattattggtgtggtatttc

SEQ ID NO: 16999 - DNA, 96 bp, Piromyces finnis
  CBM_10
aaaacaaggatatccatgttgttcaagttgtattgtgtatttttctgataaagatggccaatggggtgtagaaaatggtaaatggtgtggtattca

SEQ ID NO: 17000 - DNA, 105 bp, Piromyces finnis
  CBM_10
tttctctacaaagttaggttacccatgctgtacttcaactactcaagttgttttcaccgataatgatggtaactggggtgttgaaaacaacgactggtgtggttt

SEQ ID NO: 17001 - DNA, 105 bp, Piromyces finnis; identical to SEQ ID NO: 17000
  CBM_10

SEQ ID NO: 17002 - DNA, 111 bp, Piromyces finnis
  CBM_10
ctgctggtcagaaatttatggttatccatgctgtagtggctgtgatgttatctatgaagaatctgaaactatgagatggggtgttgaaaacaatgattggtgtggtatcat

SEQ ID NO: 17003 - DNA, 75 bp, Piromyces finnis
  CBM_10
cgaatatccatgttgtgaagactgtgttgttgtttatgaagataatcaaaagtggggcattttaaataatgatcc

SEQ ID NO: 17004 - DNA, 76 bp, Piromyces finnis
  CBM_10
cgaatatccatgttgtgaagactgtgttgttgtttatgaagataatcaaaagtggggcattttaaataatgactgg

SEQ ID NO: 17005 - DNA, 111 bp, Piromyces finnis
  CBM_10
tgctgccgcttctcaaggttatccatgctgcaaaaaccaaaatgctgaagtttactaccaagatgaaactggtgattggggtattgaaaatggtgaatggtgtggtatcac

SEQ ID NO: 17006 - DNA, 111 bp, Piromyces finnis
  CBM_10
atgttggtctgaaaaattaggattcccatgttgtagcaaatgtggacaagttgtttacaccgatgaagatggtaactggagtgttgaaaacaatgattggtgtggtatcat

SEQ ID NO: 17007 - DNA, 100 bp, Piromyces finnis
  CBM_10
ctgctggtcagaaatttatggttatccatgctgtagtggctgtgatgttatctatgaagaatctgaaactatgagatggggtgttgaaaacaatgattgg

SEQ ID NO: 17008 - DNA, 81 bp, Piromyces finnis
  CBM_10
cgaatatccatgttgtgaagactgtgttgttgtttatgaagataatcaaaagtggggcattttaaataatgactggtgtag

SEQ ID NO: 17009 - DNA, 103 bp, Piromyces finnis
  CBM_10
ttgttggtccaagaagttaggttttgattgttgttctggatgtaatagcatttacactgatgatgacggagaatggggtcttgaaaataatgaatggtgtggt

SEQ ID NO: 17010 - DNA, 108 bp, Piromyces finnis
  CBM_10
atgttggtctgaagctttaggttacaaatgctgttctcactgcgttgctatattagaagatcaagatggtgcatggggttctgaaaatggtgaatggtgtggtattca

SEQ ID NO: 17011 - DNA, 108 bp, Piromyces finnis
  CBM_10
atgttggtcaatgaaatatggttatccatgttgtgaagattgtcaattatacttagaagatgaatctggtgcttggggtgtattaaattatgattggtgtggtattcc

SEQ ID NO: 17012 - DNA, 108 bp, Piromyces finnis
  CBM_10
atgttggtctgaagctttaggttacaaatgctgttctcactgcgttgctatattagaagatcaagatggtgcatggggttctgaaaatggtgaatggtgtggtattcc

SEQ ID NO: 17013 - DNA, 105 bp, Piromyces finnis
  CBM_10
ttgtactggttacccagactatccatgttgtgacagttgtgatgtagtcttctctgatactcttggtgactggggtgttcaaaacgatcaatggtgtggtattaa

SEQ ID NO: 17014 - DNA, 94 bp, Piromyces finnis
  CBM_10
ctgcttctctgaaccagattacccatgttgtaaatccacatgcaatgttgttgataccgatgctaacggtaaatggggtgttgaaaatggtgaa

SEQ ID NO: 17015 - DNA, 114 bp, Piromyces finnis
  CBM_10
ctggtctatggctggtggttttccatgttgttctccagaaaataccaatgttgtttatcgtgaccaagatggtaaatggggtcttgatgaagatggaaattggtgtggtatgaa

SEQ ID NO: 17016 - DNA, 111 bp, Piromyces finnis
  CBM_10
atgttggtctaaacgtttaggttatgaatgttgtaaacagaaatttgaagttgttgaaaccgatgaaaatggttcatggagtatagaaaataatgaatggtgtggtattcc

SEQ ID NO: 17017 - DNA, 117 bp, Piromyces finnis
  CBM_10
ttggtcaaataattctatttctggaaattatccttgttgtccggaaggaacgccaattcaatattcagatgatgaaggagattggggtgtttatatggataattggtgtggtatcgt

SEQ ID NO: 17018 - DNA, 114 bp, Piromyces finnis; identical to SEQ ID NO: 17015
  CBM_10

SEQ ID NO: 17019 - DNA, 111 bp, Piromyces finnis; identical to SEQ ID NO: 17016
  CBM_10

SEQ ID NO: 17020 - DNA, 117 bp, Piromyces finnis; identical to SEQ ID NO: 17017
  CBM_10

SEQ ID NO: 17021 - DNA, 105 bp, Piromyces finnis
  CBM_10
ctgttgggctggtgctttaggttatccatgttgtgaaggttgtgatgttgtttataccgataacgatggaaaatggggttatgaagatgattggtgtggtattaa

SEQ ID NO: 17022 - DNA, 114 bp, Piromyces finnis
  CBM_10
ttggtccttagctatatcaaattatccatgttgttcttcttttaacactgttgtaacttatacggatcaagatggtaactggggttttgaaaatgatgattggtgtggtatgag

SEQ ID NO: 17023 - DNA, 105 bp, Piromyces finnis
  CBM_10
ttggtcagaaccaaaatatccttgttgttcagaaggtgttaaagtttattcaaaaactagtagtggtgaatggggtattgaaaatggaaattggtgtggtatacc

SEQ ID NO: 17024 - DNA, 108 bp, Piromyces finnis
  CBM_10
atgctgggcttcttctttaggctacgattgctgtgaaggatgtgatattataactactgatgaatatggtgaatggggtattgaaaatggaaattggtgtggtatacc

SEQ ID NO: 17025 - DNA, 108 bp, Piromyces finnis
  CBM_10
ttgggctaaacctttagggtataactgttgtcacggagaaacccaagttatatacacagataatgatggtcaatggggtagtgaagatggtaaatggtgcggtattat

SEQ ID NO: 17026 - DNA, 114 bp, Piromyces finnis; identical to SEQ ID NO: 17022
  CBM_10

SEQ ID NO: 17027 - DNA, 108 bp, Piromyces finnis; identical to SEQ ID NO: 17024
  CBM_10

SEQ ID NO: 17028 - DNA, 108 bp, Piromyces finnis; identical to SEQ ID NO: 17025
  CBM_10

SEQ ID NO: 17029 - DNA, 114 bp, Piromyces finnis; identical to SEQ ID NO: 17022
  CBM_10

SEQ ID NO: 17030 - DNA, 111 bp, Piromyces finnis
  CBM_10
tccagttgaaagtaagggatacaagtgctgtaatgatccaaacttacaatcaatgtttgaagatgaagatggtcaatggtactatgaaaatgatgaatggtgtttaattgt

SEQ ID NO: 17031 - DNA, 114 bp, Piromyces finnis; identical to SEQ ID NO: 17022
  CBM_10

SEQ ID NO: 17032 - DNA, 108 bp, Piromyces finnis; identical to SEQ ID NO: 17025
  CBM_10

SEQ ID NO: 17033 - DNA, 105 bp, Piromyces finnis; identical to SEQ ID NO: 17023
  CBM_10

SEQ ID NO: 17034 - DNA, 108 bp, Piromyces finnis; identical to SEQ ID NO: 17025
  CBM_10

SEQ ID NO: 17035 - DNA, 114 bp, Piromyces finnis; identical to SEQ ID NO: 17022
  CBM_10

SEQ ID NO: 17036 - DNA, 105 bp, Piromyces finnis; identical to SEQ ID NO: 17023
  CBM_10

SEQ ID NO: 17037 - DNA, 111 bp, Piromyces finnis; identical to SEQ ID NO: 17030
  CBM_10

SEQ ID NO: 17038 - DNA, 111 bp, Piromyces finnis; identical to SEQ ID NO: 17030
  CBM_10

SEQ ID NO: 17039 - DNA, 99 bp, Piromyces finnis
  CBM_10
cactggttattcatgctgttctaatccaaatgcctatgtttacactaccgatatcaccggtaattggagtattgaaggtaattattggtgtttaattgt

SEQ ID NO: 17040 - DNA, 73 bp, Piromyces finnis
  CBM_10
atattctacttgtaaaaatacatgtagtgttgaatacgaagatgattccaaatggggtattgaaaacaatgat

SEQ ID NO: 17041 - DNA, 90 bp, Piromyces finnis
  CBM_10
tgaaaaatataagtgttgtaaaaaatgtaaagtagtttacactgataactatttatggggagcagaacataatgaatggtgttcaattcc

SEQ ID NO: 17042 - DNA, 120 bp, Piromyces finnis
  CBM_10
atgctggtcaactagttttggttatccatgttgtcaatcaaaagatactactatttctttaacagaatttggtacaggaaatcaatatggtattgaaaatggacgtttttgtggtattac

SEQ ID NO: 17043 - DNA, 87 bp, Piromyces finnis
  CBM_10
ttataagtgttgttcccattgtgatgtttacttaacagatgaagtgggacaatggggtgttgaaaacaattattggtgtggtattcc

SEQ ID NO: 17044 - DNA, 96 bp, Piromyces finnis
  CBM_10
acaaggttacaagtgctgttcaggatgtagaactgtctactacactgatgatcttggtgactggggtgttgaagatggtgattggtgtggtattcc

SEQ ID NO: 17045 - DNA, 87 bp, Piromyces finnis
  CBM_10
ttatgaatgttgtaataattgtcaagttatagaaactgatgatgaaggtagatggggtagccttaacggtgaatggtgtttcatcga

SEQ ID NO: 17046 - DNA, 96 bp, Piromyces finnis; identical to SEQ ID NO: 17044
  CBM_10

SEQ ID NO: 17047 - DNA, 105 bp, Piromyces finnis
  CBM_10
taaatttgaacaatacggttataagtgttgttcccattgtgatgtttacttaacagatgaaatgggacaatggggtgttgaaaacaattattggtgtggtattcc

SEQ ID NO: 17048 - DNA, 105 bp, Piromyces finnis; identical to SEQ ID NO: 17047
  CBM_10

SEQ ID NO: 17049 - DNA, 87 bp, Piromyces finnis; identical to SEQ ID NO: 17045
  CBM_10

SEQ ID NO: 17050 - DNA, 96 bp, Piromyces finnis; identical to SEQ ID NO: 17044
  CBM_10

SEQ ID NO: 17051 - DNA, 96 bp, Piromyces finnis
  CBM_10
ttctggttatccatgttgtgttttcaccactacagttataatgtcagatagatcaggtaattggggtatagaatatggtcaatggtgttacataaa

SEQ ID NO: 17052 - DNA, 114 bp, Piromyces finnis
  CBM_10
atgttggtctcttaaagaaggttatcaatgttgtcaagatgaaaaaactaccattattccaacaaaagatggaaaagaatggggtatagaaaataacgaatggtgtggtatcac

SEQ ID NO: 17053 - DNA, 114 bp, Piromyces finnis
  CBM_10
atgttggtcagaagttttgggctattcttgttgtaaagataagaaaacaaaggtttcctatgttgatgcatcaggtgaatggggtgctgaacatggtcaatggtgtggtattac

SEQ ID NO: 17054 - DNA, 87 bp, Piromyces finnis
  CBM_10
tgaatacaaatgttgtgaaaaatgtaaagtagtttacagtgatggtgaagattggggtgttgaacatggaaattggtgttcaattcc

SEQ ID NO: 17055 - DNA, 93 bp, Piromyces finnis
  CBM_10
ttcaggttatccatgttgtgtaaaaactaaaactcttgtttccagtgatgctgttggtgactggggtattgaaaataatgactggtgtctctt

SEQ ID NO: 17056 - DNA, 67 bp, Piromyces finnis
  CBM_10
ccaatataaatgttgtaaaaaatgtgaagttatcatgacagatgatgatggtgattggggtattgaa

SEQ ID NO: 17057 - DNA, 114 bp, Piromyces finnis
  CBM_10
ttggtccattaaatatggctattcttgttgtacaaataaaaatactaaagtttcttttgttgaacctactggtgaaaagtatggtattgaacatgatcaatggtgtggtattca

SEQ ID NO: 17058 - DNA, 102 bp, Piromyces finnis
  CBM_10
taatactggctataattgttgtctctctgataaaactccctctagtactaccgataatattggtaagtggggtattgaaggtggtgattggtgtcttattga

SEQ ID NO: 17059 - DNA, 114 bp, Piromyces finnis; identical to SEQ ID NO: 17057
  CBM_10

SEQ ID NO: 17060 - DNA, 102 bp, Piromyces finnis; identical to SEQ ID NO: 17058
  CBM_10

SEQ ID NO: 17061 - DNA, 67 bp, Piromyces finnis; identical to SEQ ID NO: 17056
  CBM_10

SEQ ID NO: 17062 - DNA, 87 bp, Piromyces finnis; identical to SEQ ID NO: 17054
  CBM_10

SEQ ID NO: 17063 - DNA, 93 bp, Piromyces finnis; identical to SEQ ID NO: 17055
  CBM_10

SEQ ID NO: 17064 - DNA, 114 bp, Piromyces finnis; identical to SEQ ID NO: 17053
  CBM_10

SEQ ID NO: 17065 - DNA, 114 bp, Piromyces finnis; identical to SEQ ID NO: 17053
  CBM_10

SEQ ID NO: 17066 - DNA, 87 bp, Piromyces finnis; identical to SEQ ID NO: 17054
  CBM_10

SEQ ID NO: 17067 - DNA, 93 bp, Piromyces finnis; identical to SEQ ID NO: 17055
  CBM_10

SEQ ID NO: 17068 - DNA, 114 bp, Piromyces finnis; identical to SEQ ID NO: 17057
  CBM_10

SEQ ID NO: 17069 - DNA, 67 bp, Piromyces finnis; identical to SEQ ID NO: 17056
  CBM_10

SEQ ID NO: 17070 - DNA, 102 bp, Piromyces finnis; identical to SEQ ID NO: 17058
  CBM_10

SEQ ID NO: 17071 - DNA, 102 bp, Piromyces finnis; identical to SEQ ID NO: 17058
  CBM_10

SEQ ID NO: 17072 - DNA, 67 bp, Piromyces finnis; identical to SEQ ID NO: 17056
  CBM_10

SEQ ID NO: 17073 - DNA, 114 bp, Piromyces finnis; identical to SEQ ID NO: 17057
  CBM_10

SEQ ID NO: 17074 - DNA, 126 bp, Piromyces finnis
  CBM_10
atgttggtcagaaaaacttggttattcttgctgtaaaaataagaatacaaaaattagttatatttctagatcgacaggtaaagaattatattatggtgttgaacacggtcaatggtgtggtatcac

SEQ ID NO: 17075 - DNA, 99 bp, Piromyces finnis
  CBM_10
ttctggttatagttgttgttccctttcaaatactgaagttagaactaccgatgcggtaggtaaatggggtattgaaggtgaagaatggtgtcttattga

SEQ ID NO: 17076 - DNA, 73 bp, Piromyces finnis
  CBM_10
agaatataaatgttgtcaagaatgcaatatttcctatactgatactgaagattggggtattgaaaatggtaat

SEQ ID NO: 17077 - DNA, 114 bp, Piromyces finnis; identical to SEQ ID NO: 17057
  CBM_10

SEQ ID NO: 17078 - DNA, 67 bp, Piromyces finnis; identical to SEQ ID NO: 17056
  CBM_10

SEQ ID NO: 17079 - DNA, 102 bp, Piromyces finnis; identical to SEQ ID NO: 17058
  CBM_10

SEQ ID NO: 17080 - DNA, 93 bp, Piromyces finnis; identical to SEQ ID NO: 17055
  CBM_10

SEQ ID NO: 17081 - DNA, 114 bp, Piromyces finnis; identical to SEQ ID NO: 17053
  CBM_10

SEQ ID NO: 17082 - DNA, 87 bp, Piromyces finnis; identical to SEQ ID NO: 17054
  CBM_10

SEQ ID NO: 17083 - DNA, 93 bp, Piromyces finnis; identical to SEQ ID NO: 17055
  CBM_10

SEQ ID NO: 17084 - DNA, 87 bp, Piromyces finnis; identical to SEQ ID NO: 17054
  CBM_10

SEQ ID NO: 17085 - DNA, 114 bp, Piromyces finnis; identical to SEQ ID NO: 17053
  CBM_10

SEQ ID NO: 17086 - DNA, 117 bp, Piromyces finnis
  CBM_10
atgttggtctcttgctgaaggttatccatgttgtaagaatcaaaatactccagttaaatatgaatctaaatcaagaggtgttaaatacggtattgaaaacggtgattggtgtggtct

SEQ ID NO: 17087 - DNA, 108 bp, Piromyces finnis
  CBM_10
ttgggcatctgctttaggtttcacttgttgtaaggcaaccaagactgtcgttatggaagatgctgatggtgcttggggtgttgaagatggtttctggtgtggtattgt

SEQ ID NO: 17088 - DNA, 105 bp, Piromyces finnis
  CBM_10
atgtgaattcaatactcttggttattcttgctgtccagacgctactgtcgtttatgaagatgaccacaaatggggatatgttaacaaccactggtgtggtgttac

SEQ ID NO: 17089 - DNA, 111 bp, Piromyces finnis
  CBM_10
ttgttggtcctctaagattggttatccatgttgtaaggaaaacaacgttatttacgccattgactctcaaggtagttggggttatgaaaatgattcatggtgtggtatttc

SEQ ID NO: 17090 - DNA, 108 bp, Piromyces finnis
  CBM_10
ttgctggtcttccgctttaggttacccatgctgtaaatcttgtgatgctatataccaagataacgatggtaagtggggtttcgaaaacaatgactggtgtggtattgc

SEQ ID NO: 17091 - DNA, 105 bp, Piromyces finnis
  CBM_10
ttctggtgctttaggatacccatgctgtaaatctgcctgcactgtctatgatactgatagtaatggaaaatggagtatcgaaaataatgactggtgtttaattga

SEQ ID NO: 17092 - DNA, 97 bp, Piromyces finnis
  CBM_10
ttgtaccggtcaagatagtggtttcccatgttgtaatcattgtgaagttatctacaatgataatgatggaccatggggtattgaaaatggtgaatgg

SEQ ID NO: 17093 - DNA, 105 bp, Piromyces finnis
  CBM_10
ttttgctattgctcaaggttatgaatgttgtaacgataatgaagtcgtatatactgatgaatctggtcaatggggtattaaggatggtcaatggtgtggtattgg

SEQ ID NO: 17094 - DNA, 87 bp, Piromyces finnis
  CBM_10
ttatccatgttgtaatgaatgtgaagttatttacactgataacgatggtgactggggtgttgaaaataacgaatggtgtttaattaa

SEQ ID NO: 17095 - DNA, 108 bp, Piromyces finnis
  CBM_10
ctgtactggtatgaactctggttatcaatgttgtgatacttgtaatgttgtctacactgataatgatggtaaatggggtattatgaatggtgaatggtgtggtattaa

SEQ ID NO: 17096 - DNA, 111 bp, Piromyces finnis
  CBM_10
ttgttggtctactggtttaggttacaattgctgtaaatcatgtgttgatgttgcttacatcgataatgatggtaaatggggtgttgaaaatggtaattggtgtcttattaa

SEQ ID NO: 17097 - DNA, 111 bp, Piromyces finnis; identical to SEQ ID NO: 16827
  CBM_10

SEQ ID NO: 17098 - DNA, 90 bp, Piromyces finnis
  CBM_10
tgattacgcctgctgtagtggatgtgaatcagtctatgttgacaatgatggtaaatggggtgttgaaaatggtaattggtgtcttattaa

SEQ ID NO: 17099 - DNA, 108 bp, Piromyces finnis; identical to SEQ ID NO: 17095
  CBM_10

SEQ ID NO: 17100 - DNA, 97 bp, Piromyces finnis; identical to SEQ ID NO: 17092
  CBM_10

SEQ ID NO: 17101 - DNA, 105 bp, Piromyces finnis; identical to SEQ ID NO: 17093
  CBM_10

SEQ ID NO: 17102 - DNA, 87 bp, Piromyces finnis; identical to SEQ ID NO: 17094
  CBM_10

SEQ ID NO: 17103 - DNA, 108 bp, Piromyces finnis; identical to SEQ ID NO: 17095
  CBM_10

SEQ ID NO: 17104 - DNA, 111 bp, Piromyces finnis; identical to SEQ ID NO: 16827
  CBM_10

SEQ ID NO: 17105 - DNA, 90 bp, Piromyces finnis; identical to SEQ ID NO: 17098
  CBM_10

SEQ ID NO: 17106 - DNA, 97 bp, Piromyces finnis; identical to SEQ ID NO: 17092
  CBM_10

SEQ ID NO: 17107 - DNA, 87 bp, Piromyces finnis; identical to SEQ ID NO: 17094
  CBM_10

SEQ ID NO: 17108 - DNA, 105 bp, Piromyces finnis; identical to SEQ ID NO: 17093
  CBM_10

SEQ ID NO: 17109 - DNA, 108 bp, Piromyces finnis; identical to SEQ ID NO: 17095
  CBM_10

SEQ ID NO: 17110 - DNA, 111 bp, Piromyces finnis; identical to SEQ ID NO: 16827
  CBM_10

SEQ ID NO: 17111 - DNA, 90 bp, Piromyces finnis; identical to SEQ ID NO: 17098
  CBM_10

SEQ ID NO: 17112 - DNA, 105 bp, Piromyces finnis
  CBM_10
tttctctgaaaagttaggttacaaatgctgtaaggcatgtgatactatttacaccgatgaaagtggtgactggggtttcgaaaacaatgactggtgtggtattgc

SEQ ID NO: 17113 - DNA, 105 bp, Piromyces finnis; identical to SEQ ID NO: 17091
  CBM_10

SEQ ID NO: 17114 - DNA, 117 bp, Piromyces finnis
  CBM_10
ttgctgggctgaacttctcggttacagttgctgtagtactaaaacttgtagaaatgctgtctacactgatgatgatggccaatgggatgttgaaaatggtaattggtgtggtattac

SEQ ID NO: 17115 - DNA, 93 bp, Piromyces finnis
  CBM_10
aagtggatatccatactgtaagaccaccactgatgttgtttacactgacagtgtcaaatggggtattgaaaacaatgactggtgcggtatcgt

SEQ ID NO: 17116 - DNA, 114 bp, Piromyces finnis
  CBM_10
ctgctgggctagtaagcttggatttaaatgttgtacctcccaatgtccacaagaagtttacgttgatactgatggtagttggggtgttgaaaacaacaactggtgtggtatagt

SEQ ID NO: 17117 - DNA, 117 bp, Piromyces finnis
  CBM_10
ttgctgggctgaacttctcggttacagttgctgtagtactaaaacttgtagaaatgctgtctacactgatgatgatggccaatgggatgttgaaaatggtaattggtgtggtattgg

SEQ ID NO: 17118 - DNA, 111 bp, Piromyces finnis
  CBM_10
ttgctggtctgaagaattaggttatccatgttgtacctctactactaaggttgtttacactgatgaaagtggtaattggggtgttgaaaacaacaactggtgtggtatagt

SEQ ID NO: 17119 - DNA, 117 bp, Piromyces finnis; identical to SEQ ID NO: 17117
  CBM_10

SEQ ID NO: 17120 - DNA, 114 bp, Piromyces finnis; identical to SEQ ID NO: 17116
  CBM_10

SEQ ID NO: 17121 - DNA, 48 bp, Piromyces finnis
  CBM_10
tgctagtggtcgttggggtattgaaaacaatgactggtgcggtatcgt

SEQ ID NO: 17122 - DNA, 117 bp, Piromyces finnis; identical to SEQ ID NO: 17117
  CBM_10

SEQ ID NO: 17123 - DNA, 93 bp, Piromyces finnis; identical to SEQ ID NO: 17115
  CBM_10

SEQ ID NO: 17124 - DNA, 114 bp, Piromyces finnis; identical to SEQ ID NO: 17116
  CBM_10

SEQ ID NO: 17125 - DNA, 114 bp, Piromyces finnis; identical to SEQ ID NO: 17116
  CBM_10

SEQ ID NO: 17126 - DNA, 117 bp, Piromyces finnis; identical to SEQ ID NO: 17114
  CBM_10

SEQ ID NO: 17127 - DNA, 48 bp, Piromyces finnis; identical to SEQ ID NO: 17121
  CBM_10

SEQ ID NO: 17128 - DNA, 111 bp, Piromyces finnis
  CBM_10
ttgctggtctgaagaattaggttatccatgttgtacctctactactaaggttgtttacactgatgaaagtggttcctggggtattgaaaacggtgactggtgcggtattaa

SEQ ID NO: 17129 - DNA, 117 bp, Piromyces finnis; identical to SEQ ID NO: 17114
  CBM_10

SEQ ID NO: 17130 - DNA, 111 bp, Piromyces finnis; identical to SEQ ID NO: 17118
  CBM_10

SEQ ID NO: 17131 - DNA, 105 bp, Piromyces finnis
  CBM_10
taagggagctcaaggttatccatgttgtcaattctcctgtgatgtttattctactgatagtgatggtaaatggagtgttgaaaacaataactggtgtttaattga

SEQ ID NO: 17132 - DNA, 84 bp, Piromyces finnis
  CBM_10
tgaatatccatattgtagtggatgtgaatccaattatcaagatgctgatggtgaatggtattttgttgataacaaatggtgtaa

SEQ ID NO: 17133 - DNA, 96 bp, Piromyces finnis
  CBM_10
gggttacccatgttgtaccaatccatcaactaccgttttctatgttgatgaagatggtaactggggtttagaaaatgataactggtgtattatgaa

SEQ ID NO: 17134 - DNA, 114 bp, Piromyces finnis
  CBM_10
ttttgcccttaaattaggtttcccatgttgtaataacaatgaaatatattataccgatgaaaatggaaattggggtttaacaaacactacaccagtcaattggtgtggtattgg

SEQ ID NO: 17135 - DNA, 90 bp, Piromyces finnis
  CBM_10
atgttggtcaaaagaacttggttttgaatgttgcaaatcctgtgtaactcaatatactgatgaagatggtcaatggggttatgaagatga

SEQ ID NO: 17136 - DNA, 102 bp, Piromyces finnis
  CBM_10
tttcgctactaaacttggttacaagtgctgttctgaatgtgatgttacctacactgattctgatggtgattggggctttgaaggtgactggtgtggtattaa

SEQ ID NO: 17137 - DNA, 94 bp, Piromyces finnis
  CBM_10
tttctctcttccagactatccatgttgttcctctggtactagtgtagtttacactgacgctagtggttcatggggtgttgaaaataatgaatgg

SEQ ID NO: 17138 - DNA, 108 bp, Piromyces finnis
  CBM_10
atgtttctctgaaaagcaaggttatccatgctgttcaggatgtgatgttgcctacattgactctgatggtgactggggatatgaaaatgatagctggtgtggtattaa

SEQ ID NO: 17139 - DNA, 105 bp, Piromyces finnis
  CBM_10
ttgtttcgctactaagcttggttacaagtgctgttcaggatgtgatgtcacctacactgattctgatggtgactggggctttgaaggtgactggtgtggtattaa

SEQ ID NO: 17140 - DNA, 108 bp, Piromyces finnis; identical to SEQ ID NO: 17138
  CBM_10

SEQ ID NO: 17141 - DNA, 94 bp, Piromyces finnis
  CBM_10
tttctctcttccagactatccatgttgttcctctggtactagtgtagcctacactgatgctagtggttcatggggtgttgaaaataatgaatgg

SEQ ID NO: 17142 - DNA, 102 bp, Piromyces finnis
  CBM_10
tttttcttctccaatatatccatgttgctcaaaatgtaatattgtattcacagatgaagaaggagattggggttacgaaaaaggagattggtgtggtattag

SEQ ID NO: 17143 - DNA, 111 bp, Piromyces finnis
  CBM_10
ttgttgggcagaagaatttggatacaattgctgtaaacattgtacagttacttatagtgacgaaaatggggattggggtagagaagaagatgatgcatggtgtggtattat

SEQ ID NO: 17144 - DNA, 108 bp, Piromyces finnis
  CBM_10
ctgctgggctgaaaaattaggatataagtgttgtaatgaatgcactgttacttataatgatgaaaatggtgattggggatttgaaaacggggaatggtgtggtatttt

SEQ ID NO: 17145 - DNA, 97 bp, Piromyces finnis
  CBM_10
atgctggtcatctacaatgggatataaatgctgtcaaaaatgtaatgttgtcactgaagataattctggaaagtggggtattgaaaacaatgaatgg

SEQ ID NO: 17146 - DNA, 97 bp, Piromyces finnis
  CBM_10
atgctggtcatctgcaataggatataaatgctgtcaaaaatgtgacattgtcactgaagataattctggaaagtggggtattgaaaacaatgaatgg

SEQ ID NO: 17147 - DNA, 114 bp, Piromyces finnis
  CBM_10
ctgctggtctcaaagtttaggttacccatgttgttcctctgctagtgctaaggttgaatacactgatgccgatggtaagtggggtattgaaaacggtaactggtgtggtattcc

SEQ ID NO: 17148 - DNA, 111 bp, Piromyces finnis
  CBM_10
ttgctgggctaagccattaggttacaactgttgtacttcaactactcaagctgtctacactgatagcgatggtaagtggggtgttgaaaacggtgactggtgtggtattgt

SEQ ID NO: 17149 - DNA, 114 bp, Piromyces finnis
  CBM_10
ttgctggtcccaaaaattaggttacccatgctgttcttccagctctgctcaagtttggttcaccgataatgatggtgaatggggtgttgaaaacggtgactggtgtggtattgt

SEQ ID NO: 17150 - DNA, 114 bp, Piromyces finnis; identical to SEQ ID NO: 17149
  CBM_10

SEQ ID NO: 17151 - DNA, 114 bp, Piromyces finnis; identical to SEQ ID NO: 17147
  CBM_10

SEQ ID NO: 17152 - DNA, 111 bp, Piromyces finnis
  CBM_10
ctgctggtctcaaccattaggttacccatgctgtacttctacctctactgctgtttacactgatggtgatggtgcttggggtattgaaaacggcgattggtgtggtatcaa

SEQ ID NO: 17153 - DNA, 111 bp, Piromyces finnis
  CBM_10
ttgctgggctaagccattaggttacaactgttgtacttcaactactcaagctgtctacactgatagcgatggtaagtggggtgttgaaaacggtgactggtgtggtattcc

SEQ ID NO: 17154 - DNA, 111 bp, Piromyces finnis; identical to SEQ ID NO: 17152
  CBM_10

SEQ ID NO: 17155 - DNA, 114 bp, Piromyces finnis
  CBM_10
ttgctggtcccaaaaattaggttacccatgctgttcttccagctctgctcaagtttggttcaccgataatgatggtgaatggggtgttgaaaacggtgactggtgtggtattcc

SEQ ID NO: 17156 - DNA, 114 bp, Piromyces finnis; identical to SEQ ID NO: 17147
  CBM_10

SEQ ID NO: 17157 - DNA, 111 bp, Piromyces finnis; identical to SEQ ID NO: 17148
  CBM_10

SEQ ID NO: 17158 - DNA, 111 bp, Piromyces finnis; identical to SEQ ID NO: 17152
  CBM_10

SEQ ID NO: 17159 - DNA, 114 bp, Piromyces finnis; identical to SEQ ID NO: 17155
  CBM_10

SEQ ID NO: 17160 - DNA, 114 bp, Piromyces finnis; identical to SEQ ID NO: 17149
  CBM_10

SEQ ID NO: 17161 - DNA, 114 bp, Piromyces finnis; identical to SEQ ID NO: 17147
  CBM_10

SEQ ID NO: 17162 - DNA, 111 bp, Piromyces finnis; identical to SEQ ID NO: 17148
  CBM_10

SEQ ID NO: 17163 - DNA, 114 bp, Piromyces finnis; identical to SEQ ID NO: 17149
  CBM_10

SEQ ID NO: 17164 - DNA, 114 bp, Piromyces finnis; identical to SEQ ID NO: 17147
  CBM_10

SEQ ID NO: 17165 - DNA, 111 bp, Piromyces finnis; identical to SEQ ID NO: 17148
  CBM_10

SEQ ID NO: 17166 - DNA, 114 bp, Piromyces finnis; identical to SEQ ID NO: 17147
  CBM_10

SEQ ID NO: 17167 - DNA, 111 bp, Piromyces finnis; identical to SEQ ID NO: 17148
  CBM_10

SEQ ID NO: 17168 - DNA, 114 bp, Piromyces finnis; identical to SEQ ID NO: 17147
  CBM_10

SEQ ID NO: 17169 - DNA, 111 bp, Piromyces finnis; identical to SEQ ID NO: 17152
  CBM_10

SEQ ID NO: 17170 - DNA, 111 bp, Piromyces finnis; identical to SEQ ID NO: 17153
  CBM_10

SEQ ID NO: 17171 - DNA, 114 bp, Piromyces finnis; identical to SEQ ID NO: 17149
  CBM_10

SEQ ID NO: 17172 - DNA, 114 bp, Piromyces finnis; identical to SEQ ID NO: 17147
  CBM_10

SEQ ID NO: 17173 - DNA, 111 bp, Piromyces finnis; identical to SEQ ID NO: 17152
  CBM_10

SEQ ID NO: 17174 - DNA, 111 bp, Piromyces finnis; identical to SEQ ID NO: 17153
  CBM_10

SEQ ID NO: 17175 - DNA, 114 bp, Piromyces finnis; identical to SEQ ID NO: 17147
  CBM_10

SEQ ID NO: 17176 - DNA, 111 bp, Piromyces finnis; identical to SEQ ID NO: 17148
  CBM_10

SEQ ID NO: 17177 - DNA, 114 bp, Piromyces finnis; identical to SEQ ID NO: 17149
  CBM_10

SEQ ID NO: 17178 - DNA, 111 bp, Piromyces finnis; identical to SEQ ID NO: 17152
  CBM_10

SEQ ID NO: 17179 - DNA, 114 bp, Piromyces finnis; identical to SEQ ID NO: 17155
  CBM_10

SEQ ID NO: 17180 - DNA, 105 bp, Piromyces finnis
  CBM_10
ttggtctactgctttcggttacagctgttgtaagtcatgtggtccagtttacttcactgacgaaagtggtaactggggtattgaaaatggtgactggtgtggtct

SEQ ID NO: 17181 - DNA, 108 bp, Piromyces finnis; identical to SEQ ID NO: 16774
  CBM_10

SEQ ID NO: 17182 - DNA, 105 bp, Piromyces finnis; identical to SEQ ID NO: 17180
  CBM_10

SEQ ID NO: 17183 - DNA, 85 bp, Piromyces finnis
  CBM_10
ctggtcagaaccattaggatacccatgttgtactggatgtgcctattcatggtacagtgatgatgatggtgaatggggtgttgaa

SEQ ID NO: 17184 - DNA, 105 bp, Piromyces finnis; identical to SEQ ID NO: 17180
  CBM_10

SEQ ID NO: 17185 - DNA, 85 bp, Piromyces finnis; identical to SEQ ID NO: 17183
  CBM_10

SEQ ID NO: 17186 - DNA, 85 bp, Piromyces finnis; identical to SEQ ID NO: 17183
  CBM_10

SEQ ID NO: 17187 - DNA, 105 bp, Piromyces finnis; identical to SEQ ID NO: 17180
  CBM_10

SEQ ID NO: 17188 - DNA, 105 bp, Piromyces finnis
  CBM_10
taaatcagttgaaggctatccatgctgtaaatcctcttgtatcgtatacaccaaagaaaacggtgttaactggggtgtagaaaataataattggtgtgtaatcaa

SEQ ID NO: 17189 - DNA, 111 bp, Piromyces finnis
  CBM_10
ctgttgggcaaaggctttaggttactcttgctgtgattcttgtgctccagtttactatttcgataatgatggagaatggggtattgttgatggacaatggtgtggtattcc

SEQ ID NO: 17190 - DNA, 85 bp, Piromyces finnis; identical to SEQ ID NO: 17183
  CBM_10

SEQ ID NO: 17191 - DNA, 108 bp, Piromyces finnis; identical to SEQ ID NO: 16774
  CBM_10

SEQ ID NO: 17192 - DNA, 108 bp, Piromyces finnis; identical to SEQ ID NO: 16774
  CBM_10

SEQ ID NO: 17193 - DNA, 105 bp, Piromyces finnis; identical to SEQ ID NO: 17188
  CBM_10

SEQ ID NO: 17194 - DNA, 111 bp, Piromyces finnis; identical to SEQ ID NO: 17189
  CBM_10

SEQ ID NO: 17195 - DNA, 76 bp, Piromyces finnis
  CBM_10
tacttctctaggttattcatgttgtaaaagtgaaaattgtatggtttattatcaagatgaatctggtgattggggt

SEQ ID NO: 17196 - DNA, 109 bp, Piromyces finnis
  CBM_10
ctcagcttctatcatgagccaaggttacaagtgctgttccaagaactgccaagttgtttacactgatgctgatggtgactggggtgttgaaaacggtcaatggtgtggt

SEQ ID NO: 17197 - DNA, 109 bp, Piromyces finnis
  CBM_10
ttctgctgctattactagacaaggttacaagtgctgttctaagaattgccaagttgtttacactgatggtgatggtgactggggtgttgaaaacggtcaatggtgtggt

SEQ ID NO: 17198 - DNA, 117 bp, Piromyces finnis
  CBM_10
ttgctcagctaagattactagccaaggttacaagtgctgttcttctagctgtgtcccatcttataccgatggtgatggtgattgggctattgaaaatggtgaatggtgtggtatcac

SEQ ID NO: 17199 - DNA, 111 bp, Piromyces finnis
  CBM_10
atgttggtctgaaaaattaggattcccatgttgtagcaaatgtggacaagttgtttacaccgatgaagatggtaactggagtgttgaaaacaatgattggtgtatcattag

SEQ ID NO: 17200 - DNA, 114 bp, Piromyces finnis
  CBM_10
ttcttctaagattactagccaaggttacaagtgctgttcttctagctgtgtcccatcttataccgatggtgatggtgattgggctattgaaaatggtgaatggtgtggtatcac

SEQ ID NO: 17201 - DNA, 111 bp, Piromyces finnis; identical to SEQ ID NO: 17199
  CBM_10

SEQ ID NO: 17202 - DNA, 117 bp, Piromyces finnis
  CBM_10
ctgctctgccaatattcttgctcaaggttacaagtgctgttctgctggttgtcaagtcatttacactgataatgatggtacctggggtgctgaaaatggtgaatggtgtggttgtgg

SEQ ID NO: 17203 - DNA, 111 bp, Piromyces finnis
  CBM_10
tgctgccgcttctcaaggttatccatgctgcaaaaaccaaaatgctgaagtttactaccaagatgaaactggtgattggggtattgaaaatggtgaatggtgtggatgtgg

SEQ ID NO: 17204 - DNA, 111 bp, Piromyces finnis; identical to SEQ ID NO: 17005
  CBM_10

SEQ ID NO: 17205 - DNA, 111 bp, Piromyces finnis; identical to SEQ ID NO: 17199
  CBM_10

SEQ ID NO: 17206 - DNA, 117 bp, Piromyces finnis; identical to SEQ ID NO: 17202
  CBM_10

SEQ ID NO: 17207 - DNA, 117 bp, Piromyces finnis
  CBM_10
ttgctcagctaagattactagccaaggttacaagtgctgttcttctagctgtgtcccatcttataccgatggtgatggtgattgggctattgaaaatggtgaatggtgtggatgtgg

SEQ ID NO: 17208 - DNA, 117 bp, Piromyces finnis
  CBM_10
ctgctctgccaatattcttgctcaaggttacaagtgctgttctgctggttgtcaagtagtttacaccgataatgacggtacttggggtgttgaaaataatgaatggtgtggttgtaa

SEQ ID NO: 17209 - DNA, 114 bp, Piromyces finnis
  CBM_10
ttcttctaagattactagccaaggttacaagtgctgttcttctagctgtgtcccatcttataccgatggtgatggtgattgggctattgaaaatggtgaatggtgtggatgtgg

SEQ ID NO: 17210 - DNA, 117 bp, Piromyces finnis; identical to SEQ ID NO: 17202
  CBM_10

SEQ ID NO: 17211 - DNA, 114 bp, Piromyces finnis
  CBM_10
tacttcaattactaatcaaggttataagtgttgttctgctgaaaagtgtgaagttgtatacactgatgaatccggtgattggggtgttgaagatggtgactggtgtggttgtac

SEQ ID NO: 17212 - DNA, 99 bp, Piromyces finnis
  CBM_10
tttaggatatccatgttgttctaaaactaattgtgttgctgtttacactgatgaaactggtgattgggatgttgaaaacaatgattggtgttggtgtag

SEQ ID NO: 17213 - DNA, 117 bp, Piromyces finnis
  CBM_10
tcctacttcaattactaatcaaggttataagtgttgttctgctgaaaagtgtgaagttgtatacactgatgaatccggtgattggggtgttgaagatggtgactggtgtggttgtac

SEQ ID NO: 17214 - DNA, 99 bp, Piromyces finnis; identical to SEQ ID NO: 17212
  CBM_10

SEQ ID NO: 17215 - DNA, 94 bp, Piromyces finnis; identical to SEQ ID NO: 16781
  CBM_10

SEQ ID NO: 17216 - DNA, 94 bp, Piromyces finnis; identical to SEQ ID NO: 16781
  CBM_10

SEQ ID NO: 17217 - DNA, 94 bp, Piromyces finnis; identical to SEQ ID NO: 16781
  CBM_10

SEQ ID NO: 17218 - DNA, 94 bp, Piromyces finnis; identical to SEQ ID NO: 16781
  CBM_10

SEQ ID NO: 17219 - DNA, 99 bp, Piromyces finnis
  CBM_10
ctgtcacccatactacaattgctgtaataattgtgatgtttattacactgataacgaaggtaagtggggtgttcaaaacaacgactggtgtttcattga

SEQ ID NO: 17220 - DNA, 105 bp, Piromyces finnis
  CBM_10
caagttcgaaagtttaggttaccgttgctgtaacggttgtgacgttgtttacaccgatagtgatggtaactggggtgttgaaaatggtaactggtgtggtattag

SEQ ID NO: 17221 - DNA, 111 bp, Piromyces finnis
  CBM_10
agcttctatcatgagccaaggttacaagtgctgttccaagaactgccaagttgtttacactgatgctgatggtgactggggtgttgaaaacggtcaatggtgtggttgtgg

SEQ ID NO: 17222 - DNA, 105 bp, Piromyces finnis
  CBM_10
caagttcgaaagtttaggttaccgttgctgtaacggttgtgacgttgtttacaccgatagtgatggtaactggggtgttgaaaatggtaactggtgtggtattca

SEQ ID NO: 17223 - DNA, 99 bp, Piromyces finnis; identical to SEQ ID NO: 17219
  CBM_10

SEQ ID NO: 17224 - DNA, 96 bp, Piromyces finnis
  CBM_10
ccaaggttacaagtgctgttccaagaactgccaagttgtttacactgatgctgatggtgactggggtgttgaaaacggtcaatggtgtggttgtgg

SEQ ID NO: 17225 - DNA, 114 bp, Piromyces finnis
  CBM_10
ctctgcttctattactaaccaaggttacaagtgttgtaaggttggatgtcaaaccatttacaccgatgctgacggtaactggggtgttgaaaacaaccaatggtgtggatgtgg

SEQ ID NO: 17226 - DNA, 99 bp, Piromyces finnis
  CBM_10
taaccaaggatatccatgctgtaagtcctgcggtaccgtctattacaccgatgctgatggtgaatggggtgtcgaaaacggtgactggtgtggtatgcc

SEQ ID NO: 17227 - DNA, 99 bp, Piromyces finnis; identical to SEQ ID NO: 17226
  CBM_10

SEQ ID NO: 17228 - DNA, 114 bp, Piromyces finnis; identical to SEQ ID NO: 17225
  CBM_10

SEQ ID NO: 17229 - DNA, 114 bp, Piromyces finnis
  CBM_10
ttcttctaagatcacttcccaaggttaccaatgctgttctgataactgtgaagttatttacactgatgctgatggtaactggggtgttgaaaatggtaactggtgtggtattca

SEQ ID NO: 17230 - DNA, 114 bp, Piromyces finnis
  CBM_10
ttctgctgctattactagacaaggttacaagtgctgttctaagaattgccaagttgtttacactgatggtgatggtgactggggtgttgaaaacggtcaatggtgtggttgtgg

SEQ ID NO: 17231 - DNA, 114 bp, Piromyces finnis; identical to SEQ ID NO: 17230
  CBM_10

SEQ ID NO: 17232 - DNA, 108 bp, Piromyces finnis
  CBM_10
ttctattacctcacaaggttatccatgctgttcatcttgtggtaccgtctactaccaagatgctgatggtgactggggtgttgaaaacggtcaatggtgtggttgtgg

SEQ ID NO: 17233 - DNA, 105 bp, Piromyces finnis
  CBM_10
taatggtgcccaaggattcccatgttgtcaaaatacttgtgaagtctatactactgattccgatggtgattggggtttagaaaatggtaactggtgtggtattca

SEQ ID NO: 17234 - DNA, 111 bp, Piromyces finnis
  CBM_10
ttgctggtctacttcattaggttattcatgttgtaaatcatgtatcaatgttgcctacaaggataatgatggtgaatggggtattgaaaataacaattggtgtggtattcc

SEQ ID NO: 17235 - DNA, 99 bp, Piromyces finnis; identical to SEQ ID NO: 17219
  CBM_10

SEQ ID NO: 17236 - DNA, 105 bp, Piromyces finnis
  CBM_10
caagttcgaaagtttaggttaccgttgctgtaacggttgtgacgttgtttacaccgatagtgatggtaactggggtgttgaaaatggtaactggtgtggtattaa

SEQ ID NO: 17237 - DNA, 99 bp, Piromyces finnis; identical to SEQ ID NO: 17226
  CBM_10

SEQ ID NO: 17238 - DNA, 114 bp, Piromyces finnis; identical to SEQ ID NO: 17225
  CBM_10

SEQ ID NO: 17239 - DNA, 114 bp, Piromyces finnis; identical to SEQ ID NO: 17225
  CBM_10

SEQ ID NO: 17240 - DNA, 99 bp, Piromyces finnis; identical to SEQ ID NO: 17226
  CBM_10

SEQ ID NO: 17241 - DNA, 114 bp, Piromyces finnis
  CBM_10
ttctgcaaagattactagtcaaggttacaagtgttgtagtgctggatgtgtaatttactacactgatgctgatggtgattggggtgttgaaaacaatgaatggtgtggttgtgg

SEQ ID NO: 17242 - DNA, 105 bp, Piromyces finnis
  CBM_10
ttctgcaaagattactagtcaaggttacaagtgttgtagtgctggatgtgtaatttactacactgatgctgatggtgattggggtgttgaaaacaaccaatcacc

SEQ ID NO: 17243 - DNA, 106 bp, Piromyces finnis
  CBM_10
ttgggctaaatcttctggatattcatgctgttctaccaacaaatgtagagaagttgtttactttgacaaagaaggtcaatgggatgttgaaaatggtcaatggtgt

SEQ ID NO: 17244 - DNA, 108 bp, Piromyces finnis
  CBM_10
tttctccactaagttaggttacccatgctgtaaagctggtacccaagctgtttacaccgatgctgacggtgattggggtgttgaaaatggtgattggtgtggtattaa

SEQ ID NO: 17245 - DNA, 111 bp, Piromyces finnis
  CBM_10
ttgttggtccaagtcattaggtttcgaatgttgtaccggttcagcttacgttctctacaccgatgaaaatggtcaatggggtgttgaaaatggtgattggtgtggtattgg

SEQ ID NO: 17246 - DNA, 97 bp, Piromyces finnis
  CBM_10
atgctgggctcaagctttaggttacccatgctgtaagaatactaaggatgttgttaccactgattctgatggtgactggggtattgaaaatggtgac

SEQ ID NO: 17247 - DNA, 96 bp, Piromyces finnis
  CBM_10
aggttatcctttatgtaaggaaaagcatgaagatgatttagttagagatgaagatggctactgggccattgaagatggtaattggtgtggtgttca

SEQ ID NO: 17248 - DNA, 97 bp, Piromyces finnis
  CBM_10
ttgcagaagtgccaaggttggttacaaatgttgtaaggaaactactgaagttgttgccagagacagtcttggtttctggggtgttgaaaatggtcaa

SEQ ID NO: 17249 - DNA, 108 bp, Piromyces finnis
  CBM_10
tttctccactaagttaggttacccatgctgtaaagctggtacccaagctgtttacaccgatgctgacggtgattggggtgttgaaaatggtgattggtgtggtatttt

SEQ ID NO: 17250 - DNA, 108 bp, Piromyces finnis
  CBM_10
tttctccactaagttaggttacccatgctgtaaagctggtacccaagctgtttacaccgatgctgacggtgattggggtgttgaaaatggtgattggtgtggtattgg

SEQ ID NO: 17251 - DNA, 97 bp, Piromyces finnis; identical to SEQ ID NO: 17246
  CBM_10

SEQ ID NO: 17252 - DNA, 106 bp, Piromyces finnis; identical to SEQ ID NO: 17243
  CBM_10

SEQ ID NO: 17253 - DNA, 111 bp, Piromyces finnis
  CBM_10
ttgttggtccaagtcattaggtttcgaatgttgtaccggttcagcttacgttctctacaccgatgaaaatggtcaatggggtgttgaaaatggtgattggtgtggtattaa

SEQ ID NO: 17254 - DNA, 111 bp, Piromyces finnis; identical to SEQ ID NO: 17148
  CBM_10

SEQ ID NO: 17255 - DNA, 111 bp, Piromyces finnis
  CBM_10
ttgctgggctaaggctttaggttacaactgttgtacttccactactcaagctatttacactgatagtgatggtaagtggggtgttgaaaacggtgactggtgtggtattgt

SEQ ID NO: 17256 - DNA, 111 bp, Piromyces finnis; identical to SEQ ID NO: 17255
  CBM_10

SEQ ID NO: 17257 - DNA, 111 bp, Piromyces finnis; identical to SEQ ID NO: 17255
  CBM_10

SEQ ID NO: 17258 - DNA, 111 bp, Piromyces finnis; identical to SEQ ID NO: 17255
  CBM_10

SEQ ID NO: 17259 - DNA, 111 bp, Piromyces finnis; identical to SEQ ID NO: 17255
  CBM_10

SEQ ID NO: 17260 - DNA, 111 bp, Piromyces finnis
  CBM_10
ttgctgggctgaagctttaggttacaagtgttgtcaaactaccagtaatgttgaattcattgatactgatggtaagtggggtttcgaaaacggtgattggtgtggtattaa

SEQ ID NO: 17261 - DNA, 111 bp, Piromyces finnis
  CBM_10
ctgctttgccgaaaagttaggttacagttgctgtccagatggtactactgtctcttacactgatggtgatggtaaatggggtgttgtcaatggtgactggtgtggtattgc

SEQ ID NO: 17262 - DNA, 111 bp, Piromyces finnis; identical to SEQ ID NO: 17148
  CBM_10

SEQ ID NO: 17263 - DNA, 111 bp, Piromyces finnis
  CBM_10
atgctgggctcaagctttaggttacccatgctgtaagaatactaaggatgttgttaccactgattctgatggtgactggggtattgaaaatggtgactggtgtggtattgt

SEQ ID NO: 17264 - DNA, 111 bp, Piromyces finnis; identical to SEQ ID NO: 17148
  CBM_10

SEQ ID NO: 17265 - DNA, 111 bp, Piromyces finnis; identical to SEQ ID NO: 17255
  CBM_10

SEQ ID NO: 17266 - DNA, 111 bp, Piromyces finnis; identical to SEQ ID NO: 17148
  CBM_10

SEQ ID NO: 17267 - DNA, 111 bp, Piromyces finnis; identical to SEQ ID NO: 17148
  CBM_10

SEQ ID NO: 17268 - DNA, 111 bp, Piromyces finnis; identical to SEQ ID NO: 17152
  CBM_10

SEQ ID NO: 17269 - DNA, 111 bp, Piromyces finnis; identical to SEQ ID NO: 17148
  CBM_10

SEQ ID NO: 17270 - DNA, 111 bp, Piromyces finnis; identical to SEQ ID NO: 17148
  CBM_10

SEQ ID NO: 17271 - DNA, 111 bp, Piromyces finnis; identical to SEQ ID NO: 17148
  CBM_10

SEQ ID NO: 17272 - DNA, 111 bp, Piromyces finnis; identical to SEQ ID NO: 17255
  CBM_10

SEQ ID NO: 17273 - DNA, 111 bp, Piromyces finnis; identical to SEQ ID NO: 17255
  CBM_10

SEQ ID NO: 17274 - DNA, 94 bp, Piromyces finnis
  CBM_10
atgctggtcttcctcccaaggttatccatgctgttcttcttcttcagttgttgttgccttttccgatgctagtggtgaatggggtgttgaaaac

SEQ ID NO: 17275 - DNA, 96 bp, Piromyces finnis
  CBM_10
aaagggttacaaatgctgtaagactacctcccaagtttatgaagttgattctgacggtaaatggggtattgaaaacaatgattggtgtttcattaa

SEQ ID NO: 17276 - DNA, 114 bp, Piromyces finnis
  CBM_10
ttcttctaagattactagccaaggttacaagtgctgtgctagcaattgtgacgtggtttacgttgataatgatggtaactggggtgttgaaaacgatgaatggtgtggatgtgg

SEQ ID NO: 17277 - DNA, 54 bp, Piromyces finnis
  CBM_10
ttgctgggctaacgctttaggttacccatgttgtacttcaactactcaagttgt

SEQ ID NO: 17278 - DNA, 90 bp, Piromyces finnis
  CBM_10
tggttacaactgttgtagaaacacttgtgatattcaatacaaggatgacgatggtaactggggtgttgaaaacaacgactggtgtggatt

SEQ ID NO: 17279 - DNA, 111 bp, Piromyces finnis
  CBM_10
ttcttctaagattactagccaaggttacaagtgctgtgctagcaattgtgacgtggtttacgttgataatgatggtaactggggtgttgaaaacaacgactggtgtggatt

SEQ ID NO: 17280 - DNA, 111 bp, Piromyces finnis
  CBM_10
ttcttctaagattactagccaaggttacaagtgctgtgctagcaattgtgacgtggtttacgttgataatgatggtaactggggtgttgaaaacaacgactggtgtggttt

SEQ ID NO: 17281 - DNA, 90 bp, Piromyces finnis
  CBM_10
tggttacaactgttgtagaaacacttgtgatattcaatacaaggatgacgatggtaactggggtgttgaaaacaacgactggtgtggttt

SEQ ID NO: 17282 - DNA, 108 bp, Piromyces finnis
  CBM_10
atgctggtctgaagctttaggttacccatgttgtgaaggcaatgttgttataacatccgatgaaaatggtgattggggtgttgaaaacaatgaatggtgtggttgtgg

SEQ ID NO: 17283 - DNA, 114 bp, Piromyces finnis; identical to SEQ ID NO: 17241
  CBM_10

SEQ ID NO: 17284 - DNA, 60 bp, Piromyces finnis
  CBM_10
catttacaccgatgctgacggtaactggggtgttgaaaacaaccaatggtgtggatgtgg

SEQ ID NO: 17285 - DNA, 114 bp, Piromyces finnis
  CBM_10
ttcttctaagatcacttcccaaggttaccaatgctgttctgataactgtgaagttatttacactgatgctgatggtaactggggtgttgaaaatggtaactggtgtggtattag

SEQ ID NO: 17286 - DNA, 114 bp, Piromyces finnis; identical to SEQ ID NO: 17285
  CBM_10

SEQ ID NO: 17287 - DNA, 114 bp, Piromyces finnis
  CBM_10
ctctgcttctattactaaccaaggttacaagtgttgtaaggttggatgccaaactgtttacactgatgctgatggtaactggggtgttgaaaatggtaactggtgtggtattag

SEQ ID NO: 17288 - DNA, 114 bp, Piromyces finnis; identical to SEQ ID NO: 17287
  CBM_10

SEQ ID NO: 17289 - DNA, 81 bp, Piromyces finnis
  CBM_10
tggatgctgtgctcattgtaatgccatctacgaagatgaagatggtttatggggtgtttctaatggtgaatggtgtaaaat

SEQ ID NO: 17290 - DNA, 90 bp, Piromyces finnis
  CBM_10
aggttacgaatgctgttcttcttgtaatgttatttacactgacgacgatggtaattggggtgttgaaaacgatcaatggtgtggtattga

SEQ ID NO: 17291 - DNA, 111 bp, Piromyces finnis
  CBM_10
atgtttcagtagtaaattaggttacccatgttgtacttctactactgacgttattaccgaagatgaagatggtaagtggggtttagaaaatggtgattggtgcggtattca

SEQ ID NO: 17292 - DNA, 111 bp, Piromyces finnis; identical to SEQ ID NO: 17261
  CBM_10

SEQ ID NO: 17293 - DNA, 88 bp, Piromyces finnis
  CBM_10
ttgctgggctgaagctttaggttacaagtgttgtcaaactaccagtaatgttgaattcattgatactgatggtaagtggggtttcgaa

SEQ ID NO: 17294 - DNA, 82 bp, Piromyces finnis
  CBM_10
ttgctgggcttctagtttaggttatccatgttgtaagtctactaaggttgtcattgatactgatgctagtggtcgttggggt

SEQ ID NO: 17295 - DNA, 94 bp, Piromyces finnis
  CBM_10
ctgttggtcagaaagattaggttggccatgttgtagtaacagtaacgctgaagtcgtttatgtagatgaagatggtgattggggtgttgaaaac

SEQ ID NO: 17296 - DNA, 105 bp, Piromyces finnis
  CBM_10
ttgctggtcaactaaattaggttacaaatgctgtaagggttgtgatgtttcttatactgatagtgatggtgattggggttatgaaagtgactggtgtggtatccc

SEQ ID NO: 17297 - DNA, 99 bp, Piromyces finnis
  CBM_10
cactacttctggttacccatgctgtaaggattgtaatgtagtttacactgatgaaacaggtaaatggggtattgccaataatgaatggtgtgctatttc

SEQ ID NO: 17298 - DNA, 90 bp, Piromyces finnis
  CBM_10
tgaatacgaatgctgtaatggatgtaatgttgttgaccaatctgatggtcttaagtggggtgttgaaaataataattggtgcatcatcaa

SEQ ID NO: 17299 - DNA, 106 bp, Piromyces finnis
  CBM_10
atgttcttcaaaaattactgctcaaggttattcatgttgttcctcttcaaattgttccattatttacactgatgaagatggtacctggggtgttgaaaatggtcaa

SEQ ID NO: 17300 - DNA, 84 bp, Piromyces finnis; identical to SEQ ID NO: 17132
  CBM_10

SEQ ID NO: 17301 - DNA, 114 bp, Piromyces finnis; identical to SEQ ID NO: 17134
  CBM_10

SEQ ID NO: 17302 - DNA, 96 bp, Piromyces finnis; identical to SEQ ID NO: 17133
  CBM_10

SEQ ID NO: 17303 - DNA, 97 bp, Piromyces finnis
  CBM_10
ttgctggtctgaagctattggttatccatgctgtaagggatgtgaagccatttcaaatgatgaaagtggtgcctggggtgttgaaaataatgaatgg

SEQ ID NO: 17304 - DNA, 90 bp, Piromyces finnis
  CBM_10
tccatgttgttcttctgaaaatgctgaaatcgtttatactgattctgaaggtgattggggtttagaaaaaggagattggtgtcttattaa

SEQ ID NO: 17305 - DNA, 91 bp, Piromyces finnis
  CBM_10
tttttctttaaaacttggttatagatgttgtgaaagatcaaaggttgtttattctgatgctgatggtttatggggtgttgaaaatggtcaa

SEQ ID NO: 17306 - DNA, 79 bp, Piromyces finnis; identical to SEQ ID NO: 16824
  CBM_10

SEQ ID NO: 17307 - DNA, 87 bp, Piromyces finnis; identical to SEQ ID NO: 16784
  CBM_10

SEQ ID NO: 17308 - DNA, 84 bp, Piromyces finnis; identical to SEQ ID NO: 16783
  CBM_10

SEQ ID NO: 17309 - DNA, 87 bp, Piromyces finnis; identical to SEQ ID NO: 16784
  CBM_10

SEQ ID NO: 17310 - DNA, 84 bp, Piromyces finnis; identical to SEQ ID NO: 16783
  CBM_10

SEQ ID NO: 17311 - DNA, 103 bp, Piromyces finnis
  CBM_10
tactggagctcaaggttattcatgttgtaataaagaatgtactgtatactatgatgatgaagatggtgattggagtatagaaaatggtgaatggtgtttaatt

SEQ ID NO: 17312 - DNA, 111 bp, Piromyces finnis
  CBM_10
atgttggtctgaaagcttaggttacccatgttgtgaaactacatgtgatattgttgaaaaagatagtgatggaagttggggtgtagaatataatgaatggtgtggtattcc

SEQ ID NO: 17313 - DNA, 85 bp, Piromyces finnis
  CBM_10
tatagccaaaagtttgggttatcaatgctgtcctaaaaatatatcagaagtatattatcacgatgaaaatggtgattggggattt

SEQ ID NO: 17314 - DNA, 99 bp, Piromyces finnis
  CBM_10
aggctatagttgttgtgaacaaaataattgtaatatttattacaaggatgatgatggtgattggggtcttaccagtagcttaaaatggtgtggtattag

SEQ ID NO: 17315 - DNA, 96 bp, Piromyces finnis
  CBM_10
tcaaatgggttataaatgttgtagatcttgtaatgttgttttaactgactccactggtaaatggggtgttgaagataatgaatggtgtggtattcg

SEQ ID NO: 17316 - DNA, 84 bp, Piromyces finnis
  CBM_10
ttatgtgtgttgcgatcattgtcaatctaattatgaagatgaatttggtaaatggtaccacacaaataaccatgattggtgtgc

SEQ ID NO: 17317 - DNA, 99 bp, Piromyces finnis
  CBM_10
agatttaggttataaatgttgtaaagaaccttgtgatgttatttacactgatgttgatggtgactggggagctgaaaataacgaatggtgtggctgtgg

SEQ ID NO: 17318 - DNA, 111 bp, Piromyces finnis
  CBM_10
atgctggtccgaagaattcggttacaagtgttgtaagaagtcttgtactgttttcgaaattgataatgatggtaaatggggttacgaagatggtaattggtgtggtattcc

SEQ ID NO: 17319 - DNA, 117 bp, Piromyces finnis
  CBM_10
tattgctgaaaccattggatacagatgttgtagttcaaagaataagactgtatactacacagatagttatggtgactggggttatgacttcaagttaaacgactggtgtggtattac

SEQ ID NO: 17320 - DNA, 100 bp, Piromyces finnis
  CBM_10
atgtacatttgaatctattggatataactgttgtacaacaacatgcaatgtaatttatactgatgaaaatggagattggggtattgaaaataatgaatgg

SEQ ID NO: 17321 - DNA, 103 bp, Piromyces finnis
  CBM_10
atgttggtctaagaaatacggttataactgttgtaagagatgtttcatatatgatgttactgacgaaggtaaatggggttatgaaaataatgaatggtgtggt

SEQ ID NO: 17322 - DNA, 111 bp, Piromyces finnis
  CBM_10
ttggtctcataagtatggttatccatgctgtagtgaaggtacatgtcatatttttacttcagatgaaaatggtgattggggttatgaaaatggtcgttggtgtggtatttt

SEQ ID NO: 17323 - DNA, 108 bp, Piromyces finnis
  CBM_10
cttttcgagaaatcttggatttaattgttgtgaaaatgaaagcacttctgtattttttgttgatgataatggttcttggggtgttgaaaatgatgaatggtgtggtct

SEQ ID NO: 17324 - DNA, 94 bp, Piromyces finnis
  CBM_10
ctggtcagaagtttatgattattcatgttgtaaaaaaacaacccaagtcatgtatattgactccaaaggtacttggggtattgaaaatggagaa

SEQ ID NO: 17325 - DNA, 102 bp, Piromyces finnis
  CBM_10
ttggtcagaacctctcggttatccatgttgtagtattgaagctaaaccatcagatgaagctagtatttggggttgggaaaatgaagaatggtgtggtatgac

SEQ ID NO: 17326 - DNA, 108 bp, Piromyces finnis
  CBM_10
atgttttgctgaaaaattgggtaaaccatgttgtacggaaactttagatgttgtacgtgttgatgaaaatggccaatggggtatggaaaatggacaattctgtggttt

SEQ ID NO: 17327 - DNA, 51 bp, Piromyces finnis
  CBM_10
agatgaatctggtaaatggggaattgaaaataaccagtggtgtggtattaa

SEQ ID NO: 17328 - DNA, 108 bp, Piromyces finnis
  CBM_10
ttggtctgaagagttaggttacgcgtgttgtaagaagacttgtactatctttgaaatcgatgaaaatggtgaatggggtttcgaagatgataaatggtgtggtattcc

SEQ ID NO: 17329 - DNA, 108 bp, Piromyces finnis
  CBM_10
atgcttttctgaaaatttaggatattcttgttgtgaagaatgtaatgtggtttataccgataatgatggtaagtggggatatgaaaataatgaatggtgtggtataat

SEQ ID NO: 17330 - DNA, 64 bp, Piromyces finnis
  CBM_10
atgcttttctgaggttttaggatatccttgttgtaatgaatgctctattatttattctgatgct

SEQ ID NO: 17331 - DNA, 108 bp, Piromyces finnis; identical to SEQ ID NO: 16766
  CBM_10

SEQ ID NO: 17332 - DNA, 108 bp, Piromyces finnis; identical to SEQ ID NO: 17329
  CBM_10

SEQ ID NO: 17333 - DNA, 108 bp, Piromyces finnis
  CBM_10
atgctggtcagaagtttatggatattcatgttgtagagaaactactacagtcattacttctgattcaaaaggtaattggggtgctgaaaatggtgaatggtgtggtct

SEQ ID NO: 17334 - DNA, 102 bp, Piromyces finnis; identical to SEQ ID NO: 17325
  CBM_10

SEQ ID NO: 17335 - DNA, 105 bp, Piromyces finnis
  CBM_10
ctggtcagaagtttatgattattcatgttgtaaaaaaacaacccaagtcatgtatattgactccaaaggtacttggggtattgaaaatggagaatggtgtggtct

SEQ ID NO: 17336 - DNA, 108 bp, Piromyces finnis; identical to SEQ ID NO: 17323
  CBM_10

SEQ ID NO: 17337 - DNA, 108 bp, Piromyces finnis; identical to SEQ ID NO: 16854
  CBM_10

SEQ ID NO: 17338 - DNA, 117 bp, Piromyces finnis; identical to SEQ ID NO: 16830
  CBM_10

SEQ ID NO: 17339 - DNA, 111 bp, Piromyces finnis; identical to SEQ ID NO: 17291
  CBM_10

SEQ ID NO: 17340 - DNA, 54 bp, Piromyces finnis
  CBM_10
cactgaggacgatggtaattggggtcttgaaaacgatcaatggtgtggtattga

SEQ ID NO: 17341 - DNA, 81 bp, Piromyces finnis; identical to SEQ ID NO: 17289
  CBM_10

SEQ ID NO: 17342 - DNA, 111 bp, Piromyces finnis
  CBM_10
ctgctggtcttctagtttaggtttcccatgctgttccggtaaggtcgttgttgaatacactgatgctagtggtcgttggggtatccaaaacaacaactggtgtggtattgt

SEQ ID NO: 17343 - DNA, 117 bp, Piromyces finnis
  CBM_10
ctgctgggctaaggctcttggttacaattgttgttctaccaacacttgtagaaatgctgtttacaacgacactgatggtcaatgggatattgaaaacaaccaatggtgtggtatttc

SEQ ID NO: 17344 - DNA, 85 bp, Piromyces finnis; identical to SEQ ID NO: 16881
  CBM_10

SEQ ID NO: 17345 - DNA, 105 bp, Piromyces finnis
  CBM_10
ttggtctgttgaatatggttttccatgctgttttggtagtaaggttattgcaactgattataatggtgattggggttatgaaaataatcaatggtgtggtatgcc

SEQ ID NO: 17346 - DNA, 105 bp, Piromyces finnis
  CBM_10
ttgggcttcattattaggttatccatgttgtgaaagtaatatagtttatgaagttgatgaatatggtacatggggttatgaatttggtcattggtgtggtattaa

SEQ ID NO: 17347 - DNA, 108 bp, Piromyces finnis
  CBM_10
ttgggcattagcctatggttacccatgttgtaaagaaactactactgtattaagtactgatgaatctggtacttggggttatgaaaacaatacctggtgtggtattga

SEQ ID NO: 17348 - DNA, 79 bp, Piromyces finnis
  CBM_10
ttgctgggcttctagtttaggttatccatgttgtaagtctactaaggttgtcattgatactgatgctagtggtcgttgg

SEQ ID NO: 17349 - DNA, 66 bp, Piromyces finnis
  CBM_10
atgctggtctttaccagattacccatgttgttctacttgtgatgttgtttacactgatgatcataa

SEQ ID NO: 17350 - DNA, 105 bp, Piromyces finnis; identical to SEQ ID NO: 16934
  CBM_10

SEQ ID NO: 17351 - DNA, 91 bp, Piromyces finnis; identical to SEQ ID NO: 16906
  CBM_10

SEQ ID NO: 17352 - DNA, 91 bp, Piromyces finnis
  CBM_10
atgctggtctgaagaaatgggttactcatgttgttctcactgtattgttcttcttaaggatgaatccggcttatggggtgctgaaaatggt

SEQ ID NO: 17353 - DNA, 93 bp, Piromyces finnis; identical to SEQ ID NO: 17055
  CBM_10

SEQ ID NO: 17354 - DNA, 112 bp, Piromyces finnis
  CBM_10
atgttggtcagaagttttgggctattcttgttgtaaagataagaaaacaaaggtttcctatgttgatgcatcaggtgaatggggtgctgaacatggtcaatggtgtggtatt

SEQ ID NO: 17355 - DNA, 105 bp, Piromyces finnis; identical to SEQ ID NO: 17346
  CBM_10

SEQ ID NO: 17356 - DNA, 108 bp, Piromyces finnis; identical to SEQ ID NO: 17347
  CBM_10

SEQ ID NO: 17357 - DNA, 93 bp, Piromyces finnis
  CBM_10
taatttcccttgttgttctgataatactgaaatcatatatactgatgaagaaggtaattggggacttgaaaatgatgagtggtgttttataaa

SEQ ID NO: 17358 - DNA, 117 bp, Piromyces finnis
  CBM_10
atgctattttgaaactttaggttattcatgttgtccttctgaaattacagaagtagcttatactgatgaagatggtaataaatggggtattattaataatgaatggtgtggtattgt

SEQ ID NO: 17359 - DNA, 117 bp, Piromyces finnis; identical to SEQ ID NO: 17358
  CBM_10

SEQ ID NO: 17360 - DNA, 93 bp, Piromyces finnis; identical to SEQ ID NO: 17357
  CBM_10

SEQ ID NO: 17361 - DNA, 105 bp, Piromyces finnis
  CBM_10
ttggtcaagaagttatggtttcccatgttgtaatggttgtaaagtttattatattgataaatccggagaatggggtattgagaatggtaattggtgtggtattgt

SEQ ID NO: 17362 - DNA, 105 bp, Piromyces finnis; identical to SEQ ID NO: 17093
  CBM_10

SEQ ID NO: 17363 - DNA, 72 bp, Piromyces finnis
  CBM_10
ttatccatgttgtaatgaatgtgaagttatttacactgataacgatggtgactggggtgttgaaaataactt

SEQ ID NO: 17364 - DNA, 108 bp, Piromyces finnis; identical to SEQ ID NO: 16947
  CBM_10

SEQ ID NO: 17365 - DNA, 39 bp, Piromyces finnis
  CBM_10
aaagtggggtgttgaaaacagtgattggtgtggtattgt

SEQ ID NO: 17366 - DNA, 117 bp, Piromyces finnis
  CBM_10
atgttggtctgaactcataggttatccatgttgtgatccaaagaataatgttgtctattcacatgatagctatggtgaatggggatataattttaaaacacaaatgtggtgtggact

SEQ ID NO: 17367 - DNA, 102 bp, Piromyces finnis; identical to SEQ ID NO: 16780
  CBM_10

SEQ ID NO: 17368 - DNA, 225 bp, Piromyces finnis
  CBM_2
agcagaaggtaaaattgtaaatgctagtaaattaaagcttaataattggtatattgaagtaccatttgacccagaccaccaaaaattccaaggcagttggggttgtgaagttgaagaaaaagaagataaattagttcttactggtgaagttaccaataaaacacttaaagttttaactgaaacaactttcggatttattattgctagtactggtgttaagtttga

SEQ ID NO: 17369 - DNA, 216 bp, Piromyces finnis
  CBM_2
tactggctctggtatgcgttgctcaggttggtgtgtatcattcacatcttcatcatacaaaattacacaaactagtgatggtaatattgtaaattctggtccagaatatactatttgtaacaagcgtgaaaataatgctcttgatggtaagggtactgctcatattgttactttccaagcttctggttcttctcttccaactgaatttactgtttt

SEQ ID NO: 17370 - DNA, 216 bp, Piromyces finnis; identical to SEQ ID NO: 17369
  CBM_2

SEQ ID NO: 17371 - DNA, 216 bp, Piromyces finnis; identical to SEQ ID NO: 17369
  CBM_2

SEQ ID NO: 17372 - DNA, 399 bp, Neocallimastix californiae
  CBM_4_9
ttacttattccataacacatttgaaagaggtatagatggttggagtagtagaggttctgctcaagtttcttttaacaaaaatactgcctatgatggtaatggttctatttactgttctgaaagaggagctaattggagtggtgcttcccgtaatctttcaccaaatgttttcaaaccaggaaatgcttacagtttcagtgttgttgttaaatatgaggaaggaccagcttctcaaatattctatcttacccttcaatatgatgatggttctggtgaaactcaatatgaaaaggtttctattgttgaagttgcaaagggtcagtggactcaactttacaatactaactataagattcctgatagagcatgtaacatgttattctatgtggaaacagaaaa

SEQ ID NO: 17373 - DNA, 399 bp, Neocallimastix californiae
  CBM_4_9
ttattatttccataatacttttgaagaagatgaagatacttggactggtagacatactgcttctattcaagttagtcaaaaagctgcttatgctggtaaaagttcactttattgttataagagagaatataattggactggtgctcaacgtactctttctcctaaaatgtttaaaccaggagaaacttatagtttcagtgttgttgtaagatatgatgaaggaccagcaagtcaaaacttttaccttactcttcaatatgaaaatggtactgatgaagttcaatatgataagatttctattgaatccgttaaaaagggagaatggactcaacttgctaatgctaattataagattccagctaatgcttatgatatgtatttctatgttgaaactgaaga

SEQ ID NO: 17374 - DNA, 399 bp, Anaeromyces robustus; identical to SEQ ID NO: 17373
  CBM_4_9

SEQ ID NO: 17375 - DNA, 393 bp, Anaeromyces robustus
  CBM_4_9
ttatttccataatacttttgaaaatggtacagatcgttgggaaaatagaggttatgcaagtgtttctcaatcaaaagatgatgcttataaaggtagtggatctctttattgtgataatagagaatataattggagtggtgcttctcgttctctttcctctaatgtctttgaagctggtaaagaatatagttttagtgttattgtaaaatataatgaaggaccagattcacaaaaattctatcttactcttcaatatgataatggaactgatgaaattcaatatgataaaattgctaccgttaatgtttccaaagatcaatgggttcaattagctaatactaattataaaattccagctaatgcatccgatcttattttctatgttgaaactga

SEQ ID NO: 17376 - DNA, 396 bp, Piromyces finnis
  CBM_4_9
ttatttccataatacttttgaaaatggtgctgaacgttgggaaaatagaggttatgctagtgtagctcaatcaaaggatactgcttataagggtaatggatctctttactgtgaaaagagagaatataattggagtggtgcttcccgttctctttcttctaacgtttttgaaccaggtaaagaatttagtttcagtgctgttgttaagtatgatgaaggaccagaatctcaaacctttttcctttcacttcaatataatgatgattcgggtgaaactcaatacgataaaattgctattgttaaggttactcaaggtgaatgggtacaattagcaaatacaaactataaaattccagccaattcttccaacttaatgttttacattgaaactgaaga

SEQ ID NO: 17377 - DNA, 330 bp, Neocallimastix californiae
  CBM_6
aatgatggcatggcaaggtggtgtttctacaaatggtttaggtcatactactgttacctacaacagaggtgaatggactggtgtttctaatgttgattttggagaagctgctacctccgttaagataacagccgcttctaacaatggtgctgttattagaattactactggaagtccaaatggtgatgttgttggttatgtttctattccagctactggtggtaactccaactttaagactgttactgctgatattaacactgttagtggaactaagcacgttttctttgttgcttctggtgatgttgttgtcgatacctggcaattcat

SEQ ID NO: 17378 - DNA, 327 bp, Neocallimastix californiae
  CBM_6
ttctagttttgcttggcaatatggtattactattaagggtcaagataatgttcttcctgtcaattatgttaaaggagcatggacaggtatttccaatgtcgatttaggtaatgctaaatctattactcttaaagcttatgctccaaatggtgctactattaaggtttgtgttggaagtgaaaatggaactgttcttggttatgttgatattccaaagggtaacagtttacaaaatgttacaggaaatcttgataatgcttcaggaacaaagaatcttttcttagtttcttctggtgatgctaccattgagtcatggcaacttactgg

SEQ ID NO: 17379 - DNA, 321 bp, Neocallimastix californiae
  CBM_6
cgctagtttcgcttggcaaagtggtattagtgttaagggacaaggtgctgttactcaagttaattatggacgtggtgcctggactggtgtttctaatgttgctttaggtaatgccaagtctattactcttaaggcctcttcctctagtggtgctactgttaagatttgtgccggtagtgaaaatggtacagttcttggttatgttgatattccagctggtggttccttacaaaatgttactggaaatctttctggtgcttctggtaccaagagtcttttcttcattgcttctggtaatcttactattgaatcatggcaatt

SEQ ID NO: 17380 - DNA, 327 bp, Neocallimastix californiae
  CBM_6
ggcttgggaaggtggtgtctctattaacggtttaggtcacactactgttacttataataagggtgactggactggtgtttcaaatgttgatttcggtaatggcgcttacggtattaaggtctcagctgcctctagaaatggtgctgttattaagattgctgctggtagtgaaactggtaatgctcttggttacattaacattccagccactggtggtacaaactctttcaaaaccgttactgcttctcttagcaagattactggtgttaagaacattttcttcattgcatccggtgatgttgttcttgatacatggcaattcactga

SEQ ID NO: 17381 - DNA, 315 bp, Neocallimastix californiae
  CBM_6
ggcatggcaaagtggtatttctgtcgaaggtcatggtgctgttactcaagttaaatacggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaag

SEQ ID NO: 17382 - DNA, 327 bp, Anaeromyces robustus; identical to SEQ ID NO: 17380
  CBM_6

SEQ ID NO: 17383 - DNA, 324 bp, Anaeromyces robustus
  CBM_6
tgcttctatggcatggcaaagtggtatttctgtcgaaggtcatggtgctgttactcaagttaaatacggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaag

SEQ ID NO: 17384 - DNA, 327 bp, Anaeromyces robustus
  CBM_6
ttctagttttgcttggcaaagtggtattaagattaaaggtcaaggtgaagttactactgttgaatatccaagtggtggttggacaggtatttctcaagttgctttaggagatgccaaatctattactattaaagcatcttctcaatcaggagctactattaagatttgtactggtaatgaaaatggtaatgttcttggttatgttgaaattccatcaggtggtaatttaaaagaagttactggtgatcttactaatgctacaggtactcaagatcttttcttagttgcatctaataatgtttctattgaatcttggaaattaaatgg

SEQ ID NO: 17385 - DNA, 321 bp, Anaeromyces robustus
  CBM_6
tgctaatatggcttggcaaaacggtattagtgttaagggtcaaggtgctgtacttccagttagttacactcgtggtgcttggactggtgtttctaatgttgctttaggtggtgctagttctattactcttaaagcatcttctcaatcaggtgctactattaagatttgtactgaaagtgaaaatggtcaagctattggttatgttgatattccagctggtggatccttacaaaatgttagtggtactctttcaggtgctactggtactaaaaatcttttcttcgtttcctctggtgatgctaccattgaatcatggcaatt

SEQ ID NO: 17386 - DNA, 321 bp, Anaeromyces robustus
  CBM_6
tgctaatatggcttggcaatatggtattagtgtcaatggtcaaggtgctgtagttccagttaattataaccgtggtgcttggactggtgtttctaatgttgctttaggtggtgctacttctattactcttaaggcttcttcaaagtctggtgctactattaagatttgtactgaaagtgaaaatggtcaagctcttggttacgttgatattccagctggtggatccttacaaaatgttagtggtactctttcaggagctactggtactaaaaatcttttcttcgtttcctctggtgatgctaccattgaatcatggcaatt

SEQ ID NO: 17387 - DNA, 315 bp, Piromyces finnis
  CBM_6
ttggcaagctggtgtttccgtttatggtttaggtcacaccactgttacctacagaaagggtacctggactggtgtttctggtgttgaatttggtgacaatgccacttccgttaagatttcagctgcctctgccaatggtgctactattagaatcacctctggaagtgaaaacggtgaagttattggttacgttaccgttccagctactggtgatgaattcgtcactgttactgctgatgttagtgtttctggtgttaaggacatcttctttgttgcctctgacgaagttgttgtcgatacctggcaatttgttgc

SEQ ID NO: 17388 - DNA, 324 bp, Piromyces finnis
  CBM_6
tgcttcatttgcttggcaaagtggtatcaagattaagggacaaggtgcagttactaccgttgaaattccacgtggtggatggactggtgtatctcacgttgctcttggtaatgctaaatctattactattaaggctagctcctcttctggtgccaccattaaggtttgtactggtaatgaaaagggtgatgtcctcggttatgttgaaattccagcaggtggttctttacaagaagttactgctgaaatttctaatgcttcaggtactaaggatctcttctttgttgcttctaattctgtttctatggaatcatggcaattaaa

SEQ ID NO: 17389 - DNA, 315 bp, Piromyces finnis; identical to SEQ ID NO: 17387
  CBM_6

SEQ ID NO: 17390 - DNA, 324 bp, Piromyces finnis; identical to SEQ ID NO: 17388
  CBM_6

SEQ ID NO: 17391 - DNA, 318 bp, Piromyces finnis
  CBM_6
ttggcaagctggtgtttcagttaatggtttaggacacaccactgtttcttacaacagaggtgattggactggtgtttctaacgttgactttggagacagtgccacttccgtaaagatatccgccgcttccagcaatggagccaccattagaattacttcaggcagtgaaaatggtgatgttattggatacgttactattccagctacaggtggtgataagaacttcaagaccgttacagctaatgttaaggcttctggtactaagaacatcttctttgttgcctctggtgatgttactattgatacctggcaattcat

SEQ ID NO: 17392 - DNA, 324 bp, Piromyces finnis; identical to SEQ ID NO: 17388
  CBM_6

SEQ ID NO: 17393 - DNA, 318 bp, Piromyces finnis; identical to SEQ ID NO: 17391
  CBM_6

SEQ ID NO: 17394 - DNA, 318 bp, Piromyces finnis; identical to SEQ ID NO: 17391
  CBM_6

SEQ ID NO: 17395 - DNA, 324 bp, Piromyces finnis; identical to SEQ ID NO: 17388
  CBM_6

SEQ ID NO: 17396 - DNA, 318 bp, Piromyces finnis; identical to SEQ ID NO: 17391
  CBM_6

SEQ ID NO: 17397 - DNA, 315 bp, Piromyces finnis; identical to SEQ ID NO: 17387
  CBM_6

SEQ ID NO: 17398 - DNA, 315 bp, Piromyces finnis; identical to SEQ ID NO: 17387
  CBM_6

SEQ ID NO: 17399 - DNA, 519 bp, Neocallimastix californiae
  CBM-like
ttgggaaatcggtattccagatcgtactgctatggaatataagcatggggatcatttcaatcaatggggtcttccatataaatttccacaagaattcccaaatggagtcaattactacattggaaaatcaaactatgctaaagattggaattattgtcatgtttctgttccaggaaatgggggaacatataaatccgttccatggaatatttactttaatttaaataaaaaaccaacaggtactgcagttttacgtgtttctgttgctgctaatacttccactgctctttcagtttcaattaatggtggtaaaaattcagctgaagtttcaaactttaaagatgatgcttgtgttcgtcgtgatggtattcgtggattctatcgtgaattagaattcaaatttagtccaaatgacttcaagattggagaaaataagattactttgaatgccagaaagactggtggttacactaatagttatcaatttgatggtattatgtatgatcatattcgtcttga

SEQ ID NO: 17400 - DNA, 531 bp, Anaeromyces robustus
  CBM-like
aactatttttgaagttggtgtacctgatcgtactgctgaagaatatttacatggtgatcatttcaatcaatggggtctttacaataagtttgcagaagaattccctaacagtgttaacttctatattggtaaatctgactggcaatttgattggaattattgtcaagtttccattccaggaggtgctaatggtaattacaaagcttgtgaaccatggaaaattcactttaatattaataaagttccatctggaaacattcttcttagagtttcaattgctgcctcatcttcaactgcattatctgtttctgttaatggaagaaatcaatcttctgaagttaaagatcttattgatgatgcttgtattcgtcgtgatggtattcgtggtatttggagtatgaaagaatttactttcccagctagtctattaaaacaaggtgaaaactatgtttcccttcatactcgtgccattggtggttatttaacttattatagatttgatggtattatgtatgatcacattagattaga

SEQ ID NO: 17401 - DNA, 531 bp, Piromyces finnis
  CBM-like
aactgtctttgaagttggtattcctgatcgtactgctgaagaatatttacatggggatcactttaatcaatggggtctttacaatcaattccaagatgaattcccaaatagcgtaaacttccgtattggtgaatctgattggcaatttgattggaactattgtcaagtttcaattccaggtggtgctgatggaaagtacaaagctgctgaaccatggaaaatttatttcaatcttgacaaagtcccatcaggtaacatcctcgttagagtttctgttgctgcttcatcctcaactgctttatcagtttctgttaatggtaagaatcaaagtgctgaggttaaggatcttgttgatgatgcttgtattcgtcgtgatggtattcgtggtatttggagtatgaaggaatttacattctcatctagtttattaaaacaaggtgaaaattacatttctcttcacgctcgtgctattggtggttatttaacctattacagatttgacggtattatgtacgatcatgttagattaga

SEQ ID NO: 17402 - DNA, 519 bp, Piromyces finnis
  CBM-like
ttgggaaattggtataccagatcgtactgcaatggaatataaacatggtaatcattttaaccaatggggtctttaccataaatttaagactgaattcccaaacagtgttaactattatgttggtaaatctaattatgctactgattggaattactgtcacgtttcaattcaaggtgcagatggtaaatatatgcaatctccatggaatatttacttcaacttaaataaaataccaacaggaacatctgttttacgtatttccattgctgcttcttcatattctgctctttctgttgccttaaacgatggtaaagcaactgctgaagttaaagatttagttgatgatgcttgtattcgtcgtgatggtattcgtggtatttggagtatgaaggaatttacattctcatctagtttattaaaacaaggtgaaaattacatttctcttcacgctcgtgctattggtggttatttaacctattacagatttgacggtattatgtacgatcatgttagattaga

SEQ ID NO: 17403 - DNA, 84 bp, Neocallimastix californiae
  CBM1_1
tggtggtcaaaattataatggaccaacttgttgtgaagcaggtactacttgtgtaaaattaagtgattactactaccaatgtca

SEQ ID NO: 17404 - DNA, 81 bp, Neocallimastix californiae
  CBM1_1
tggtggtgaaggttacttcggtccaactaaatgctgtaagggaaaatgtatttctcaaggaccatactattcacaatgtgc

SEQ ID NO: 17405 - DNA, 81 bp, Neocallimastix californiae
  CBM1_1
tggtggtgatggttacttcggtccaactgaatgttgtaagggaaaatgtatttctcaaggaccatactattctcaatgtgc

SEQ ID NO: 17406 - DNA, 84 bp, Neocallimastix californiae
  CBM1_1
tggtggtgaaggatggaatggtccaacctgttgtaattcaggtagtgtttgtgttgtaacaaatcaatactatcatcaatgtaa

SEQ ID NO: 17407 - DNA, 84 bp, Neocallimastix californiae
  CBM1_1
tggtggtatgaattgggctggaccgaattgctgtgttgaaggaacatattgtacctttgttaatccatattattcacaatgttt

SEQ ID NO: 17408 - DNA, 84 bp, Neocallimastix californiae
  CBM1_1
tggtggacaaggatatacaggaccaacttgttgtaaatcaggatcaacttgtcatgaaattaataaatattattctcaatgtat

SEQ ID NO: 17409 - DNA, 84 bp, Neocallimastix californiae
  CBM1_1
tggtggtgtcaattatcatggttcaacaaagtgttgtggtaatttaacatgtgtatatcgtggtgaatattattctcaatgtga

SEQ ID NO: 17410 - DNA, 84 bp, Neocallimastix californiae
  CBM1_1
tggtggtataaattataatggtccaacatgttgtccaagcggttacacttgtaaatttattagtgattattattatcaatgtac

SEQ ID NO: 17411 - DNA, 81 bp, Neocallimastix californiae
  CBM1_1
tggtggtatcggttttaacggtccaacctgttgttcctctggaaaatgtgttaaactcaatgattggtattctcaatgtca

SEQ ID NO: 17412 - DNA, 84 bp, Neocallimastix californiae
  CBM1_1
tggtggtgtaaatcaccggggtccattctgttgtgaatcaggtttaacttgtgtatttgtgaatgattattattctcaatgctt

SEQ ID NO: 17413 - DNA, 81 bp, Anaeromyces robustus
  CBM1_1
tggtggtgaaggttacttcggtccaactgaatgttgtaagggaaaatgtactagccaaggaccatactattctcaatgtgc

SEQ ID NO: 17414 - DNA, 84 bp, Anaeromyces robustus
  CBM1_1
tggtggtgctacttattatggtccaacttgctgtgaaagcaatagtagatgtatcgtacataatgaatattattcacaatgtga

SEQ ID NO: 17415 - DNA, 84 bp, Anaeromyces robustus
  CBM1_1
tggtggtaaagaatatactggaccaacatgttgtaatgaaaattatcattgtatttatgttaatgagtattactctcaatgtaa

SEQ ID NO: 17416 - DNA, 84 bp, Anaeromyces robustus
  CBM1_1
tggtggtattaattatacaggtccaacatgttgtccatctggatattcatgtaaaaaacataatgattattattcacaatgtga

SEQ ID NO: 17417 - DNA, 84 bp, Anaeromyces robustus
  CBM1_1
tggtggtgttggatacaacggtccaacatgttgtaaaggtgattactattgtaaatcatatagtgattactactcacaatgtgt

SEQ ID NO: 17418 - DNA, 84 bp, Anaeromyces robustus
  CBM1_1
tggtggtttttacttttccggtccaaattgctgtgaagagggtagtagatgtatttatcaaaatgattattattctcaatgttt

SEQ ID NO: 17419 - DNA, 84 bp, Piromyces finnis
  CBM1_1
tggtggtattggctacagtggtccaacacaatgtgaatcaggtagtgaatgtgttgctaccaatgaattttattcccaatgtct

SEQ ID NO: 17420 - DNA, 81 bp, Piromyces finnis
  CBM1_1
tggtggtgatggctactttggtccaactgaatgttgtaagggaaaatgtatttctcaaggaccatactattcccaatgtgc

SEQ ID NO: 17421 - DNA, 109 bp, Neocallimastix californiae
  CBM1_2
ctgtgcttcaatatggcaacaatgtggtggtcaaaattataatggaccaacttgttgtgaagcaggtactacttgtgtaaaattaagtgattactactaccaatgtcaa

SEQ ID NO: 17422 - DNA, 108 bp, Neocallimastix californiae
  CBM1_2
ttgtgttgctttatatgatcaatgtggtggtgaaggttacttcggtccaactaaatgctgtaagggaaaatgtatttctcaaggaccatactattcacaatgtgccga

SEQ ID NO: 17423 - DNA, 111 bp, Neocallimastix californiae
  CBM1_2
agatcttaaagcttatgctcaatgtggtggtttaggttatgaaggatcaacttgttgtcaagctggtaccatttgtactgttgttaatgaacactattctcactgtgaacc

SEQ ID NO: 17424 - DNA, 108 bp, Neocallimastix californiae
  CBM1_2
ttgtgttgctttatacgatcaatgtggtggtgatggttacttcggtccaactgaatgttgtaagggaaaatgtatttctcaaggaccatactattctcaatgtgctga

SEQ ID NO: 17425 - DNA, 111 bp, Neocallimastix californiae
  CBM1_2
tgatattaaagcttatggtaaatgtggaggtaatgattggactggttcaacttgttgtatggttggtactagttgtcaaaaaattaatgaatgggtttcattatgtcaacc

SEQ ID NO: 17426 - DNA, 114 bp, Neocallimastix californiae
  CBM1_2
ttgtgctgtagatttcgatcaatgtggtggtgttggttacaatggtccaactaattgttgtaatccagattataaatgtaaggaatacggtacttactatttccaatgtgtacc

SEQ ID NO: 17427 - DNA, 111 bp, Neocallimastix californiae
  CBM1_2
agatcttaaagcttacgctcaatgtggtggtattggttatgaaggtccaaattgttgtcaagccggtactgtttgtacagaaattaatgagcattattcacattgtgaacc

SEQ ID NO: 17428 - DNA, 114 bp, Neocallimastix californiae
  CBM1_2
atgtgctggtccatttgaaccatgtggtggacttagatataagggtgctccaacttgctgtcaaactggatattattgttcaagaagaaataataattattatcaatgtgttcc

SEQ ID NO: 17429 - DNA, 114 bp, Neocallimastix californiae
  CBM1_2
atgtgctaagggttacatgccatgtggtggtagtaaattcccagatgctccaacatgttgtgaaaagtattactattgtgaaactgctgatccatcctatcatcagtgttatcc

SEQ ID NO: 17430 - DNA, 114 bp, Neocallimastix californiae
  CBM1_2
ttgtgcaaaggcttatgaaatgtgtggaggtacattgttcccaaatcaaccaacttgttgtgaacctggtaatacttgtgttattatgaatccaagatatcatgaatgtattcc

SEQ ID NO: 17431 - DNA, 111 bp, Neocallimastix californiae
  CBM1_2
atgtgcaaatgtatggggtcaatgtggtggtgaaggatggaatggtccaacctgttgtaattcaggtagtgtttgtgttgtaacaaatcaatactatcatcaatgtaaacc

SEQ ID NO: 17432 - DNA, 114 bp, Neocallimastix californiae
  CBM1_2
ttgtgctaataattgggcacaatgtggaggtattgatttcaatggtcctacaacttgttgtgatccttccgctgtatgcaaatatttaaatgattattattatcaatgtgtttt

SEQ ID NO: 17433 - DNA, 109 bp, Neocallimastix californiae
  CBM1_2
atgctcaaataaatgggatcaatgtggtggtatgaattgggctggaccgaattgctgtgttgaaggaacatattgtacctttgttaatccatattattcacaatgttta

SEQ ID NO: 17434 - DNA, 109 bp, Neocallimastix californiae
  CBM1_2
atgtgccgaaaaatggactcaatgtggtggacaaggatatacaggaccaacttgttgtaaatcaggatcaacttgtcatgaaattaataaatattattctcaatgtatt

SEQ ID NO: 17435 - DNA, 114 bp, Neocallimastix californiae
  CBM1_2
atgtgctgaagcttatcgtccatgtggtggttcttatttccaagatggtccaaattgttgtgaaccaggttttatttgtgttgatgcaaatcctcttttcaaacaatgtcttcc

SEQ ID NO: 17436 - DNA, 114 bp, Neocallimastix californiae
  CBM1_2
atgtgctaaagcttatcaaccatgtggtggtaatgattatccaaatgctccaacttgttgtgaagctggatttgcttgtttaatgaagaatccaaattaccatcaatgtattcc

SEQ ID NO: 17437 - DNA, 114 bp, Neocallimastix californiae
  CBM1_2
atgtgctaaagcttatcaaccatgtggaggtaatgattatccaaatgctccaaattgttgtgaagctggatttgcttgcttaatgaaaaatccaaattaccatcaatgtattcc

SEQ ID NO: 17438 - DNA, 111 bp, Neocallimastix californiae
  CBM1_2
ctgtggtactgatgaaattccatgtggtggtttattatatccaaatgccccaggttgttgtgaaggttatgtttgttattcaatgaatgcttactataaagaatgtgtacc

SEQ ID NO: 17439 - DNA, 108 bp, Neocallimastix californiae
  CBM1_2
atgtgctaaagcctatgaaatgtgtggtggatctttcaatccagtaagatgctgtgaaaaaggtaccgtttgtaccgttttcagtgaatatcatcatgaatgtattcc

SEQ ID NO: 17440 - DNA, 114 bp, Neocallimastix californiae
  CBM1_2
atgtgcaaaggctaaccaaccttgtggtggttcatattatccaaatgcaccaacttgttgtgaaccaggatatgaatgtactttcagaagtccattcttttctctttgtctttt

SEQ ID NO: 17441 - DNA, 114 bp, Neocallimastix californiae
  CBM1_2
ctacacaccaggctataatccatgtggaggtactaacttcccagatgcttcgccatgttgtgaacaaggtttcaagtgtgaattccataatgagaaattagctatttgtgttcc

SEQ ID NO: 17442 - DNA, 114 bp, Neocallimastix californiae
  CBM1_2
tattacaaaaggttatcatccatgtggcggtttgtactaccctgatgcttcgccatgctgtgaagaaggttttagatgtgaaagtaataatcaatatacttttgtctgcgttcc

SEQ ID NO: 17443 - DNA, 114 bp, Neocallimastix californiae
  CBM1_2
acttacaccaggcttttatccatgtggtggttcattattcccagatgcttctccatgttgtgaagaaggatttacttgccgatacaacaatgagtatgtttctgtttgtgttcc

SEQ ID NO: 17444 - DNA, 114 bp, Neocallimastix californiae
  CBM1_2
tgtcaccaagggatattatccttgtggtggtttaagatatccagatgaatcaccatgctgtgaagaaggtttcagatgtcaataccaaaatccattctacttccaatgtgtatt

SEQ ID NO: 17445 - DNA, 111 bp, Neocallimastix californiae
  CBM1_2
ctgtgttgctcgctatgcccaatgtggtggtgtcaattatcatggttcaacaaagtgttgtggtaatttaacatgtgtatatcgtggtgaatattattctcaatgtgatca

SEQ ID NO: 17446 - DNA, 111 bp, Neocallimastix californiae
  CBM1_2
ttgttccacaccatatggacaatgtggtggtataaattataatggtccaacatgttgtccaagcggttacacttgtaaatttattagtgattattattatcaatgtactaa

SEQ ID NO: 17447 - DNA, 108 bp, Neocallimastix californiae
  CBM1_2
ttgtgctaaagaatttgatcaatgtgatggtattaattataatggtccaaaatgttgttctgtaggtaaatgcgttagacttaatgattattattatcaatgtcaaaa

SEQ ID NO: 17448 - DNA, 106 bp, Neocallimastix californiae
  CBM1_2
ttgtgcttctcaatgggctcaatgtggtggtatcggttttaacggtccaacctgttgttcctctggaaaatgtgttaaactcaatgattggtattctcaatgtcaa

SEQ ID NO: 17449 - DNA, 109 bp, Neocallimastix californiae
  CBM1_2
atgtgccaaacattgggatcaatgtggtggtgtaaatcaccggggtccattctgttgtgaatcaggtttaacttgtgtatttgtgaatgattattattctcaatgctta

SEQ ID NO: 17450 - DNA, 114 bp, Neocallimastix californiae
  CBM1_2
atgtggaaaagcttttgaaatgtgtggtggtaccttattcccagaggcaccaaattgttgtgaacccggtaatatttgtgtcaaaaaatacgatacctatcatcaatgtcttcc

SEQ ID NO: 17451 - DNA, 117 bp, Neocallimastix californiae
  CBM1_2
atgtgctttgaagtactctccatgtggtggagagaacttccctgaaattaccactaactgttgtgaagagggctcctcctgtttagctcacaatcagtactattatcaatgcattcc

SEQ ID NO: 17452 - DNA, 114 bp, Neocallimastix californiae
  CBM1_2
atgtgctaaagcctatgaaccatgtggtggtcttgaacatccaaatgcaccaacttgttgtgaagcaggatttgcttgcttacaaaagaatccaaattatcatcaatgtattcc

SEQ ID NO: 17453 - DNA, 114 bp, Neocallimastix californiae
  CBM1_2
atgtgcagtagcctatggatgttgtggtggttccgataatccagatgctccaaattgttgtcagagtggttacacctgtgtcaaggatgacccaagattctggcaatgtattcc

SEQ ID NO: 17454 - DNA, 114 bp, Neocallimastix californiae
  CBM1_2
atgtggaaaatcatttgaaatgtgtggtggtaccttattccctaatgttccaaattgttgtgaaccaggtaatacttgtgtgattaaacatgatacttatcaccaatgtattcc

SEQ ID NO: 17455 - DNA, 114 bp, Neocallimastix californiae
  CBM1_2
atgtgctaaggcctatgaaccatgtggtggtcttgaacatccaaatgcaccaacttgttgtgaggcaggatttgcttgcttacaaaagaatccaaattaccatcaatgtattcc

SEQ ID NO: 17456 - DNA, 114 bp, Neocallimastix californiae
  CBM1_2
atgtgccagagtatatgaaatttgtggtggtaaaaactatccaaatgctccaaaatgttgtgaacctggttctaaatgtgttcacttcagtgaagatttctaccaatgtaatcc

SEQ ID NO: 17457 - DNA, 114 bp, Neocallimastix californiae
  CBM1_2
atgttcaggaccatatgaaccatgtggtggaagcagtttcttagattatccaagatgttgtccaccaggatactactgccttcaccgaaatgaaatttatcatcaatgtgttcc

SEQ ID NO: 17458 - DNA, 114 bp, Neocallimastix californiae
  CBM1_2
atgttctggaccgtatgaaccgtgcggtggaagtagtttcttagattatccaaattgttgtccaccaggatattactgcctacaccgaaatgaaatttaccatcaatgtgttcc

SEQ ID NO: 17459 - DNA, 114 bp, Neocallimastix californiae
  CBM1_2
atgttctaaaccatatgaaccatgtggtggtagtggattcttagaatatccaagatgttgtccaccaggatactactgccttcaccgaaatgaaatttatcatcaatgtgttcc

SEQ ID NO: 17460 - DNA, 114 bp, Neocallimastix californiae
  CBM1_2
gtgttctaaaccatatgaaccatgtggtggtagtggattcttagattatccaagatgttgtccaccaggatactattgccttcaccgaaatgaaatttatcatcaatgtgttcc

SEQ ID NO: 17461 - DNA, 111 bp, Neocallimastix californiae
  CBM1_2
atgtggaaaagcatttgaaatgtgtggtggtcaattattccctaaggcaccaaactgttgtgaatctggttatacctgtgtcgatcgtggaacgtatcatcaatgtcttcc

SEQ ID NO: 17462 - DNA, 97 bp, Neocallimastix californiae
  CBM1_2
ttgtgttcctgcttttggacaatgtggcggtaccgactaccgtggttcaaccaagtgttgtgaaaatttaagatgtgtttatttaaatgattactat

SEQ ID NO: 17463 - DNA, 114 bp, Neocallimastix californiae
  CBM1_2
ttgtgctaatgtttatgaatattgtggaggtattaattatccaaaagcaccaaagtgttgtaagccaggttcaaaatgtgttaaatttaatgaatatcatcatcaatgtatgcc

SEQ ID NO: 17464 - DNA, 114 bp, Neocallimastix californiae
  CBM1_2
ttgtgctaaatcgtatgaagcctgtggtggatcaagatatccaaatgtaccgaaatgttgtactccaggtaatgtatgtgtgaagaataataatgtatttcaccaatgtatgcc

SEQ ID NO: 17465 - DNA, 114 bp, Neocallimastix californiae
  CBM1_2
ttgtgctagagaatttaatgtatgtggtggtattagtaatccttatgcaccaaaatgttgtaaatctggttacatttgtgtttcctttaacaaatatttctcaatttgtatgcc

SEQ ID NO: 17466 - DNA, 114 bp, Neocallimastix californiae
  CBM1_2
gtgctctggtccttatgaaccatgtggtggaattagtttcttagattctccatcatgttgtccacagggatattattgtttaaaaagaaatgaaaattaccatcaatgtgttcc

SEQ ID NO: 17467 - DNA, 114 bp, Neocallimastix californiae
  CBM1_2
atgtgctagagcctttgaaatgtgtggtggtaccttattccctaatgctccaaactgttgtgaagaaggcagtacctgtaataagaagtatccatactatcatcaatgtcttcc

SEQ ID NO: 17468 - DNA, 111 bp, Anaeromyces robustus
  CBM1_2
agatcttaaagcttatgcccaatgtggtggtaaagaatacacaggtccaaactgttgtcaagctggtactatttgtactgaaattaatgaacactactctcactgtgaacc

SEQ ID NO: 17469 - DNA, 108 bp, Anaeromyces robustus
  CBM1_2
ttgtgtagctttatatgatcaatgtggtggtgaaggttacttcggtccaactgaatgttgtaagggaaaatgtactagccaaggaccatactattctcaatgtgcaga

SEQ ID NO: 17470 - DNA, 111 bp, Anaeromyces robustus
  CBM1_2
ttgtgctacattatggaatcaatgtgatgaaaatggaattcttggaccatcttgttgtgaaaagggttcaatatgtaaaaaatatagtgactattattctcaatgtgtacc

SEQ ID NO: 17471 - DNA, 111 bp, Anaeromyces robustus
  CBM1_2
ttgtgctaaagtttgggatcaatgtggtggtgctacttattatggtccaacttgctgtgaaagcaatagtagatgtatcgtacataatgaatattattcacaatgtgaacc

SEQ ID NO: 17472 - DNA, 111 bp, Anaeromyces robustus
  CBM1_2
ttgtgctggaaattggaaccaatgtggtggtaaagaatatactggaccaacatgttgtaatgaaaattatcattgtatttatgttaatgagtattactctcaatgtaaaac

SEQ ID NO: 17473 - DNA, 114 bp, Anaeromyces robustus
  CBM1_2
tttaactcctgcttatcaaccatgtggtggtaaacaatatccagatgcttcttcatgttgtgttgaaggttatatatgtagtcgtcatagtagtgatatatctatttgtattcc

SEQ ID NO: 17474 - DNA, 111 bp, Anaeromyces robustus
  CBM1_2
atgtgccaaggtatatgatcaatgtggtggtattggtttccgtggtccaacatgttgtgaaccaggtactacttgtgaatttgttgtagattattattcacaatgtattcc

SEQ ID NO: 17475 - DNA, 114 bp, Anaeromyces robustus
  CBM1_2
tttaactccaggttatcaaccatgtggtggtagaaaatatagagatgcttcaccatgttgtgttgaaggttatgtatgtagttttcatagtaatgatatatctatctgtgttcc

SEQ ID NO: 17476 - DNA, 114 bp, Anaeromyces robustus
  CBM1_2
atgtgctaaatcatatggtatttgtggtggtactgcttatcctgatgctccaacttgttgtgaagaaggtaatttctgttggaaaagatatgataatcttcatcaatgtattcc

SEQ ID NO: 17477 - DNA, 114 bp, Anaeromyces robustus
  CBM1_2
ttgtgctaaagcttatcaaccatgtggtggtcttgaatatccagatgctccaaattgttgtgaagcaggttttgcttgtttaagaaagaatccaaattatcatcaatgcattcc

SEQ ID NO: 17478 - DNA, 114 bp, Anaeromyces robustus
  CBM1_2
atgtgctaaagcttatgatgcttgtggtggttcaaattatccaaattctccaagatgttgtattgaaggattaacttgtgtttatgaatctgaagctgcctcttattgtgttcc

SEQ ID NO: 17479 - DNA, 114 bp, Anaeromyces robustus
  CBM1_2
atgttctaaagcttattatccatgtggtggttcttattatccagatttaccaaattgttgtgaaccaggatttgtttgtgttgaaacaacttctgttattaaacaatgtcttcc

SEQ ID NO: 17480 - DNA, 108 bp, Anaeromyces robustus
  CBM1_2
atgtgctagagcttatgaaatgtgtggtggttatggatatgaaactaaatgttgtgaatctggtactatatgtaaagtatttagtgaatatcatcatcaatgtattcc

SEQ ID NO: 17481 - DNA, 111 bp, Anaeromyces robustus
  CBM1_2
atgtgctggaggatatggtcaatgtggtggtattaattatacaggtccaacatgttgtccatctggatattcatgtaaaaaacataatgattattattcacaatgtgaacc

SEQ ID NO: 17482 - DNA, 114 bp, Anaeromyces robustus
  CBM1_2
ttgtattccagattatgaaaaatgtggtggtataggttataatggaccaacatgttgtgaaaaccctaactttaaatgtgaagtcattaacgaatatttccatcaatgtacacc

SEQ ID NO: 17483 - DNA, 111 bp, Anaeromyces robustus
  CBM1_2
atgtgctgatgtctggcaacaatgtggtggtgttggatacaacggtccaacatgttgtaaaggtgattactattgtaaatcatatagtgattactactcacaatgtgttcc

SEQ ID NO: 17484 - DNA, 123 bp, Anaeromyces robustus
  CBM1_2
atgtattgaagcatggggtcaatgtggtggtaccgttaatggaaagaaatataatggttcaacttgttgtgtaagtggttataaatgtaaagaatacaataccaattatgctcaatgtgtacc

SEQ ID NO: 17485 - DNA, 111 bp, Anaeromyces robustus
  CBM1_2
gtgctctaaggaatttgaaatgtgtggtggttcattatatcctgattcaccagaatgttgtgaaggtacattttgtttaaaaagtaattctaaatatcatcaatgtattcc

SEQ ID NO: 17486 - DNA, 114 bp, Anaeromyces robustus
  CBM1_2
atgtattaaggcttatcaacaatgtggaggtcttaattataaaggtacaattagttgttgtgaagaaggttatttctgtcataaaaatgatgaacattaccatcaatgtattcc

SEQ ID NO: 17487 - DNA, 114 bp, Anaeromyces robustus
  CBM1_2
atgtggtaaagtttatgatatttgtggtggtactaattatcctaatgctccaaaatgttgtgaatctggttctacttgtgtagcctttagtgaaattcatcatcaatgtattcc

SEQ ID NO: 17488 - DNA, 114 bp, Anaeromyces robustus
  CBM1_2
atgtgcaggtgcctttgaaatatgtggtggaactgattatccaaatgctccaaactgttgtatcactggttatatatgtaataaaattcatgtaaattattatctttgtttacc

SEQ ID NO: 17489 - DNA, 114 bp, Anaeromyces robustus
  CBM1_2
atgtgcaggtgcctttgaaatatgtggtggaaaggatcatccagatgctccaaattgttgtatctctggttatgtctgtgataaaactttcaaaagacattatatatgtattcc

SEQ ID NO: 17490 - DNA, 114 bp, Anaeromyces robustus
  CBM1_2
atgtgcaggtgcctttgaaatatgtggtggaaaggatcatccagatgctccaaattgttgtatctctggttatgcttgtgataaaactttcaaaagacattatatatgtattcc

SEQ ID NO: 17491 - DNA, 114 bp, Anaeromyces robustus
  CBM1_2
atgtgctgatgcttatcaatcctgtggtggtttatttaatcctaatgccccaaattgttgtaaagaaggatttacatgtgttaaaaaggatcccaacttttatcaatgtattcc

SEQ ID NO: 17492 - DNA, 114 bp, Anaeromyces robustus
  CBM1_2
atgtgctagtgcttataatgcttgtggtggaaccgattatccagatgctccaaattgttgtgttccaaattatgtttgtataaaaacttcttccaaatatcatcaatgtcttcc

SEQ ID NO: 17493 - DNA, 108 bp, Anaeromyces robustus
  CBM1_2
atgtgtaaaagcttatgaaatgtgtggtggtatgaatactgaaaagaaatgttgtgaacaaggtagtagatgcgtagaatttaatgaattctatcatcaatgtattcc

SEQ ID NO: 17494 - DNA, 114 bp, Anaeromyces robustus
  CBM1_2
atgtgctaaactttatgatatttgtggtggtaaacttttcccagatgcaccaacttgttgtgaacaaggttctaaatgtattatttatgatgaaagtataagtagatgtcttcc

SEQ ID NO: 17495 - DNA, 114 bp, Anaeromyces robustus
  CBM1_2
atgtgctaaaccatatcaaccatgtggtggtcttggttatccagatgctccaaattgttgtgaacaaggttatgtatgtcaacataatgatttatactatcatcaatgtattcc

SEQ ID NO: 17496 - DNA, 111 bp, Anaeromyces robustus
  CBM1_2
atgtagtaaggaatatgaaatgtgtggtggtactttatatccagatgctccaagttgttgtgaaggtaccttctgttggactaaatataaagaatatcatcaatgtatgcc

SEQ ID NO: 17497 - DNA, 100 bp, Anaeromyces robustus
  CBM1_2
atgtgcatcactttttgcacaatgtgatggtgatggttataatggtccaaaatgttgtcaatctggtcaatgtgttaaagttaataattggtattctcaa

SEQ ID NO: 17498 - DNA, 109 bp, Anaeromyces robustus
  CBM1_2
ttgtggaaaaatatatgaacaatgtggtggtttttacttttccggtccaaattgctgtgaagagggtagtagatgtatttatcaaaatgattattattctcaatgttta

SEQ ID NO: 17499 - DNA, 109 bp, Piromyces finnis
  CBM1_2
atatgcaaagaaatggcaacaatgtggtggtattggctacagtggtccaacacaatgtgaatcaggtagtgaatgtgttgctaccaatgaattttattcccaatgtcta

SEQ ID NO: 17500 - DNA, 111 bp, Piromyces finnis
  CBM1_2
agatcttaaagcttatgctcaatgtggtggtcttggttatgaaggttcaacctgttgtcaagctggtactatctgtactgtagttaatgaacattactctcattgtgcacc

SEQ ID NO: 17501 - DNA, 111 bp, Piromyces finnis
  CBM1_2
agatattgaagcctatggtaagtgtggtggtaaggattggactggttctacctgttgtatggttggtactagttgtaaggaagttaacgaatgggtttccttatgtgaacc

SEQ ID NO: 17502 - DNA, 108 bp, Piromyces finnis
  CBM1_2
ttgtgttgctttatatgatcaatgtggtggtgatggctactttggtccaactgaatgttgtaagggaaaatgtatttctcaaggaccatactattcccaatgtgctga

SEQ ID NO: 17503 - DNA, 111 bp, Piromyces finnis; identical to SEQ ID NO: 17501
  CBM1_2

SEQ ID NO: 17504 - DNA, 348 bp, Neocallimastix californiae
  CBM6
tactaactatgcttcaatgatggcatggcaaggtggtgtttctacaaatggtttaggtcatactactgttacctacaacagaggtgaatggactggtgtttctaatgttgattttggagaagctgctacctccgttaagataacagccgcttctaacaatggtgctgttattagaattactactggaagtccaaatggtgatgttgttggttatgtttctattccagctactggtggtaactccaactttaagactgttactgctgatattaacactgttagtggaactaagcacgttttctttgttgcttctggtgatgttgttgtcgatacctggcaattcattgg

SEQ ID NO: 17505 - DNA, 384 bp, Neocallimastix californiae
  CBM6
tacctacgaaggtgtatcacaattgagtgatgtagatggcagtaaggttaataacgcttctagttttgcttggcaatatggtattactattaagggtcaagataatgttcttcctgtcaattatgttaaaggagcatggacaggtatttccaatgtcgatttaggtaatgctaaatctattactcttaaagcttatgctccaaatggtgctactattaaggtttgtgttggaagtgaaaatggaactgttcttggttatgttgatattccaaagggtaacagtttacaaaatgttacaggaaatcttgataatgcttcaggaacaaagaatcttttcttagtttcttctggtgatgctaccattgagtcatggcaacttactgg

SEQ ID NO: 17506 - DNA, 348 bp, Neocallimastix californiae
  CBM6
aacttactatgcctctatgatggcttgggaaggtggtgtctctattaacggtttaggtcacactactgttacttataataagggtgactggactggtgtttcaaatgttgatttcggtaatggcgcttacggtattaaggtctcagctgcctctagaaatggtgctgttattaagattgctgctggtagtgaaactggtaatgctcttggttacattaacattccagccactggtggtacaaactctttcaaaaccgttactgcttctcttagcaagattactggtgttaagaacattttcttcattgcatccggtgatgttgttcttgatacatggcaattcactga

SEQ ID NO: 17507 - DNA, 348 bp, Anaeromyces robustus; identical to SEQ ID NO: 17506
  CBM6

SEQ ID NO: 17508 - DNA, 345 bp, Piromyces finnis
  CBM6
taccaactacgcctcaatgatggcttggcaagctggtgtttcagttaatggtttaggacacaccactgtttcttacaacagaggtgattggactggtgtttctaacgttgactttggagacagtgccacttccgtaaagatatccgccgcttccagcaatggagccaccattagaattacttcaggcagtgaaaatggtgatgttattggatacgttactattccagctacaggtggtgataagaacttcaagaccgttacagctaatgttaaggcttctggtactaagaacatcttctttgttgcctctggtgatgttactattgatacctggcaattcattgg

SEQ ID NO: 17509 - DNA, 345 bp, Piromyces finnis; identical to SEQ ID NO: 17508
  CBM6

SEQ ID NO: 17510 - DNA, 345 bp, Piromyces finnis; identical to SEQ ID NO: 17508
  CBM6

SEQ ID NO: 17511 - DNA, 345 bp, Piromyces finnis; identical to SEQ ID NO: 17508
  CBM6

SEQ ID NO: 17512 - DNA, 357 bp, Piromyces finnis
  CBM6
ttactatgaagcagaagatggtaaacttgatggaattactgtctataaagatctttcaggattttctggtactggttatgttggtagatttgaaaatccaggaaattcaataacagtaacagtcaatgcaccatcaactggtatgtatgatttatctattatatactgtgctaatatgggtcaaaaaatcaatactcttatggttaatggtcaaagtgcaggtgatgttacattcactgaaaataaaaagtttgaatcaaaagatgttggtgctatttatttaaataaaggaaagaatactattggtcttgtagcttcatggggttggatgtgggttgatgcttttgttattaatga

SEQ ID NO: 17513 - DNA, 567 bp, Neocallimastix californiae
  Cellulase
taaaaaaattttagttgctatttggaaacaaattgctgctgaatttgctgactatgatgaacatttaattttcgaaggtatgaatgaaccaagaaaggttggtgatccagccgaatggaatggtggtgattatgaaggatggaatttcgttaatgaaatgaatgatcttttcgttaaaactattcgttctactggtggtaacaatgctttacgtcatcttatgattccaacctacgctgcttgtattaatgatggtgctattaataacttcaaatttccaagaggtgatgataaagttattgtttctcttcactcatacagtccatataactttgccttaaataatggagctggtgcagttagtaatttctacgatggtagtgaaattgattgggctatgaatactattaattctaatttcattagcaagggtattcctgttattattggtgaatttggtgccatgaatcgaaacaatgaaaatgaccgtgaaagatgggcagaatattatattaagaaggctacatctatcggtgttccatgtgttatatgggataatggttactt

SEQ ID NO: 17514 - DNA, 825 bp, Neocallimastix californiae
  Cellulase
taatgaatctggtgctgaatttggtcaaggtgaatacccaggtacttacaataagcattacatttacccagatgttaaagctattcaagcttccattgatcaaggtatgaatattttccgtgttggctttgcatgggaacgtttacaaagaagcttaaatgctgaatttgatgccactgaatttggtcgtttagatgaagttattaactatatcactagtaatggtgctgtagccattattaatccacataactttgctagatataagaacgctgttattggtacaagtcaagtcccaaattctgctttctctaacttatggaagagattagctcaaaaatacaagaacaatcaaaaagtttggtttggtttagtaaatgaaccacatgatatgccaacagctcaatggttcgctgctgcacgtgatgctgttgataccattcgtgctacaggtgctaacaataatgttcttgttcctggtaatgcatacactggtgcatggaactggaaagaaactttttatggtgaatctaatgcttccgttgctcttagatacttcagctcagctgataagaatataattttcgaaactcaccaatatttcgattctgattattctggtactcatgaacaatgtgttcaacgtccatgtaacaaactcttcgttaatttcgttgaatggttaaaagctaacaatttaaagggtttcattggtgaatttggtgctgccattaacagggactgcaaagcttgtgttgaagaagctattaactacttagaacaaaactctgctaatattgttggctgggcctggtgggctgctgg

SEQ ID NO: 17515 - DNA, 1474 bp, Neocallimastix californiae
  Cellulase
gaagacttctattgttttaactgctgttgctgctcttgccgctaaggcttccgctgcttgttttgctgaaagattaggttacccatgttgtaaaggaaacactgttgcttacactgataatgatggtaaatggggtgtcgaaaatggtaactggtgtggtattgctgatactccttccccagctgcttgttggtctacaagtttaggttatccatgttgttcatcttccagtgctcaagtttattacactgataatgatggtaaatggggtgttgaaaatggtgactggtgtggtattccaactggttctactggtggtagtactggtggtagtactggtggtggtagcgttactccatctggtgaacaattcactatttctggaaatccatttagcggagttgaattctacattaatccatactatgttgaagaagttgatggagcaattgctcaaatgtccgattcttcccttattgctaaggctgaaaagatgaagacctactctaatgctatctggttagataccattaagaacatgcaaagttggttagaatctaacttacaaggagctcaatctcaacaccaatctagtggtaaggatgttttaactgttttcgtcgtttacgatttaccaggtcgtgattgtcacgctcttgcttctaatggtgaacttcttgctaacgatggtgattttactcgttacaagtctgaatacattgatgtcattgaaggtcacttaaagacttacaaatctcaaccagttgttcttattgttgaaccagattcacttgctaacatggttaccaatcttgattccactccagcatgtcgtgattctgaaaagtattacatggatggccatgcttacttaattaagaagtttggtgttcttccacatgttgctatgtatcttgatattggtcacgccttctggttaggttgggatgacaaccgtgaaaaggctggtaaggtttatgccaaggttatcagctctggtgctccaggtaaggttcgtggtttcactgataatgttgctaactacactccatgggaagatccaactctttctcgtggaccagaaaccgaatggaacccatgtccagatgaaaagagatacttacaagctattcaaaaggacttcaagtcagctggtattcaatcagtttacttcgtttgtgatacttctcgtaatggtaagaaggttgaccgtaagcacccaggagaatggtgtaaccaaactggagttggtattggagccagaccacaagccagtccagtttctggtatggaataccttgatgctttctactggattaagccacttggtgaatctgatggtacctctgatgaaagtgcagctcgtttcgatggttactgtggtcatgaaaccgctatgaagccagctccagaagccggtcaatggttccaaaagcactttgaacaaggtattaagaatgctaacccaccactc

SEQ ID NO: 17516 - DNA, 255 bp, Neocallimastix californiae
  Cellulase
agatgaaaatattctctttgaagttcaccaatatttcgatactgattactctggttctcatgatacctgtgtccaacgtccatgtcaaaacaacctcaaagaatttgttgaatggcttaagactaacaacttaaagggatgggttggtgaaattggtggacttgctaatgatgaatgtaaggaatgtattgaagaagttcttgaatatctccaagaaaacagagatgttattaagggagtccaatggtgggccgc

SEQ ID NO: 17517 - DNA, 573 bp, Neocallimastix californiae
  Cellulase
tgattcaaagggtcgtaaggttcaattatctggtctttcatggttcggtggtgaaactactaacctttccccacacggtttatggaccaattctttagctaactttattaagattgtcaaggataatggttacaaccatcttcgttacccatggactaatgaaatgttctttgaaggtgctaagactcaatctattgatcaaatgaacaatccagatcttgttgatctttctccattagaagttatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggagctgatcttcacaatgaaccacacggtaaggcttgctggggttgtggtgaagaagaacgtgattggagacttgcagctgaaagatgtggtaatgctattcatgaagttaatccagactggcttattattgttgaaggtaatgatcacta

SEQ ID NO: 17518 - DNA, 1468 bp, Neocallimastix californiae
  Cellulase
gaagacatctcttgctttaattactgttactactcttgccgctaaggcttctgctgcatgcttctctcaaagtttaggttatccatgttgttctggaaatgacgttgtttacatcgataatgatggtaaatggggtgttgaaaatggtaactggtgtggtattgctgatactccagctccagctgcttgctggtcaacaagtttaggttatccatgttgttcatcttctagtgcccaagtttactacactgataatgacggaaagtggggtgttgaaaataatgactggtgtggtattccaactggttccattggcggtggaaacagcggtggaaatgaagaagtaaatgttactccaggtgaacaatacactcacaatggtaatccattctctgatgttgaattcttcattaatccatactatactgctgaagttgatgccgcaattgctcaaatgagtgattcttcccttatcgctaaggctgaaaagatgaagacatactctaatgctatttggttagataccattaagaatatgaatgagtggttagaaaagaatttaaagggagctcttgctcaacaaagtggaagtaagaaggttttaaccgtttttgtggtttacgatttaccaggtcgtgattgtcacgctcttgcttctaatggtgaacttctcgccaatgatggtgatttagctcgttacaagtctgaatacattgatgttattgaaggtcacttaaagacttataaatctcaaccagttgttcttattgttgaacctgattcacttgctaacttagttactaaccttgaatctactccagcttgtgctgactccgaaaaatactatcttgatggtcatgcttacttaattcaaaagtttggtattcttccacatgttgctatgtatcttgatattggtcacgccttctggttaggttgggatgataaccgtgaaaaggcagctaaggtttactctaaggttatcagttccggttccccaggtaaggttcgtggtttcactgataatgttgctaactacactccatgggaagatccaacactttctcgtggaccagacactgaatggaacccatgtccagatgaaaagagatacttagaagccatgcacaaggacttcaaggcagcaggtattagttccgtttacttcgtttgtgatacttctcgtaatggtaagaaggttgaccgtaagcacccaggagaatggtgtaaccaaactggagttggtattggtgccagaccacaagctagtccagtttctggtatggaataccttgatgctttctactggattaagccacttggtgaatctgatggtacctctgatgaatctgcagctcgtttcgatggttactgtggtcatgaaaccgctatgaagccagctccagaagccggtcaatggttccaaaagcactttgaacaaggtattaagaatgctaacccaccactc

SEQ ID NO: 17519 - DNA, 933 bp, Neocallimastix californiae
  Cellulase
tgattctaagggacgtaaggttcaattatctggtctttcttggttcggtggtgaaaccactaacctttccccacacggtttatgggctaactctttagctaacttcattaagattgttaaggataatggttacaatcatcttcgttacccatggaccaatgaaatgttctttgaaggtgctaagactcaatcagttgatcaagttaacaacccagatcttgctgatctctctcctttagaaattatggatgccgttattaatgaatgtggtaaggctggtcttaaggtttatcttgatcgtcacagaccactttctggtggacaaagtgaattatggtatgttgatgaagttgatgaagctaaatggattgaagactggcaattccttgctaagcgttacaagggtaatccaaccgttattggtgctgatcttcacaatgaaccacacggtaaggcctgctggggttgtggtgaagaagaacgtgattggagacttgcagctgaaagatgtggtaatgctattcatgaagttaatccagactggcttattattgttgaaggtaatgatcactatggtgaagaaggatggcaaaagggagaatcctactggtggggaggtatgttaaagggagttaaagaattcccagttagattaaatactccaaacaagcttgtctattctgctcacgattatgataagaatgtccatatgcaagattggttcaaagaagccgatttcccagataacatgccaccaatttgggatgataaatggggatacattgttaaggaagatattgcaccagttcttattggtgaattcggttcactcttaagagatgccacagatgttaaatggttaagtaacttaattgactatatgaaagaaaatgaagttcactggactttctggtgtttaaatccaaactctgg

SEQ ID NO: 17520 - DNA, 843 bp, Neocallimastix californiae
  Cellulase
taataaaaatccaattgcttcagaaacttgttggggtaatgttaaaactactcaagaactttactataaattaagtgatcttggttttaatactttccgtattccaactacttggagtggtcattttggagatgctccagactacaaaattaatgatcaatggatgaaaagagttcgtgaaattgttgattatgctcttaatactggtggttatgccattttaaatattcatcatgaaacttggaatcatgctttccaaaaaaatttagacagtgctaagaaaattttagttgctatttggaaacaaattgcagctgaatttgcagactatgatgaacatttaattttcgaaggtatgaacgaaccaagaaaggttggtgatgcaaatgaatggaatggtggtgattatgaaggatggagcttcgttaatgaaatgaatgatcttttcgttaaaactattcgtgctactggtggtaacaatgctttacgtcatcttatgattccaacttacgctgcttgtgttatggataatgctgtgaataacttcaaatttccaagtggtgatgataaagttattgtttctcttcactcatacagtccatataactttgccttaaataatggagctggtgcaattagtaatttcaacgatggcagtgaaattgattgggttatgaatattatcaactctaacttcattagcaaaggtattcctgttattattggtgaatttggtgccatgaatcgaaacaatgaagatgaccgtgaaagatgggctgaatattatattaagaaggctacatctcttggtattccatgtgttatatgggataatggttactt

SEQ ID NO: 17521 - DNA, 933 bp, Neocallimastix californiae
  Cellulase
tgacgaaaagggtcgtaaggttagattagctggtatctcatggtttggaggtgaaactactaatctttctccccatggattatgggctaagccattagaccatttcattaaagtaataaaggatcatggttacaaccatattcgttatccatggactaatgagatgctcttcccaggtgctaaaactgaatctattaatgctatggaaaatcctgatcttgttgatcttaccccattagaagttatggacgctgttattgatgcctgtggtaaggctggtttaaaagtttatcttgatcgtcacagaccactttctggtggtcaaagtgaattatggtatatttctaaggttgatgaaaagaaatggattgaagactggcaattcctagccaaacgttacaagggtaatccaactgttattggtgctgatcttcacaatgaaccacatggtactgcctgttggggttgtggtgaaactcaacgtgattggagacttgctgctgaaagatgtggtaatgctattcatgaagttaaccctgattggcttattattgtagaaggtaatgatcattatggtgaagaaggttggcaaaaaggtgaaggctactggtggggtggtatgttgaagggtgttaaagaaaatcctgtcagattaaagaaaccaaacaagcttgtttattctgctcacgattatgataagaatgttcacatgcaagattggttcaaagtttcttctttcccagataacatgcctgaaatttgggatgataaatggggttacattgtgaaagaagatatagctcctgttcttattggtgaatttggttcacttttaagagataaaactgatgttaaatggttacaaaatttaatttcttacatgaataaaaataccgttcactggactttctggtgcttaaatccaaattctgg

SEQ ID NO: 17522 - DNA, 312 bp, Neocallimastix californiae
  Cellulase
attcaacaactttatcttcccagaagatgatgataaggttattgcttctgttcatgcctatgctccatacaactttgccttaaataatggtgaaggagctgttgataagtttgatgcagctggtaagagagatcttgaatggaacattaatttaatgaagaagagatttgttgatcaaggtattccaatgattcttggtgaatatggtgctatgaaccgtgacaatgaagaagatcgtgctacttgggctgaattctacatggaaaaggttactgctatgggagttccacaaatctggtgggataatggtgt

SEQ ID NO: 17523 - DNA, 1374 bp, Neocallimastix californiae
  Cellulase
gaaggcctctattgctttaactgctgctgctgctcttgccgctaaggcttctgctgcttgtttcgctgaaagattaggttacccatgttgttctggtaacgaagttgtttacaccgataacgatggaaagtggggtgtagaaaatggtaattggtgtggtattgccgatgctccaacttgctggtctctttctcaaggttatccatgctgttcttcttcaaatgctgaagtttggtacaccgatgcctcaggtaaatggggtgttgaaaatggagactggtgtggtattccaactggttctactggtggtagtactggtggtagtactggtggtggtaatgttactccatctaatgaacaatacaccatttctggtaatccattcaagggtgttgaattctacatcaatccatactatgttgaagaagttgatggagctattgctcaaatgtctgactcttccctcattgctaaggctgaaaagatgaagacttactctaatgctatttggttagatactattaagaatatgcaaagttggttagaatctaacttacaaggagctcaatctcaacaccaaagtagtggtaaagatatcttaacagttttcgttgtttatgatttaccaggtcgtgattgtcacgctcttgcctctaacggtgaacttcttgccaatgatggagatttagctcgttacaagtctgaatatattgatgttattgaaggtcacttaaagacttacaaatctcaaccagttgttcttattgttgaacccgattcacttgctaacttagttactaatcttgaatctactccagcttgtgctgattctgaaaaatactatcttgaaggacatgcttatttaattaagaagcttggtgttcttccacatgttgctatgtatcttgatattggtcacgctttctggttaggttgggatgataatcgtgaaaaggctggtaaagtttatgctaaggttattagttctggtgctccaggtaatgttcgtggtttcactgataatgtttctaactacactccatgggaagatccaactctttctcgtggaccagaaactgaatggaacccatgtccagatgaaaagagatacttagaagctatttctaaggacttcaaatcagcaggtatcaaatccgtttactttgtttctgatagttctcgtaatggtaagaaggttgatcgtaagcacccaggagaatggtgtaaccaaactggtgttggtgttggtgccagaccacaagccagtccaatttctagcatggaataccttgatgctttctactggattaagccacttggtgaatccgatggtacttctgatgactacagctgttcgttacgatggttactgtg

SEQ ID NO: 17524 - DNA, 1372 bp, Neocallimastix californiae
  Cellulase
gaagtttattaatttagttgctacttctattttagctacttgtgctttagcttcttcatgtcacccacaatacaattgctgtaattcttgtgacgttgtatacactgataatgaaggtgaatggggtgtcgaaaataacaattggtgttttataaatgatgcaaagtgtcatccatcttcatgtaaatttgaagctcttggttacccatgttgtagtcattgtaactctatttaccatgatgaaagtggtgattggggtgttgaaaatggtgattggtgtggtattcaagagagtaactgtggtagtactccatcaggaactactattagaaaaactactactactactactaccaaaaagacttacccaactattactccatccttcttcagtactggaaacatttacagtaacagtcaataccaaggtgaagttcaatcttctattaataaattaagtggtgaattacaacaacaagctaacagagtaaaatacactccaactgctgtttggttagcttgggatggtgctccaggtgaagttccaaagcatcttggtgctgctggtggtaacactgctgtcttcatgatgtactggatcccaactcgtgattgtaacagtaatgcttcccaaggtggtgcttctgacttaaattcttacaagaattacgttgacagtgtttacaattcattcagatcctatggtaacagtaaaattgttgttgtcgtcgaaccagatactcttggtaacatggtgacttctcaaggtaatgaaaactgtagaagaactgctgttattcataagcaagctcttgcttatgctataaacaaattcggtagtcttaacaatgttcaagtctaccttgatgccggtcacagtcaatggttaaccggttatgaagatgaaactgctgaaattattaaggaaatattagatatggctccacaaggtaagattcgtggtttctccactaatgtatctaacttccaacctgtccaaagagaatatgaatatcatactcgtctttacgatgctcttgaaaaggttggtgtcaagaatatgagattcatcgttgatactagtcgtaatggtgttgatatcagtgaagaatttgcaaagactaagacctggtgtaactttgttggtactggttttggtgaacgtccaaagggtaatccagacccagttaacatgccattattagatgcttatatgtggttaaagccaccagcagaatctgacggttcttctactggtgctcgtgctgatccagtttgtgctcgttctgattctcttccaggggctccagacgctggtcaatggttccatgaatactttgtccaattattaaagaatgctaatccaaaattc

SEQ ID NO: 17525 - DNA, 1456 bp, Neocallimastix californiae
  Cellulase
gaaggcttcatttgctttgactgctattgctgcattaaccgcaaaggtttctgctgcctgtttctcagaaagattaggttacccatgttgtaaaggtaacactgtcgtttacaccgataatgatggaaagtggggtgttgaaaataataattggtgtggtatcggttccactagtggttcttctgctgcttgctggtctcaagcattaggttacccatgctgtagtcacaagaatgttgtttacactgataatgatggtgactggggtgttgaaaatggtgattggtgtggtattattaagggcggttctggttctggttctggtggtggtagtgccgctattggtgaacaatacactattaatggtaatccatttgccaatgttgaattctatattaatccatactatgttgaagaagttgacaatgccatttcccaaatgtctgactcttcccttattgctaaggctgaaaagatgaagacttactccaatgctatttggttagataacattaaaaacatgcaaagttggttacaaccaaacttagaaggtgctctctctcaacaaaatagtggtggtaccccagttttaactgtctttgttgtttatgatttaccaggtcgtgattgtcacgctcttgcctccaatggtgaacttcttgccaatgactctgatatggaacgttacaagtcagaatatattgatgttattgaaggtcacttaaagacttacaagtctcaacctgttgttcttgttattgaaccagattcccttgctaacatggtcactaacattgaaagtactccagcttgtgctgattctcaaaattactactttgatggacacgcctacttacttaagaagcttggtgtcttcccaaatgtagccttatatcttgatattggtcacgccttctggttaggttgggatgataaccgtgaaaaggctgcaaaggtctatgctaaggttattcaatctggtgcaccagctaaggttcgtggtttcgttgataacgttgctaactacactccatgggaagacccaactctttcacgtggtccagatactgaatggaacccatgtccagatgaaaagagatacttagaagctatgcacaaggactttactagtgccggtattcaatctgtctacttcttctctgattcctctcgtaacggtaagaagactgaccgtaagcacccaggtgaatggtgtaaccaaaccggttgtggtattggtgccagaccaaaagccagtccaatctctggtatggaataccttgatgccttctactgggttaagccaattggtgaatctgatggtacctcagatactagtgctaagcgttatgatggttactgtggtcacgaaactgccatgaagccagctccagaagccggtcaatggttccaaaagttcttcgaagaaggtcttaagaatgccaatccaccactt

SEQ ID NO: 17526 - DNA, 967 bp, Neocallimastix californiae
  Cellulase
gaaggcctctattgctttaactgctgttgctgctcttgccgctaaggcttctgctgcttgtttctctgaaagattaggttatccatgttgttctggtgacgaagttgtttacactgataatgatggtaagtggggtgttgaaaatggtaattggtgtggtattgccgatgctccagctccagctgcttgctggtctactagcttaggttatccatgttgttcttcttcaaatgctgaagtttggtacactgatgactctggtaaatggggtgttgaaaatggtgactggtgtggtattccacaaaatgaaattgtaaagggaggacaatacaccatttctggtaatccatttaagggtgttgaattttacattaacccatactatgttgatgaagttgatggagccattgctcaaatgtccgattcttctcttattgctaaggctgaaaagatgaaaacttactctaatgctatttggttagataccattaagaacatgcaaagttggttagaatctaacttaaagggtgctcttgctgaacacaattcaactggaaaggatattttaactgttttcgttgtttacgatttaccaggtcgtgattgtcacgctcttgcttccaatggtgaacttcttgccaactctggtgatatggaacgttacaagtctgaatacattgatgtcattgaaggtcacttaaaggaatataactctcaaccagttgttcttattgttgaaccagattctcttgctaacttagttactaatcttgaatctactccagcttgtcgtgattctgaaaagtattatcttgatggtcatgcttacttaattcaaaagcttggtgttcttccacatgttgctatgtatcttgatattggtcacgccttctggttaggttgggatgataatcgtgaaaaggctggtaaggtttatgccaaggttattcaattcaggttcaccagg

SEQ ID NO: 17527 - DNA, 1252 bp, Neocallimastix californiae
  Cellulase
gaagacctctattgctttaactgctgttgctgcccttgccgctaaggcttctgctgcttgtttctctgaaagattaggttatccatgttgttctggtaacgaagttgtttacactgataatgatggtaaatggggtgttgaaaatggtaattggtgtggtattgccgatgctccagctccagctgcttgctggtctactagcttaggctacccatgttgttcttcttcaagtgctgaagtttggtacactgatgactctggtaaatggggtgttgaaaatggtgactggtgtggtattccaactggttctactggtggttctactggtggttctactggtggtaatgctactccaggtgaacaatataccattaatggtaatccattcaagggtgttgaattttacattaacccatactatgttgatgaagttaatggagccattgctcaaatgtccgattcttctcttattgctaaggctgaaaagatgaagacttactctaatgctatttggttagataccattaagaacatgcaaagttggttagaatctaacttagaaggagctctttctcaacaagaatctactggtaagaaagttttaactgttttcgttgtttacgatttaccaggtcgtgattgtcatgctcttgcttccaatggtgaacttcttgccaactctggtgatatggaacgttacaagaccgaatacattgatgtcattgaaggtcacttaaagaaatacaagtctcaaccagttgttcttattgttgaaccagattctcttgctaacatggttactaatattgaaactactccagcttgtgctgattcacaaaactattactatgatggtcatgcctacttacttaagaagtttggagttcttccacatgttgctatgtatcttgatattggtcacgccttctggttaggttgggatgataatcgtgaaaaggctggtaaggtttatgccaaggttattcaatcaggttcaccaggtaaggttcgtggtttcaccgataatgtttcaaactacactccatgggaagatccaactctttctcgtggaccagaaactgaatggaatccatgtccagatgaaaagagatatttagaagctatgcacaaggacttcaaggcggcaggtattgaatcagtttactttgtttccgatacttctcgtaatggacacaagactgaccgtaagcacccaggagaatggtgtaaccaaacaggagttggtattgga

SEQ ID NO: 17528 - DNA, 790 bp, Neocallimastix californiae
  Cellulase
gaagacctctattgctttaaccgcagttgctgctcttgccgctaaggcttctgctgcttgtttctcagaaagattaggttacccatgctgttctggtgatgaagttgtttacaccgataacgatggaaagtggggtgtagaaaacggtaattggtgtggtattgccgatgctccaacttgctggtctctttctcaaggttatccatgctgttcttcttcaaatgctgaagtttggtacactgatgcctcaggtaaatggggtgttgaaaatggtgactggtgtggtattccaactggtactactggtggtaatgttactccatctaatgaacaatacaccatttctggtaatccattcaagggtgttgaattctacatcaatccatactatgttgaagaagttgatggagctattgctcaaatgtctgactcttcccttattgctaaggctgaaaagatgaagacttactctaatgctatttggttagataccattaagaacatgcaaagttggttagaatctaatttacaaggagctcaatctcaacaccaaagtagtggtaaggatatcttaactgttttcgttgtttacgatttaccaggtcgtgattgtcacgctcttgcttctaacggtgaacttcttgccaatgatggagatttagctcgttacaagtctgaatacattgatgttattgaaggtcacttaaagacttacaaatctcaaccagttgttcttattgttgaacccgattcacttgctaacttagttacaaatcttgaatctactcca

SEQ ID NO: 17529 - DNA, 1300 bp, Neocallimastix californiae
  Cellulase
gaaagttttaaatattttatctatattaactgctgcgggttcagccattgcttctaaatgccatccttattacgattgttgtaaaggatgtcaaaccattttaactgatgaagaaggcaattggggttctgaaaatggtcagtggtgttttgttgatgaaaaaaaatgtgaaagtgttcttggaacgtgtaaatttgaagcaattggttatccatgttgttctcattgtgatgtaattttaactgatgatgatggaaactggggtgctgaaaatggtcaatggtgtggtattcctgaaaactgtggttctactgaaccaagtacaaatcaatcagttgctccaactgaaaatttctttgataacgaactttatattagcccaaactatgttaaagaaattgaatcaactattccagatttgagtccagaattacaagcaaaagccaagaatgttgaaaaggtttcttctgctgtttggttagcctatgaaggtgctccaaatgatgttgctccacatcttaaagctgctggttcaaagactgttactttcattctttatatgattccaactcgtgattgtaatagtttagcttctgctggtggtgtttctgatcttgacaagtacaagggttatgttgacaagattgctaacactattaagaaattcccagaatctaaggttgttatggttattgaaccagatactcttggtaatcttattacaggtgaaactgaagcttgtaagaatgttcacactttacataagcaagctttagcttatgccgctaatgttttcggtaacatgagtaatgttagtgcttatcttgatgctgctcatagtaaatggttaggatgggctgctgataaggttgccgctgttgttaaggaaattttagacaatgctccaaatgctaatattcgtggttttagtactaatgtttctaattacatgccaattgaagctgaatatgaatatcatcaaaaactccatgatgctcttgaagaagtcggtattaaggacaaaagattcattgttgatactggtcgtagtggtgttgatgtacgtgaagaattcgatgttaaccaaacctggtgtaatttaatttatgctggtttaggtgaaccatcacgtggaagtccagatccagaaaatatgccattattagatgctttcatgtggctcaaaccaccaggtgaagctgatggttctgacactggttctagagctgatccagtttgtggacgtgaagattcattcccaggttctccagatgctggttcatggttcggagaatacttt

SEQ ID NO: 17530 - DNA, 1468 bp, Neocallimastix californiae
  Cellulase
gaaggtttcatttgttttaagtgctattgctgcattagccgcagaggtttctgctgcctgtttctcagaaagattaggttacccatgttgtaagggtaacaatgtggtctacactgataatgatggaaagtggggtgttgaaaataataattggtgtggtattggttctaatagtggtggttcctcagccgcttgctggtctcaagctttaggttacccatgttgtactcacaaaaatgctgtttacactgatggtgatggtgattggggtgttgaaaatggtgattggtgtggtattattaagggaggaagtagtggtggcagtggtggtaatggtggtggtgatgctaccattggtgaccaatacaccattgaaggtaatccatttgctaatgtcgaattttacattaatccatactatgttgaagaagttgataatgccatctcccaaatgtctgactcttcccttattgctaaggccgaaaagatgaagacctactctaatgctatttggttagataatattaagaatatgcaaagttggttagaaccaaacttaaagggtgctctctctcaacaaaacagtggtggtactccagttttaactgtctttgtcgtttacgatttaccaggtcgtgattgtcacgctcttgcctccaatggtgaacttcttgccaatgactctgatatggaacgttataagtcagaatacattgatgtcattgaaggccacttaaagacttacaagtctcaacccgttgttcttgttattgaaccagattcccttgctaatatggttactaacattgaaagtactccagcttgtgctgattctcaaacttactattatgatggacacgcctacttacttaagaagcttggtgtcttccccaatgtagccttatatcttgatattggtcatgccttctggttaggttgggatgataaccgtgaaaaggctgcaaaggtttattctaaggttattcaatctggttctccagcaaaggttcgtggtttcgttgataatgttgctaactacactccatgggaagacccaactctttcacgtggtccagatactgaatggaacccatgtccagatgaaaagagatacttggaggctatgcacaaggacttcaaggcagctggtattcaatctgtctacttcttctctgattcatctcgtaacggtaagaagactgaccgtaaacacccaggtgaatggtgtaaccaaactggttgtggtgtcggtgcaagaccaaaagcaagtccaatctctggtatggaataccttgatgccttctattgggttaagccaatcggtgaatctgatggtacctctgatactagtgctaaacgttatgatggttactgtggtcacgaaactgccatgaaaccagctccagaagccggtcaatggttccaaaaattcttcgaagaaggtatcaagaacgccaatccaccactt

SEQ ID NO: 17531 - DNA, 750 bp, Neocallimastix californiae
  Cellulase
taatgctattgaagcttctattgaacaaggtatgaatgttttccgtatgggactcagatgggaacgtttccaacatgaattatttggtgatttaactgaatttgatttaactgaatataaaaagattgttgatgctactactgctaagggagcagttcttattattgatccacataactatgctcgttataacaataatgttattggatctgaagaagttccaattgaagctttcgcagacttctgggctaaattagccgaagttttcaaagacaatgaaaaagtatggtttgatttagttaatgaaccccatgatatggaaacagatgattggtttaaagctgcacgtgctgcagttgatgctattcgtactacaggagctaagaacaatattttaatttcaggtaatggttgggatggagcctggagttggggtaaggaagcatggtatggagaatctaatgcagatgttgctttaagatacttctcttctgaagatgaaaatattatttttgaagttcatcaatatttcgatagtgattactctggtactcatgatacctgtgttcaacgtccatgtcaaaaccttcttaaagaatttgttgaatggctcaagaccaacaacttaaagggttggttaggagaaactagtagtactcttagtgaaggatgcaaggaatgtgttcaagaagttcttgaataccttgaagaaaacagagaacatgttttaggagttacatggtgggccgc

SEQ ID NO: 17532 - DNA, 243 bp, Neocallimastix californiae
  Cellulase
tatttttgaagttcatcaatatttcgatagtgattactctggtactcatgatacctgtgttcaacgtccatgtcaaaaccttcttaaagaatttgttgaatggctcaagaccaacaacttaaagggttggttaggagaaactagtagtactcttagtgaaggatgtaaggaatgtgttcaagaagttcttgaataccttgaagaaaacagagaacatgttttaggagttacatggtgggccgc

SEQ ID NO: 17533 - DNA, 1429 bp, Neocallimastix californiae
  Cellulase
gaaggcctttatcgcattaagtactgttattgctctagcagctaaatcttctgctacttgctggtctgaaaaacttggttatccatgttgttcatcttcagatgccgaaattatatataccgataaagatggtaattggagtattgagaattatgaatggtgtggtattccaaaagcagtcacttgttggtctgaaacttatggttatccatgttgtaaaactacaaataaggttgtatacaccgatgaggatggtaaatggggtgttgaagataaaaaatggtgtggtattataaaaaaggaagatgatgatgaatttcctggaccagaacaagtaccattagaaggctctggcaatccatttaaagacgctgaattctacattaatccatattatactactgaagttgatgctgccattactaaaataagtaacgcttctcttattgctaaggctgaaaaaatgaaggaattctcaaatgccatttggttagattctattaaaaatatgaacgaattgcttgaaagcagtttaaatggtgctcttgctcaacaagaaagtggatataagaaagttttaaccgtttttgttgtttacaatttaccaggtcgtgattgtcatgctcttgcttctaatggtgaacttcttgccaatgatgctgactttgatcgttacaagtctgaatacattgatgttattgaaggtcacttaaagacttacaaatctcaaccagttgttcttattgttgaaccaaattcacttacaaacttagtgactaaccttgaatctactccagcttgttctgattccgaaaaatactatcgtgaaggaaatgcttacttaattaagaagtttggagttttaccacacgttgctctatatcttgatattggtcatgcctatttattaggttgggatgatactcgtgaaaaagctgctagactttaccatgatgttattagatcaggtgctccaggtaatattcgtggttttgctgataatattggtggcttcgttccatgggatgatccaaatctttctaatggaccagaaactgaatggaatccatgtccagatgagaagagatacttaaaagctatgtacagcgatttcgtgtctgcaggtattcatagcgttaaattcgttactgatacttcacataatggtaagaagtttgattatagtgatagggaattatggtgtaaatcaacatctgctggtgttggtgctagaccaatggctattccaattactactatagattatcttgatgctttctattggattaagccatttggtaacgtatctgaattaccaaatcaaagtagctttgataatgtttgtaaagatggtttagaaatatattcaagcgatacctggagtcaaaaggtctttgaagaaggtattaggaatgctaatccaccactc

SEQ ID NO: 17534 - DNA, 897 bp, Neocallimastix californiae
  Cellulase
tacaggtgattggattaatggtaataatgttaatgcttatgaaactgcttggggaaatccagctgctactaaggaattaattaatgcaattaaaaataatggtttcaatagtattcgtataccagtttcatggagtaatcttatgtcttctgattacactattagtgaagaattattaaagagagttaatgaagtagttagttgggttatcgaaaatgatatgtatgctattattaacattcactgggatggtggatggattgaaaaattcggaactaacgaatccacaatggctaatcaaaagttcgtcaaaatttggaatcaagtttcagattacttcaaaaattatggagaacatttaatttttgaatctttaaatgaagaaggttgttggaatgatgtctggaatcgttacagtaatgctggtgataagaacaaggcttatagtactttaaataacattaatcaacaatttgttgatattgttcgtaaatctggtggtaacaacaaaagtagacatttacttattgctggttattgtactgatattgatcttactgtcgattctgcattcaagatgccaactgattctgaaaaccgtatgatggtttctgttcattactacactccatctactttcactattcttgaaaaggatgaagattggggtaaattccaaggtacttggggtactgatgccgatgttaatgaacttattactaatttcgacaaacttaagaaacgttttgttgataatggtgttcctgttattattggtgaatatgctactgttttaactaacaaggacaaggcaagtgttcacaaatatttattcacttgtgctcaatacgctactagtttaggtatttgcccaatgctttgggataatggtgaata

SEQ ID NO: 17535 - DNA, 783 bp, Neocallimastix californiae
  Cellulase
tactcattacacctatccaaacattgatgctattagtacttctatcgaacaaggtatgaatgctttccgtatgggtcttagatgggaacgtttccaacatgaattatttggtgaattaactgaatttgatcttaccgaatataagaagatcgtggatgctgttactgctatgggagctgttattattgttgatccacacaactatgctcgttacaaagataaacttattggttcagaggaagttccaactgaagcttttgttgatttctggaagaagatggctaatgttttcaaggataatgacaaagtatggtttggtttagttaatgaaccacatgatatgaaaacagatgactggtttaagattgctcgtgctgctgttgatggtattcgttccactggagctaataataccattttaattccaggtaatggatgggatggtgcatggagttggggttctcaagcttggtatggtgaatccaatgctgaagttgccttaagatacttctcttctgaagatgaaaatattgcttttgaagttcaccaatactttgattctgattactccggaggtcatggaacatgtgaaaaacgtccatgccaaaacaatgttaaagaatttgttcaatggcttaaggataataacttaaagggttggtttggagaattcagtggtcatatctctgatagtcaatgtaaggaatgtgtccaagaattccttgaataccttcaattaaacaatgaatatgttttaggagccacctggtgggcagcaggtcc

SEQ ID NO: 17536 - DNA, 894 bp, Neocallimastix californiae
  Cellulase
aggtgattggattaatggtagaaatgtaaatgcttatgaaactgcatggggtaatccagctgctactaaagatttaatcaaagcaattaaaaataatggtttcaatagtattcgtattcctgtttcttggagtaatcttatgtcatctgattacactattagtcaagaattattaaaaagagttaatgaagtagtcagttgggttattgatacaggtatgtatgctattattaacattcattgggatggtggatggattgaaaaattcggaaccaacgaatccacaatggctaatcaaaaattcaataaaatctggactcaagtatccgactatttcaaaaactatggagaacatttaatttttgaatcactgaatgaggaaggttgttggaatgatgtctggaaccgttacagtaactcaggtaataaaaacaaggcttatagtactttaaataatattaatcaacaattcgttgatattgttcgtaaatcaggcggtaacaacaaaaatagacatttacttattgctggttattgtactgatattgatttaactgttgattctgctttcaagatgccatctgattcagctaaccgtatgatggtttcagttcactactacactccatctacctttactattcttgaaaaggatgaagattggggtaaattccaaggaacatggggtactgatgctgaaattaaaactcttatggctgattttgacaaacttaagaagcgcttcgttgacaacggcgtaccagttattattggtgaatatgccacagttttgactaacaaggataaagctagtgtccataaatatttattcacttgtgctcaatacgctactagtttaggtatttgtccaatgctttgggataatggtgatta

SEQ ID NO: 17537 - DNA, 1399 bp, Neocallimastix californiae
  Cellulase
gaaattctctaccgttttaactactttatttgctgctggagctcttgcttctcaatgtcactggcaatacccatgttgtgataactgtgaagtttattatactgataatgaaggtaaatggggtattttaaacaatgactggtgtaaaatcaatgataaccgctgtaatgccaacagcgctagtaatacttgtagtagtagaattacctctcaaggttataaatgctgtagtaactgtatcgtttactacactgataatgatggtgaatggggtgttgaagatggtaactggtgtggaacaccagacaaatgtaaaggtgataataataatagcactaacaacaataacaataacaataacaacaataacaacaataataatggtggtaaccaacaaccaaaaccaattggtgacaacttctttgaaaatgaactttacagtaacttcaaattccaaggtgaagttgattcttccattaaaaagttaagtggtaatgttaagcaaaaggccgaaaaggtaaaatatgttccaacggctgcttggttagcttgggaaggtgcccccaatgaagttccacaataccttgatgaagctggctcaaagaccgtggtcttcgtcttatatatgattccaactcgtgattgtaatgctaatgcctctgctggtggtacagccaatattgataagtacaagtcctacgtggataagatttacaacaccattaacaaatatccaaactctagaattgttatgattcttgaaccagatactattggtaaccttgtcactgctaacaatgccaactgtagaaatgtccaaaatatgcataagcaagctctctcctacgccatcagtaaatttggtactcaaagtaatgtaagagtctatcttgatgccgctcacggtgcctggttaaacccacacgcggataagaccgctcaagtaattaaggaaatcttaaacaatgctggtaatggaaaacttcgtggtatcagtaccaatgtttctaactaccaaagcgttgccagcgaatacaaataccatcaaaaccttaacagagctcttgaaaaccttggtgtcagaggcttaaagtttattgttgatacctctcgtaacggtgctaacgttgaaggtgccttcaatgcctccggtacctggtgtaacttcaagggtgccggtttaggtgaacgtccaaagggtaatccaaacccaggtagtatgccattacttgatgcctacatgtggattaagactccaggagaagctgatggttcctctcaaggttctagagctgatccagtttgtgctcgtggtgattctcttcaaggtgctccagatgctggttcatggttccatgattactttgtcatgttgattaacaatgccaacccacctttc

SEQ ID NO: 17538 - DNA, 864 bp, Neocallimastix californiae
  Cellulase
tgattcaaagggtcgtaaggttcaattatctggtctatcatggttcggtggtgaaactactaacctttccccacacggtttatgggctaactctttagctaactttattaagattgtcaaggataatggttacaaccatcttcgttacccatggactaatgaaatgttctttgaaggtgctaagactcaatctgttgatcaagtgaacaatccagatcttgctgatctttctccattagaaattatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagaatccgatttcccagataacatgccaccaatttgggatgataaatggggatacattgttaaggaagatattgcaccagttcttattggtgaattcggttcactcttaagagatgccacagatgttaaatggttaag

SEQ ID NO: 17539 - DNA, 705 bp, Neocallimastix californiae
  Cellulase
ggaagctattgattattttattgctgctgcatctcaaagaaatataagattggtgctaggttttacaaataactggactgattatggtggtatggatgaatgggtaaaaggttttggaggaaaatatcacgacgatttttatactaataaagaaattcgtaatgcatttaaaaggtatattaaaactgtaataactcgtattaatcgtcatactaatattcgttatagagatgatccaacaattttttcatggcagttggcaaatgaaccaagatgtggtaatggtccatctggacttcctcaatcagggaagtgtactccggaagttattactgaatgggctgatgatattagttcgtatattaaagaattagatccaaatcatcttgtctcagttggtgttgaaggttttggtcttgaagcacctaaaggatctaaaggattatatgcatataaatatgatgaaggaactgattttgaagcattaaccgcattaccaaatgtagattataatacatatcattattacccaattccatggggaatgacagacttaatttctcatactaaagattggattgaatcacatcaagctgttggaaaaaaattaaataaacctgtagtttttgaagagtggggtcttgaagtaccgaccgattgttcaaaagaagaacgaattcaatattataaaacttggacaaaaca

SEQ ID NO: 17540 - DNA, 933 bp, Neocallimastix californiae
  Cellulase
tgatgaaaagggtcgtaaagttaaattagctggtctttcatggtttggaggtgaaactccaaatctttcacctcatggtttatgggctaaaccattagctcatttcattaaagtaattaaagatcatggttacaaccacattcgttatccatggactaatgaaatgtttgtagaaggtgcaaagactgaatctattaatgctatggaaaatccagatcttgttgatcttactccattagaagttatggatgcagtaattgatgcttgtggtaaggctggtttaaaggtttaccttgaccgtcacagaccaactgccgctggacaaagtgaattatggtatatttcaaaggttgatgaaaagaaatggattgaagactggaaattccttgctaagcgttataagggaaatccaaccgtaattggtgctgatcttcacaatgaaccacatggtactgcttgctggggatgtggtgaaactgaacgcgattggagacttgctgctgaaagatgtggtaatgctattcatgaagttaacccagactggcttattattgttgaaggtaatgatcactttggtgaagaaggttggcaaaagggtgaatcctactggtggggaggtatgttaaagggtgttaaagaaaacccagtcagattaaataaaccaaataagcttgtttactctgctcatgactacgataagaacgtccatatgcaagaatggttcaagctttctactttcccagataatatgccagaaatttgggatgatgtttggggatatatttctaaggaagatattgctccagtccttattagtgaattcggttcacttttaagagataagactgatgttaagtggttagaaaaccttgtttcctacatgaatgataatgctgttcactggactttctggtgtttaaatccaaattctgg

SEQ ID NO: 17541 - DNA, 861 bp, Neocallimastix californiae
  Cellulase
cactaaacaatatgaaactgcatggggaaaccctgaaaccactgaagctatgattaaaggtgttaaaagctatggtttcaagtcagttcgtattccagttgcatggagtaatctcatgtcttctgattatacgattagtccattattacttaaaagagtggaagaagtagtcaattatgttgtcaaaaatgatatgtatgctataatgaatatccactgggatggtggttggtttgaaaaattttctacctcggaacaagaagcatttactaaatacaaaaaagtttgggaacaattaacggattatttcaaaagttttgatgaacatttaattttcgaatcattaaatgaagaaggttgttgggattccatttggaatcgctattctaaatctggtgacaaggccaaagcctacggtttattaaatacaattaatcaaaactttgttgatattgttcgtaattctggtggaaacaataccaatagacatttacttttagctggttattgtacagatattgacttaacggttgatgaagcctatgtggttccaaaggatgatagagttatggtctccgttcactactacactccatccactttcactcttcttgaagaagatgccgattggggtaaggctgcccctacctggggtacggatgatgaagttaactaccttattaatgatttcaataaattaaagacacgttttgttgataaaggtattccagtcattattggtgaatatggtacaactgctaaaaataaagataccgaaagtattcataaatatttaatgacatgtgcagaatatgccctaaacttagatatgtgtccagttgtttgggatgcaggacaata

SEQ ID NO: 17542 - DNA, 876 bp, Neocallimastix californiae
  Cellulase
agttgatttagctcttgaagcttatgctagacataatcttaatgttgttagagcttgggctttctgtgatgaatgtgaagatgctacaagattagttgatttttctggtccagaagttacccttaatagtgaaaacatggaaaaggttgattattatcttgctgcggctgctcaaagaaatattcgtgttgttttaactcttacaaataattggactgattatggtggtatggatgtttgggttaaacaatttggtggaaaatatcatgatgaattctatacaaatagaaaaattgttgaaggttataagcaatatattaaagctatgattaatcgagttaacacttacactggtcaattatataaggatgatccaacaattttctcatggcaacttgctaatgaagcccgttgtaacaatggaccacatggtcttccagttaaaaattgtaatactgatactattacaaattggatggacgaaattgcttcatttatacatcaagaagatccaaatcatttagtttcttctggtattgaaggtattggtcttactccaccatcgggtgttgatccaaatacttatgtttatagatatgatgaaggaactgattatgaagctattagtgctcttgattctattgactataatactgttcatatgtatccagttggatggggactaaaggattatagcaaagatggtgttacatggattaaagcccacgctgatgttgataagaaatttaataaaccaactgttgttgaagaatggggtcttagtacttcagcagataatgttccacttgaagaacgtgatccaatttatacaaaatggatggatgctgtattggctaatgataatattggtatgaa

SEQ ID NO: 17543 - DNA, 1288 bp, Neocallimastix californiae
  Cellulase
tgatgtttattacaccgatgacgaaggtgagtggggtattcaaaacaataattggtgcttcattaatgatgctaattgccatccatctaatgtctgtaaatttgaagcgattggttatccatgttgtagtcactgtaacattgtttacactgatgatagtggcaactggggtattgaaaatgatgattggtgtggtataagagataactgtggaggaaacacaccatcctcctcaagtactactactactaccacgaccaccaccaccaccaaaaaaacctatccaacggtggctccctccttcttcagttccggaaatatttacagtaatagtcaataccaaagtgaagttcaatcatctattaacaaattaagtggtgaattacagcaacaagcttctagagtaaaatacaccccaaccgctgtttggttagcttggtatggtgctccaaatgaagttccaaaacatcttggggctgctggtggtaacactgctgtcttcataatgtactggattccaactcgtgattgtaacagtaatgcctctcaaggtggtgctagcgacttaaattcttacaagaattatgtcgatagtgtttataacaccttcagatctaacggtaacagtagaatcgttattgttattgaaccagatactattggtaacatagtgacttctcaagggaatgaaaattgtagaagaactgctattattcataaggaagcccttgcatatgccgttaacaaatttggtagtcttaacaatgttcaagtttatcttgatgccggtcacagccaatggttaaccggttatgaagatgaaactgctgctattattaaagaaattttagatatggcaccacaaggtaagattcgtggattctccactaatatttctaacttccaacccgttcaaagagaatatgaatatcatactcgtctttatgatgctcttgaaaaggttggtatcagcaatatgagatttattgttgatactagtcgtaatggggttgatatcagtgaagcctttgctaagactaagacctggtgtaactttgttggtactggttttggtgaacgtccaaagggtaatccagatcctataaatatgccattattagatgcttacatgtggttaaagccaccagcagaatctgatggttcttctcaaggtatgcgtgctgatccagtctgtgctcgtcctgattctcttccaggagctccagaagctggtcaatggttccacgattattttgttcaattattaagaaatgcaaatccaaaattc

SEQ ID NO: 17544 - DNA, 807 bp, Neocallimastix californiae
  Cellulase
ggttgaaaatattaatcaaccatgggctgaaaaaaattttacagcaaaagaaattgttgagagttataaacaattaggtttcaatgccattcgtattccggtaaaatgggcaaaaactatcaattctaaaacagttatcgaacctaatttattaaaaagtgtagaagaagtggttcgtcaaaccctaaataataatatgtttgctattattaatttagaaacttcaaatactttcatgacaggttttatttctgaagatgataatatacgttccgaaacctatgatggttataaaggaatatggaaacaaatttcaaattattttaaggattatgatgaacatttattatttgaatctatgaatgattctggttattgggaagatatatggaatactagaacttctgatggggatagacaatatgctcttgatatattacgtcaagtcaatcaagaattcattaatatggttcgttcaacaggtggttcaaatgaagaaagatatttattagtcagtggttatgctaatgatcctatcctaactcaagataacttctataaaattccaagtgatccttcccataaacttatggtttctctttattattatgttccaaatcattttactatcatcgataattattatacttggggttcacaagatgacattaaacagcttcaaactattatgaaaaatcttagtgttcgctttgttattcaaggtgttcctgtagttatcactagatacggtactattgtaaaaaatagaagttcagctaatattcatagttatttaacttccattgc

SEQ ID NO: 17545 - DNA, 1495 bp, Neocallimastix californiae
  Cellulase
aaaaaaaaaaaaaagttatttagtaaaaatgaaggcttctattgctttaagtgctgctgctgttcttgccgctaaggtttccgctgattgtttttcatcaagattaggtttcccttgctgttcctcttcttccgctgaagtttggtataccgattctgatggtaaatggggtgttgaaaatgatggatggtgtggtattccagaggctccatctccagctcaatgttggtctgaagctcaaggttatccctgctgtaaattcacttctgatgtcgttttcaccgacaatgacggaaactggggtgttgaaaatggaaattggtgtggtatccaaaagaagaatggaaacaatgataatactaacctcgatgatgttactccagataatcaaattaccctcaacggtaatccattcgccaataaaatcttctacattaatccttattatgttgaagaagttgatggtgccattgctcaaatgattgatgcttctcttatttcaaaggctgaaaaaatgaagactttctcaaatgctatttggcttgatactatcaaaaatatgcaaagttggttagaacctaatttaaagggagcccttgctcaacaaaagtctgccggaaaggaagttttaacggttttcgttgtttacgatttaccaggtcgtgattgtcatgctcttgcttccaatggtgaacttcttgctaataaaggagattgggctcgttacaagtccgaatatattgatgtcattgaagaaaagttaagaacttacaaatctcaacccgtcgttcttattgttgaaccagattcattggctaacatggtcactaatcttgattctactccagcttgtcgtgattctgaaagatattacatggatggccatgcctacttaattcaaaaattcggtgttcttccacatgttgctatgtatcttgatattggtcatgccttctggttaggatgggatgataatcgtcaaaaggccggaaaggtctattccaaggtgattcaatctggagcaccaggtaaagttcgtggtttcacggataatgtggctaactacactccatgggaagatccaaccctttctcgtggaccagaaaccgaatggaatccatgtccagatgaaaagagatacttagaagctattcacaaggacttcacggctgtaggcattccatcggtttactttgtttgtgatacttctcgtaatggtaaaaaggttgatcgtaagcatccaggagaatggtgtaaccaaactggagttggtattggtgccagaccacaagccagtccaatttccggtatgccataccttgatgccttttattggattaagccacttggtgaatctgatggtacctctgataccagtgctgctcgtttcgatggttactgtggacatgaaactgccatgaagccagccccagaagccggtcaatggttccaaaagcactttgaacaaggtcttaaaaatgctaatccaccactc

SEQ ID NO: 17546 - DNA, 738 bp, Neocallimastix californiae
  Cellulase
agatggaaatggtaatgaatttattttccgtggtattaatattgcacatgcttggtatactgataagacggaattctccattaatgaaattaatgctttaggtgctaacagtgcacgcattgttttagcttgtggtgctaaatacacaaaaacttcatatactgaagttgaaaagatcatcggatggtgtgaaaaggctggtttagtatgtgttcttgaacttcatgactttacaggatctgataatccatccgatattactactactgctttaaattactggaaagaaatgaaggatttagttaatactcataaagattatattattataaatatagctaatgaatggcaaggtagttggaataagggatccctctggggtaatacttattcttctgctgttaaatctatgcgtaatattggaatccaaaatgcaattatgattgatgcttctggctatggtcaagaaacaggaccaatgataaattatgctcaaagtgttctttcagctgatcctaataaaaatgttattttttcctatcatgtttattcagttctcggtaaagacaatactagtttatactctggtttcgatggaataaaagctaaaggagtatgctggattgttggagaatttggttggtggcaaaatggaggagatgttgtatataaatcattaatgagttactgtaattctaatcgtattggatggattgcttggtcttggtcaggtaatgg

SEQ ID NO: 17547 - DNA, 798 bp, Neocallimastix californiae
  Cellulase
tgtggaaaatataaatcagccatgggataaaaaatcatttacagcaaaagaaatagttgaaagctataagcaattaggtttcaatgccattcgtattcctgttaattgggctacaaaaattaattcaaaaactattattgaaccaaatttattaaaaagtgttgaggagatcgttcataatactatagataataatatgtttgctattatcaatttagaaacttcaaattcctttatgacaggatttatttcagaagatgaagaattacgttctgaaacatatgacggttataaaaatatatggaaacaagtttcaaatcattttaaggattatgatgaacatttattatttgaatcaatgaatgattccggatactgggaagatatttggaatacaagaactactgatggtgatagacaagctgctcttgatgtattacgtcaagtaaatcaagaatttataaatgcagtacgttcaacaggtgacaataatgaaaaaagatatttattggtaagcggttatgctaatgatcctattttaactcaagataacttttataaaattccaagtgatccatcccataaacttttagtttctctttattattatgttccaaatcatttcactactattgataattattatacttggggttcacaagaagatgttaaacaacttcaaacaataatgaaaaatcttagtattcgttttgttattcaaggtgttccagtgattataactagatatggtacaattgttaaaaatagaagttcagcaaatattaatagttatttaac

SEQ ID NO: 17548 - DNA, 942 bp, Neocallimastix californiae
  Cellulase
tgaaaatgatgaacccgttagaattgctggtgttaactggttcggaacagaaactgctcaattatccccacatggtttatggagtaaaaatttaactgaaattttatatttaattgtagaccatggttataatactattagatatccatattgtaatgatatctttaaaccaggagcaagtacagtttctattgaatattatagaaatccttgggctaaaggtttatctccacttgaagttatggatgttgttattagagaagcaacagatttaggtttaaaaattatcttagatcgtcatagaccagattttcaagctcaaagtgctttatggtatactagtgccgtttctgaagaacaatggatttcagactggcaaaaattagctaaacgttacaaggataatagtggtgttattggtgctgatttacataatgaacctcatgatgaggcttgttggggttgtgatgacatttccattgattggcgtttagctgcagaaagatgtggtaatgctattcatgaaattaatcctaactggttaattattgttgaaggaattcatcatattggtgaaacttgttggcaatgtggtgataactactggtggggaggatatttaaagaaaggtgtggttgatattattaataaacctgtcaatttaaagattccaaatcgtgttgtttattctactcatgattatccaagagaagttttcccacaaacttggtttgatgatccaactttcccagataatatgccagacaaatggtacaattattggtcttggattaagaaggataatattgctccaatattagtcggtgaattcggaaccaaattggaagatgattgggatagagtttggttaaagactcttgttaactacatgaaggaaaatagacttcattggaccttctggtgtcttaatgagaatagttc

SEQ ID NO: 17549 - DNA, 1465 bp, Neocallimastix californiae
  Cellulase
gaaggcttctcttgctctaactgccattgctgctcttgccgctaaggcttctgctgcttgctggtctgaagcttatggttacccatgttgttcctctgccagtactaaggttatttacaccgatagcgatggtgaatggggtgttgaaaacggtaactggtgtggtatttcaaaggatgatccaagaggaggctgtttctctgatactttaggttacccatgttgtactagtaccactaatgttatctacactgatagctacggtcgctggggtattgaaaacagtaattggtgtattcttgatgattcatctaacccaggttatggtagtgatgactacactgttggttcccaatactctctctctggtaacccattcgctggtcacaagttctacgttaatccatactacgttgataaagttgacaaggccattgctcaaatgcacgactacgacagttcacttaaatttaaggccgaaaagatgaaggaatactctaacgctatttggttagataccattaataacatggaagcctggttagaaagaaaccttaagggtgctcttgctcaacaaaatgccgaaggtagtagagttttaactgtcttcgtcgtttacgatttaccaggccgtgactgtcaggctcttgcctccaacggtgaacttctcgccaacaatggtgatatgaaacgttacaaatctgaatacattgatatcattgatagacgcttatctacttacaagtctcaaccaattgttcttgttattgaaccaaattcccttgctaacttagttactaaccttgaaaacattccagcttgtgctgactctgaaaaatactacttagatggtcacgcttacttaattaagaagttcggttcccacccacacgttgccatgtacctcgatattggtcacgctttctggttaggttgggatgataaacgtgctagtgccgctaagatttactctaaagttattaaccctggtgctccaggtaaagttcgtggtttcgcttccaacgtcgctaactacactccatgggaagacccagaactttctcgtggcccagacactgaatggaacccttgcccagatgaaaagagatacatcaaagccatgtacaaggaattcaaggctgccggtatctcctctgtttacttcattgaagatacttctcgtaatggtcacaagacttaccgtaaccactcaggtgaatggtgtaaccaaatgggatctggtattggtgccagaccaaaggcttatccagtttccggtatggaatatctagatgctttctactgggttaaaccatacggtgaatctgatggtacttctgatgaatctgataagagttttgatggttactgtggtcacgcaaccgccatgaagccagctccagaagccggtcaatggttccaaaaattcttcgaagaaggtcttatgaatgctaacccaccactt

SEQ ID NO: 17550 - DNA, 822 bp, Neocallimastix californiae
  Cellulase
tgaatctggtgcagaatttggagaaggaaaataccctggggtatataataccgattatatttatccagatgtcaaagctattcaagcctctattgatcaaggtatgaatattttccgtgttggtttttcatgggaacgtatgcaaagaacattaaattcagcctttgatactacagaatttaagcgtttggatgaagtgattagttacattactaaaaatggagcagtcgctattcttaatccacataacttcgctagatatagaaatagtgttgttggttccagtcaagttccaaattccgcctttgctgatttctggaaaagaatggctgataaatataagagtaataataaagtttggtttggattagtgaatgaaccccatgacatgccaaccgaacaatggttctctgctgcacgtgatgctgtcaatgctattcgtaaagcaggagcgaataataatgtattagttccgggtaattcctacacaggagcatggtgctggacgaaaacacattatggatcaccaaattcaaaagtagcacttgaatattttaatgcttccgataaaaatattatttatgaagttcatcaatattttgatagtgattattctggtacgcatgagcaatgtgtacaacgtccatgtaataaacttttcactgattttgttgattggttaaaagaaaataatttgaaaggtttcgttggtgaacttggagcagctatcaataatgactgtaaagcctgtgtagaagaagccttaaactatttagaaaagaattctgactatgttgttggttggacttggtgggcagctgg

SEQ ID NO: 17551 - DNA, 933 bp, Neocallimastix californiae
  Cellulase
agaccagaaaggtcgtaatgttaaattagctggtatttcatggttcggaggagaaactgataatctttctccacatggtttatggtcaaaatcgttagctcacttcattaaggttattaaggataatggctataatcatattcgttacccatggactaatgaaatgcttctctcaggtgccagaactaaatctattaatgctatggaaaatccggatcttgctaatcttacaccattagaagttatggatgccgttattaatgctgctggtaaggcaggtttaaaggtttaccttgatcgtcatagaccaactgcagctggtcaaagtgaactttggtatatttctaaagtggatgaaaagaaatggattgaagattggaaattccttgctaagcgttacaagggtaatccaacagttatcggtgctgatattcataatgaaccccatggtactgcttgttggggttgtggagaaactaagcgtgattggagacttgctgctgaaagatgtggtaatgccattcatgaagtaaatcccgattggcttattattgttgaaggtaatgatcattatggtgaagaaggttggcaaaagggtgaatcctactggtggggaggtatgttaaagggtgttaagcaataccctgttagattaaataagaagaacaagcttgtttattctgcacatgattatgataagaatgttcatttacaagattggtttaaggtatctaacttcccagacaatatgccatctatttgggatgataaatggggttacattgcaaaacaaaatattgcaccagtacttattagtgaatttggttctctcttaaaggataaaactgatgtaaaatggttacaaaaccttatttcttatatgaataagaatggtgttcattggactttctggtgtctaaatccaaattcagg

SEQ ID NO: 17552 - DNA, 1483 bp, Neocallimastix californiae
  Cellulase
gaaggctagtattgctttaactgctattgctgctcttgctgctaaggtttacgctgttccaccaagctgtttctccttaaagttaggttatccatgttgttctaatgctagcactccatctgtctatgaagattctgatggtaaatggggtgttgaaaatggtaactggtgtggtattccagaacaagtaaaagtatgttggtctgaaaaattaggatatccatgttgtacttctactagtgtttctgtctttgaagataatgatggtaaatggggtattgaaaacggtaactggtgtggtattattaatggtccaactccaactccaactccaactccaaaaacaactccaaatccagaaccaactattgacccaactcaatacaagatcaatggtaacccattcaagggtgttgatttctaccttaacccatactacgttgaagaagttgaaaatgctcttaacaatcttattgattcttctcttagatcaaaggttgaaaagatgaagactttctctaatgctatctggcttgataccattaataacatgcaaagttggttagaaccaaaccttaagggtgctcttgctcaacaccaatctactggtaaggatgtcttaactgtctttgttgtttacgatttaccaggtcgtgattgtcacgctcttgcttccaatggtgaacttcttgctaacgatgctgatgctcaacgttacaagaccgaatacattgatgttattgaatctcacttaaagcaatacactgctcaaccagttgttcttattattgaaccagattcacttgctaacatggttactaaccttgatgatccacactgttctcaatctgaatcctactatatggatggtcatgcttacttacttaagaagtttggtgttcttgaccacgttgctatgtaccttgatattggtcacgctttctggttaggttgggatgataaccgtgaaaaggctgctaagctttacaagaaggttattgactctgcttctccaggtaaggttcgtggtttcgttgataatgttgctaactacactccatgggaagacccaactctttctcgtggtccagatactgactggaacccatgtccagatgaaaagagatacttagaagctgttaagaaggactttacttctgctggtattaagtctgtttacttcgtcagtgatacttctcgtaatggtcacaagaccgaccgtaagcacccaggtgaatggtgtaaccaaactggtgttggtgttggtgctcgtccacaagctagtccagtttctggtatggattaccttgatgctttctactggattaagccacttggtgaatctgatggtacctctgatgaatctgctgttcgtttcgatggttactgtggtcacgataccgctatgaaaccagctccagaagccggtcaatggttccaagctcacttcgaacaaggtgttgaaaacgctaacccaccactc

SEQ ID NO: 17553 - DNA, 1462 bp, Neocallimastix californiae
  Cellulase
gaaatctactgttgctttaactgctgttgctgctcttgctgctaaggcctctgctgcttgctggtctgaaaatttaggttataaatgttgttcaagtgccaacgctccaattgtttacactgatagtgatggtaactggggtgttgaaaacggtaactggtgtggtattccagttccagaaacttgctgggctgaaaaattaggttactcttgctgtacttctacttctcaagttgtttacactgatggtgatggtaactggggtgttgaaaacggtaactggtgtggtattattactggtttaactccaactccaggtccaagtccaaacccagatccaactccagacaacactcaattcaagatcagtggtaacccattcaagggtgttgatttctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaaccttaagggtgctcttgctcaacaccaatctactggtaaggatgtcttaactgtctttgttgtttacgatttaccaggtcgtgattgtcacgctatggcttccaatggtgaacttcttgctaacgattctgatgctcaacgttacaagactgaatacattgatgttattgaaagtcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatggattaccttgatgctttctactggattaagccacttggtgaatctgatggtacctctgacgaatctgctgatcgtttcgatggttactgtggtcacgataccgctatgaaaccagctccagaagccggtcaatggttccaaaagcacttcgaacaaggtcttgaaaacgctaacccaccactt

SEQ ID NO: 17554 - DNA, 1462 bp, Neocallimastix californiae
  Cellulase
gaaaactactattgctttaactgctgctgctgctcttgccgctaaggtttctgctgcttgctggtctcaaagtttaggttactcatgttgtacaaatgctagcactccagttgtttactctgataatgacggtgactggggtgttgaaaacggtaactggtgtggtattccagttccagaaacttgctgggctgaaaaattaggttactcttgctgtacttctacttctcaagttgtttacactgatggtgatggtaactggggtgttgaaaacggtaactggtgtggtattactactggttcaactccaggtccaagtccaagtccaaacccagatccaactccagacaacactcaatacaagatcagtggtaacccattctctggagttgaattctaccttaacccatactacgttgaagaagttgaaaatgctattaagcaaatgactagctcttctcttaaggctaaggctgaaaagatgaagacttactctaacgccatctggcttgataacattaagaacatgcaaagttggttagaaccaaatcttaagggtgcactttcacaacaccaatctactggtaaggatgtcttaactgtctttgttgtttacgatttaccaggtcgtgattgtcacgctcttgcttccaatggtgaacttcttgctaacgattctgatgctcaacgttacaagactgaatacattgatgttattgaaaaacaattaaagcaatacactgctcaaccagttgttcttattattgaaccagattcacttgctaacatggttactaacattgaaaccactccagcttgtgctgaatctcaagattactacttcgatggtcacgcttacttacttaagaagttcggtgttcttgaccacgttgctatgtaccttgatattggtcacgctttctggttaggttgggatgataaccgtgaaaaggcctctaaggtttacaagaaggttattgactctggttctccaggtaaggttcgtggtttcgttgataacgttgctaactacactccatgggaagacccaactctttctcgtggtccagaaactgaatggaacccatgtccagatgaaaagagatacttacaagctatgtacaaggactttaccgctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatggttactgtggtcacgataccgctatgaaaccagctccagaagccggtcaatggttccaaaagcacttcgaacaaggtcttgaaaatgctaacccaccactc

SEQ ID NO: 17555 - DNA, 858 bp, Neocallimastix californiae
  Cellulase
caagcaatatgaaacggcttggggtaatcctgtaaccaccgaagaaatgattaagggtgtaaagagttatggtttcagtacagttcgtattccagttgcatggagtaatcttatgtcttctaattatactattagtcctttgttacttaatagagttgaagaagttgtcaattacgtcgtcaaaaatgatatgtatgctattgtaaacattcattgggataatggctggttcacaaaatttgctactgatgaagaagaagcttttattaaatataaaaggatctggggacaaatatctgaacattttaaggattatgatgaacatttgatttttgaatctttaaatgaagaaggttgctgggaatcaatttggaataattattcaaatgaaggtgataaacctaaagcttttggtcttttaaatactattaatcaaaactttgttgatattttccgtaactctggtggatataatgctgaaagattcttacttttagctggttattgtactggtattgatcacactatcgataaaaattatattcttccaaaagatgataaagttatggtttctgttcattattatggcccttccacttttactattcttgaagaagatgccgattggggaaaagctgcttattattggggtactgaagaagaaatcaataatattactaatgatcttatcaaagtaaaaactcattttgttgataataatattcctgttattattggtgaatacggtactgctactacaaataaggatccagaaagtgttcgtaagtggttaagaactgttgcaggaaaggcaacagaattgggtatatgtccaattgtttgggatgctggccaata

SEQ ID NO: 17556 - DNA, 1468 bp, Neocallimastix californiae
  Cellulase
gaaggcctccattgctttaactactattgctactatcgctgctaaagcttctgctgattgtttctctactagattaggttatccttgttgttcaggaaataccgtcgcttatacagataatgatggtgattggggtgttgaaaatggtaattggtgtggtattggaaatacttcatcttcagcttcttgttggtctaccgctttaggttatccttgttgttcttcttcaagtgccgaagtttggtataccgataatgacggagcatggggtgttgaaaatggtgactggtgtggtattccaactggatcatcaggtggtaatactccagttaatccaggtaatgatggtaatgatgtcaatgttactccaggtgatcaatattctcataatggtaatccattcaaggatgttgaatttttcattaatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacatcagatgaaagtgcagctcgtttcgatggttattgtggacatgaaacagccatgaaaccagcaccagaagctggtcaatggttccaaaagcactttgaacaaggtattaagaatgcc

SEQ ID NO: 17557 - DNA, 1240 bp, Neocallimastix californiae
  Cellulase
ttggtataccgataatgacggagcatggggtgttgaaaatggtgactggtgtggtattccaactggttcatcaggtggtaatactccagttaatcaaggtaatgatggtaatgatgtcaatgttactccaggcgatcaatattctcataatggtaatccattcaaggatgttgaatttttcattaatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacctcagatgaaagtgcagctcgtttcgatggttattgtggacatgaaacagccatgaaaccagcaccagaagctggtcaatggttccaaaagcactttgaacaaggtattaagaatgccaatcctccactt

SEQ ID NO: 17558 - DNA, 1444 bp, Neocallimastix californiae
  Cellulase
gaaggcttccattgttttatctgctcttactgcttttactcttaaagcttccgctgattgtttctctaccagattaggttatccatgttgttctggaaatgatgttgtttacattgataatgacggtaaatggggtgttgaaaatggtaactggtgtggtattgccgatactccatctcaagctgcttgttggtcactttctcagggttatccatgttgctcttcatcaaatgctgaagtttggtacaccgatgcctccggtaaatggggtgttgaaaatggtgactggtgtggtattccaactggttctactggtggtgatgccactccaggtgaacagtacactcacaatggtaatccatttgctaataagattttctatattaacccatactatgttgaagaagtggatggtgctatcgctcaaatgtctgattcttccttgatttctaaggctgaaaagatgaagacttactccaatgctatctggcttgattccatcaaaaatatgcaaagttggttggaatcaaatttaaaaggtgctctctcccaacaaaatgcctctggtcaagatgttttaactgttttcgttgtctacgatttaccaggtcgtgattgtcatgctcttgcttctaatggtgaacttcttgccaatgatagtgattgggctcgttataagactgaatatattgatgtcattgaaggtcacttaaagacttacaaatctcaaccagttgttcttattattgaaccagattcacttgcaaatatggttactaatcttgattctactccagcttgtcgtgattccgaaaagtattacatggatggtcatgcttatttaattcaaaagtttggtgttcttcctcacgttgctatgtatcttgatattggtcacgccttctggttaggttgggatgataatcgtcaaaaagctggtaaggtctactccaaagttatcagctctggtgctccaggtaaggttcgtggattcactgataatgttgctaactacactccatgggaagatccaactctttctcgtggaccagaaactgaatggaatccatgcccagatgaaaagagatatttagaagctatgtataaagactttaaggccgctggtattgaatccgtttacttcgtttgtgactcttctcgtaatggtaagaaagttgatcgtaaacacccaggtgaatggtgtaaccaaactggtgctggtgttggttatagaccacaagccaatccaatttcaggtatgagttatcttgatgctttctactggattaagccacttggtgaatccgatggtacttctgatgaaagtgcagctcgtttcgatggctactgtggacatgaaactgccatgaaaccagctccagaagccggtcaatggttccaaaagttctttgaggaaggtcttaagaatgctaatccagctctt

SEQ ID NO: 17559 - DNA, 1285 bp, Neocallimastix californiae
  Cellulase
tgatgttatttacactgatactgatggtgaatggggtgttgaaaactatgactggtgtttcattgacagcaatcgttgtcatggaggaggtaactgtagcccagctttccaaagccaaggttaccaatgttgtagcaacaacaattgtaatattgtttaccaagatggtactggtaactggggtgttgaaaacaaccaatggtgtggtctttcctacaactgtggtaacactccaactactagaactactactagaactactactagaactactactactaccactagaagaccagctcaaactagtgataacttctttgaaaatgaactttacagtaacttcaagttccaaggtgaagttgatacatctattgctaaattaagtggtcaattacaagaaaaggctaaaaaggttaagtacgttccaactgctgcttggttagcttgggaaggtgccactaatgaagttccacaataccttaatgaagctggtgacaagactgttgtctttgtcttatatatgattccaactcgtgattgtaacgctaatgcttctgttggtggatctggtagtttagacaagtacaagggttatgtcgacaacatttacaacactattaacagatatccaaattcaagaattgttatgattcttgaaccagatactattggtaatcttgttactgctaacaatgataattgtagaaacgttcaaaacatgcacaaacaagctctttcttacgccattagtaaattcggtactcaaagtaatgttagagtttatcttgatgctgctcacggtgcttggttaaattcacacgccgatagaactgctcaagttattgctgaaatcttacgtaatgctggtaatggtaagattcgtggtattagtactaacatttctaactaccaacaagttagtgatgaataccaatatcaccaaaaccttaacagagctcttgaaagccaaggtttcagaggtatgaaattcattgttgatacttctcgtaatggtcaaaatgttactgctgccttctctagaaacaacacctggtgtaacttcaagggtgctggtttaggtccacgtccacaagccaatccaaatccaaacatgcctttacttgatgcttacatgtggattaaaactccaggtgaagctgatggttctgctactggttctagagctgatccagtttgtgctagacaagattctcttcaaggtgctccagatgctggttcatggttccacgattactttgttatgttattacaaaacgctaaccca

SEQ ID NO: 17560 - DNA, 1123 bp, Neocallimastix californiae
  Cellulase
gtgtttcattgatgaaaataaatgtagttcagctattagcaaatgtagatttgaatctcttggatatccatgttgtagtcattgtaatgttatttacactgatgatgatggtaactggggtgctgaaaatggtcaatggtgtggtattccagaaaactgtggatctactgaaccaactaaaccagaacgtaaatttgaaaacttcttcgaaaatgaactttacattaaccaagattacgttaaaaagattgaatctactttaaaggatatgactccagaattacaagctaaggctaagaatgttgaaaaggttgcaactgctgtttggttagcttgggaaggtgctccaggtgaagttgaaccacaccttaaggctgctggtaacaagactattacctttattctttacatgattccaactcgtgactgtaatagtttagcttcagctggtggtgctgctgattttgaaaaataccaaggttatgttgacagtattgctgctactattaagaaatacccagatgctaaggttaacatggttattgaaccagatactcttggtaaccttattactggtgaaactgaagcttgtaagaaggttcatgacttacacagaaaagctttatcttacgccgttaacgttttcggtaacatgagtaatgttaatgcttatcttgatgctgcccaccacaaatggttaggttggggaacagacaaggttgctgctctcattaaggacattttagataatgctccagatggtgatattcgtggtattagtactaatgtttctaactaccaatccattgataatgaataccaataccacactgaccttcacgctgctcttgaagctgtcggtattactggaaagaaattcattgttgataccggtcgtagtggtgttgatgttactgaagaattcaatgttaaccaaacctggtgtaaccttatctacgctggtttaggtgaaaaatctcgtggtaacccagatccagaaaagtacccattattagatgccttcatgtggcttaaaccaccagcagaatctgatggttctgatgttggtagcagagctgatccagtttgtgctcgtgaagattcattcccaggtgctccagac

SEQ ID NO: 17561 - DNA, 306 bp, Neocallimastix californiae
  Cellulase
caacttcattttcccagaagatgatgataaggttattgcagccgtacatgcttactctccatataactttgccttaaacaatggtgatggagctgttgatacttttgattcagctggtaagaacgaacttgattggaacattaacttaatgaaaaagagattcgttgatcaaggtattccaatgattcttggtgaatatggtgctatgaaccgtgataatgaagaagaacgtgccaaatgggccgaatattacatggaaaaggttacagctttaggtattccacaagtttggtgggataatggtat

SEQ ID NO: 17562 - DNA, 1537 bp, Anaeromyces robustus
  Cellulase
gaagactgcttttgctttaactgctgttgctgctcttgctgctaaagtttatgctgttccaccaagctgtttctctgttaaattaggatacccatgttgttctagtgccaatgttccagttgcttacactgataatgatggtaactggggtattgaaaatggtgattggtgtggtattccagaagttgaaacttgctggtctgaaaaattaggtttcccatgttgttcatctccaagtgctccagttcaatacactgatgctgatggtaaatggagtgttgaaaatggtgactggtgtggtattccaaagtctggtggttccggtggttctggtggttacaatccaggaggttctggtggttataatccaggaggttctggttccggttctggttctggttctggtaatggtgattataccattggtagtcaatacagacacaatggtaacccattcaaaggtgttgaattcttcattaacccatactatgttgatgaagttgataaggctattgctcaaatgaccaactcatctcttaaggctaaggctgaaaagatgaagactttctctaacgctatttggctcgataccattaagaacatgaatgaatggttagaaagaaaccttaagggagctcttgctcaacaaaacgcttctaacaagaatgttttaactgttttcgttgtttacgatttaccaggtcgtgattgtcacgctcttgcttctaatggtgaacttcttgctaatgattctgactttgctcgttacaagtctgaatatattgatgttattgaaactcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatggttactgtggtcacgataccgctatgaaaccagctccagaagccggtcaatggttccaaaagcacttcgaacaaggtcttgaaaatgctaacccaccactc

SEQ ID NO: 17563 - DNA, 1252 bp, Anaeromyces robustus
  Cellulase
tgatgttatttacactgatactgatggtgaatggggtgttgaaaactatgactggtgtttcattgacagcaatcgttgtcatggaggaggtaactgtagcccagctttccaaagccaaggttaccaatgttgtagcaacaacaattgtaatattgtttaccaagatggtactggtaactggggtgttgaaaacaaccaatggtgtggtctttcctacaactgtggtaacactccaactactagaactactactagaactactactagaactactactactaccactagaagaccagctcaaactagtgataacttctttgaaaatgaactttacagtaacttcaagttccaaggtgaagttgatacatctattgctaaattaagtggtcaattacaagaaaaggctaaaaaggttaagtacgttccaactgctgcttggttagcttgggaaggtgccactaatgaagttccacaataccttaatgaagctggtgacaagactgttgtctttgtcttatatatgattccaactcgtgattgtaacgctaatgcttctgttggtggatctggtagtttagacaagtacaagggttatgtcgacaacatttacaacactattaacagatatccaaattcaagaattgttatgattcttgaaccagatactattggtaatcttgttactgctaacaatgataattgtagaaacgttcaaaacatgcacaaacaagctctttcttacgccattagtaaattcggtactcaaagtaatgttagagtttatcttgatgctgctcacggtgcttggttaaattcacacgccgatagaactgctcaagttattgctgaaatcttacgtaatgctggtaatggtaagattcgtggtattagtactaacatttctaactaccaacaagttagtgatgaataccaatatcaccaaaaccttaacagagctcttgaaagccaaggtttcagaggtatgaaattcattgttgatacttctcgtaatggtcaaaatgttactgctgccttctctagaaacaacacctggtgtaacttcaagggtgctggtttaggtccacgtccacaagccaatccaaatccaaacatgcctttacttgatgcttacatgtggattaaaactccaggtgaagctgatggttctgctactggttctagagctgatccagtttgtgctagacaagattctcttcaaggtgctccagatgctggttcatggttccacgat

SEQ ID NO: 17564 - DNA, 933 bp, Anaeromyces robustus
  Cellulase
tgacgaaaaaggtcgtaaagttaaattagctggtatatcttggtttggtggtgaaactactaacctttcaccacacggtttatgggctaagccattatctcacttcattaaaattattaaggatcttggttataaccatattcgttacccatggactaatgaaatgctcttcccaggtgccaaaactcaatctgttgatcaattacaaaatccagatcttgctgatcttactccattagaagttatggatgctgttattgatgcttgtggtaaagctggtattaaggtttatctcgatcgtcacagacctctttctggtggacaaagtgaattatggtatgttgctaaagtagatgaagataaatggattgaagactggcaattccttgctaagcgttacaagggtaatccaactgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagtttctaacttcccagacaacatgccagaaatttgggatgataaatggggttacattgctaaagaagacattgcaccagtacttattggtgaattcggttctcttttaatggataataaagatgttaaatggttacaaaatttaatttcttacatgaacaagaatgatgttcactggactttctggtgtttaaatccaaattccgg

SEQ ID NO: 17565 - DNA, 930 bp, Anaeromyces robustus
  Cellulase
tgaaaagggtcgtgctgttaaattagctggtatttcatggttcggtggtgaaactactaacctttctccacacggtttatgggctaaaccattaagtcatttcattaaaactattaaggatcttggttataaccatattcgttacccatggactaatgaaatgtttaaagaaggagctaaaactgaatctgttgattccgtcaataacccagatcttgctgatttaactccattagaagttatggatgctgttattgaagctgctggtgctgctggtattaaggtttaccttgatcgtcacagaccacttgctggtggacaaagtgaattatggtacattgatgaagttccagaatctcaatggattgaagactggcaattccttgctaaacgttacaagggtaacccaactgttattggtgctgatcttcataatgaaccacacggtaccgcttgttggggttgtggtgaagaagttcgtgattggagacttgctgctgaaagatgtggtaatgctattcatgaagttaacccagactggcttattattgttgaaggtaatgatcactatggtgaagaaggatggcaaaagggtgaaagttactggtggggaggtatgttaaagggtgttaaggaaaacccagttagattgaaggttccaaacaagcttgtttactctgcccacgattacgataagaatgttcacttacaagattggttcactacttctgatttcccagacaacatgccagaaatttgggatgataaatggggttacattgttaaggaagatattgctccagttcttattggtgaatttggttcagtcttaagagatgctgttgatgttaaatggttaactaatttagttacctatatgcatgaaaatggtgtccactggactttctggtgtttaaatccaaactctgg

SEQ ID NO: 17566 - DNA, 1120 bp, Anaeromyces robustus
  Cellulase
gaagactgtatttgctttagctgctattgctgcacttgcctctaaagtttctgcggcaagttgttgggcaaatagacttggttaccaatgttgtaaaggtaatactgtagtatacactgatagtgatggaaaatggggtgttgaaaatggtaattggtgtggtatcgtagatggaactcaacaaaatgccacttgttggtctcaacctcttggttacccatgttgtcaaagtacaagtgatgttatttacactgatagtgatggtgactggggtgttgaaaatggtaattggtgtggtataattaaaggtggtagcactggtggtggtactggtggtggtagtaccactccaggagaacaatacactatttctggtaacccattctctggtgttgaattttacattaatccatattatgttgaagaagttgataatgccattgctcaaatgactgattcttctcttaaagctaaagctgaaaaaatgaaaacttatccaaatgctatttggcttgataacattaagaacatgcaaagttggttacaaccaaatcttgaaaaagctcttgctcaacaatctggtagtaaaaaggttttaactgttttcgttgtttacgatttaccaggtcgtgattgtcacgctatggcttccaatggtgaacttcttgctaacgattctgatgctcaacgttacaagactgaatacattgatgttattgaagaacaattaaagaaatacaaatctcaaccaattgtccttattattgaaccagattcacttgctaacatggttactaacattgaaaccactccagcttgtgctgaatctcaagattattactttgatggtcatgcttacttacttaaaaaattcggtgtcttacaacatgttgctatgtaccttgatattggtcacgctttctggttaggttgggatgataaccgtgaaaaggctgctaaggtttacaagaaagttattgattctggttctccaggtaaggttcgtggtttcgttgataacgttgctaactacactccatgggaagacccaactctttctcgtggtccagatactgaatggaacccatgtccagatgaaaagagatacttagaagctatg

SEQ ID NO: 17567 - DNA, 870 bp, Anaeromyces robustus
  Cellulase
agttaatcaatttgaaactgcttggggtaatccagcagcaacaaaacaattaattactgcaattaaaaattctggtttcaatagtattcgtattccagttgcctggagtaatcttatgagttctgattacactattagttcagaattattaaaaagagttaatgaagttgttagttgggttattgatagtaacatgtatgctattattaacattcactacgatggaggttggattgaaaaattcggtactagtgaatctactatggctaataataaattcaataaaatttggactcaagttgccgactatttcaaaaactatggtgaacatttaattttcgaatcattaaatgaagaaggttgttggaacgatgtttggaatcgttatagtaactctggtgataaaaacaaggcttactctactttaaataacattaaccaacaatttgttgatattgtacgtaaatctggtggtaacaacaaatccagacatttacttatagctggttattgtaccgatattgacttaactgtcgattcagctttcaaaatgccaactgattctgccaatagaatgatggtttctgttcactattacactccatctactttcactattcttgaaaaggatgaaagttggggtaaatttgctggtacttggggtactgatgctgaagttaatgcccttcttgctgatttcgataaacttaagaaacgttttgttgataatggtgttccagttattattggtgaatatggtaccgttttaactaacaaagataaggacagtgttcacaaatacttattcacttgtgctcaatatgctacaagtttaggtatgtgtccaatgctttgggataatggtgatca

SEQ ID NO: 17568 - DNA, 1378 bp, Anaeromyces robustus
  Cellulase
gaaatttgttaatttattatcttcaactttatttgctttaggagctttagcttcttcttgccacccaaattatccatgttgtaatggctgtgaagttgtttacactgatgtagacggagaatggggtgttgaaaatggtgcttggtgtttacttcaaccttctaaatgctatgatacttgtaatacagaaagtttaggttatccttgctgtacccattgtaatactatttacactgatgcagatggtgattggggtattgaaaatggtgattggtgtggtattaataatagttgtaatggtggtggtcaacgtccaccacaaaatccaactcctattcgtactactactactactactactacaaagaagacttacccaactgttaatccttccttcttcagtggaaatatttacagtaattaccaatatcaatctgaagtccaatcttctattaacaaattaagtggtaatttacaacaacaagctaatagagttaaatacgttccaactgctgtttggttagcttgggatggtgcaccaaaagaagttcaaagacaccttagttccgctaatggcagtactgctgtctttattatgtactggattccaactcgtgattgtaacagtaatgcttctcaaggtggtgctaatgatttaaatgcttacaaatcttatgttgatgatgttgctaatacctttagatctaatcaaggtagtagaattgttattgttgttgaaccagatactattggtaatatggttacttctcaaaacaatgaaaattgtagaagaactgcagttattcacaaacaagctcttgcttatgctgttaatagatttggtagtcttaataatgtacaagtttatcttgatgctggtcacagtcaatggttaactggttatgaagatgaaactgctgctgttattaaggaaattttagatatggctaatcaaggtaagattcgtggtttctctactaatgtttctaacttccaaccaattgataaggaatacgaatatcaaactagactttatgatgctcttgaaaatgttggtattactgatatgagatttgttattgatactagtcgtaatggtcaagatattagtgaagctttcgctaaaactaaaacttggtgtaatttagttggtactggttttggtgaacgtccaaagggtaatccagatccaattaatatgccattattagatgcttacatgtggttaaaaccaccagcagaatctgatggttcttctcaaggtatgcgtgctgatccagtttgtgctcgttctgattctcttccaaatgctccagaagctggttcatggttccatgactatttcgttcaattattgagaaatgccaatccaccattt

SEQ ID NO: 17569 - DNA, 825 bp, Anaeromyces robustus
  Cellulase
taacgaatccggtgctgaattcggtcaaggtaaatatccaggtgaatacaataaagattatatttacccagatgttaaagcaattcaagcttcaattgatcaaggtatgaatgttttccgtattggtttttcatgggaacgtttacaaagaagtttaaatgctgaacttgattcaactgaatttgatcgtttagatgaagttgttagttatgttactaaaaatggtgctgtagctattcttaatccacacaattttgctagatataacggtcaaattgttggtacaagtcaagtaccaaattctgctttcgctgatttatggaaaagaattgctcaaaaatataagagtaataataaagtttggtttggtttagttaatgaaccacatgatatgccaactgctcaatggttctcagctgctcgtgatgctgttgatagtattcgtgctcttggtgctaataataatgttcttgtaccaggtaatgcttatactggtgcttggaattggaaagaaactttttatggagattctaatgcttctacagctcttatatatttcagttcttctgataaaaatattatttttgaaactcatcaatatttcgattctgattattcaggtactcataaagaatgtgttcaacgtccatgtaataaccttttcaaaaacttcgtagaatggttaaaagctaataatttaaaaggttttattggtgaattaggtgctgctattaatgatgattgtaaagcatgtgttgaagaagctattacttatttagaacaaaattctgattatattgttggttgggcctggtgggctgctgg

SEQ ID NO: 17570 - DNA, 1402 bp, Anaeromyces robustus
  Cellulase
gaagacttctgttattttaactattattggagcaattgctgctaatgtttctgcaacttgtgatattgaaaaaaaattaggttatccatgttgtagtaataaaaatggtaaagttgtatataaagatgaaaatggtaattggggtgttgaacatcatcaatggtgtatcttctcagataatactgatgaaacaaaatgttggtctaatgaattaggttacccatgttgtaaatctactactgaaattgttttcactgatgatcgtggtaattggggtgttgaagataagaaatggtgtggagttattgttgatgaaactaaaccagttgaagaagttaagaatgtatggacttctaataatgttaatccatttgctgaaagtgaattatatgttgatccaaattaccaacaagaacttgataatcttagttcaactataaaggatccaactgttattgaaaaagttgaaaaaatgaaacaatattctactggtatttggttagattctattcaatctgttaatgaattattagaaagtaatttagataatgcttatgctcaacaagtagaaagtggtaaaaatgttttaactacttttgttctttataatttaccaggtcgtgattgtcatgctattactacaaatggtgaacttcttgctaaagattctgatttagaacgttataagcatgaatatattgatgttattgaagaaattataaagaaacataataatcaaccaattgcttttgttgttgaaccaacttctcttccaagtatagctacttttaaaaaaagtactccagcttgtgctgatacagaaaaatattatttagaaggtcattcttatttaattaaaaaacttggtgtattaccaaatgtctttttatatcttgatgttggtcatgctttctggttaggttgggatgatcttcgtgaagaaactgctaaactttatgctaaagttattcaatctggtgctccaggtattgttcgtggttttgctgataatatttcaaattatgttccatgggatgatgctaatcttactaatggtccaaatactgaatataatccatacccagattcaaaaagatatattgaatctttacgtaaagattttgtaagtgttggtattaaaaatgttaatttcatttctgatacttcccttaccactattaataatggttctagtcctgttgaagattggtgttataatgctcctcttggtattggtgctcgtccacaagctaatccagtttcagatatgtcttatcttgatgcttttgtttggattaaaccattctatggtgataaaccatatgattctttatgtcttgaagaaagattaaatactaaaagattatttgaaaaatctgtcaagaatgctaacccaccactt

SEQ ID NO: 17571 - DNA, 774 bp, Anaeromyces robustus
  Cellulase
ttttaaactttggactgattctgaagtaaaaattaaggaagctgtagaaggttataaaaatttaggttttcattccattcgtatacctgtaaaatggtcaactcgtccaacaactaaaacaccaattgaaccaaaattattaaaagcagtagaagaagttgttcgagtagctattgaaaatgatatgtatgttattattaatttagaaacagataatttttatatgaatggatttatttcagaagataaagctattcttactgaaacttatgatagttataaaggaacttggaaacaaatcgctaattattttaaagattatgatgaacatttaatgtttgaagcattaaatgaatcaggttattgggaaactatatggaatactcgtacagctgatggtgatagacctgaagctctcgctgttttacttaaagtcaatcaagaatttataaataccgttcgttctattgaaggatataatcaagaaagatatttattaattgaaggttatgcttgtgatccaattttaactcaagatcacttttataaaacacctagtgatccaaaaagttcaggaaaacttattgtttcactttattatttcattccttacacatttactgttatagaaaagtatggtatatggggatcttcatatgatgttcatcaacttcaagaagttgttgatgatctcagatatcgttttgttattcaaggagttccagtcatttttacaagatatggtacaaatattagaaatagaaaaagagaaga

SEQ ID NO: 17572 - DNA, 861 bp, Anaeromyces robustus
  Cellulase
tgaagcttatgctaaacataatcttaatgttgtaagagcttgggctttctgtgatgaatgtgaagatgcaacaagattagttgatttttctggtccagaggttaaacttaatagtgaaaatatggaaaaggttgattattatcttgctgcagctgctcaaagaaatattcgtgttgtattaactcttactaataactggactgattacggtggtatggatgtttgggtcaaacaattcggtggaaaatatcatgatgaattctatactaatagaaaacttattgaaggttacaaacaatacattaaagctatgattaaccgtgttaatacttataccggtcaaagatacaaggatgatccaaccattttttcatggcaacttgctaatgaagctcgttgtaataatggacctcatggtcttccagttaaagattgtaatactgatactattactaaatggatggatgaaatagctacatttattcatgaagaagatccaaatcatttggtctcttctggtattgaaggtattggtcttacaccaccggctggtgttgatccaaatacatatgtctatacttacgttgaaggtactgattatgaagccattagtgctcttgattctattgattataacactgttcatatgtacccagttggttggggtttaaaagattatgctaaggatggtgtaaaatggattcaagctcacgctgatgttgataaaaaattcaataaaccaactgttgttgaagaatggggtcttagtacatcagctgataatgtacctttagaagaacgtgatccaatttatactcaatggatggatgctgttttagctaatgataatattggtatgaa

SEQ ID NO: 17573 - DNA, 777 bp, Anaeromyces robustus
  Cellulase
taaacattatatttatccaaatattgaatccattcgtgcttctgttgaacaaggtatgaatgttttccgtatgggtcttagatgggaacgtttccaacatgaattatttggtgaatttagtgaatttgatgttactgaatataaaaaggttgttgatgctactacttctatgggagctgtacttatcattgatccacataattatgctcgttacaatgataatattgttggttctaaagaagttccaattgaagcctttgctgatttctgggctaaattagcaaatattttcaaagataatgaaaaagtatggtttggtttagttaatgaaccccatgatatggaaactgatgattggttcaaggcggctcgtgctgcagttgatgctattcgtgccactggtgctactaataatattttaattccaggtaatggatgggatggtgcatggagttggggtaaggaagcttggtatggtgaagctaatgctgatgttgctttaagatatttctcatctgaagataaaaatattatttttgaagttcaccaatactttgatgaagattactctggaactcatgacacttgtattcaacgtccatgtcaaaatcttcttaaagaatttgttgaatggcttaaaactaacaatttaaaaggttgggttggtgaaattggtggtactcttaatgatgaatgtaaagaatgtgttcatgaacttattgaatatcttcaagaaaatagagattatgttttaggtcttcaatggtgggcagctgg

SEQ ID NO: 17574 - DNA, 933 bp, Anaeromyces robustus
  Cellulase
tgatcaaaatggtcgtaaaataaagttagctggtatttcatggtttggaggtgaaactaataatctttctccacatggtttatgggctaagccattagatcattttattaaaactattaaggatcttggttataatcatattcgttatccatggacaaatgaaatgcttacaccaggagctaaaacaaattcaattgattctacaagtaatccagatcttgttaatcttactccattagaagttatggatgctgttattaatgcctgtggtaaagttggtcttaaagtttatcttgatcgtcatagacctcaatctggtggacaaagtgaattatggtatattccagaagtagatgaaagtaaatggattgaagattggcaatttcttgctaaacgttacaagggaaatccaactgttattggtgctgatattcataatgaacctcatggtgaagcatgttggggatgtggagaaagtaaacgtgattggaaagctgctgctgaaagatgtggtaatgccattcatcaagttaacccagattggcttattattgttgaaggtaatgatcattatggtgaagaaggttggcaaaagggtgaatcatactggtggggtggtatgttaaagggtgttaaagaaaacccaattaaattaaataaaccaaataaacttgtatattctgctcatgattatgataagaatgttcatatgcaagattggtttaaggaatccaatttcccagataatatgccaaccatttgggatgataaatggggtttcattgctaaacaaaatattgcaccagttcttattggtgaatttggttcccttttaaaagatgcaaccgatagtaaatggttacaaaatttagttacttatatgactaagaatgaaattcattggactttctggtgtttaaatccaaattctgg

SEQ ID NO: 17575 - DNA, 1347 bp, Anaeromyces robustus
  Cellulase
gaagtttttatctgtaatttctttgttaatcgctggagctcttgcttcaaattgtgatccacaatatccatgttgtaatggctgtgatgttaaatacactgataacagtggtaaatggggtgttgaaaataataattggtgtaaaatagataataataaatgtaattcaagtaaagctagttcatgtaaatttgaagctcttggttacccatgctgttcacactgtgagtctatttatgaagataattcaggtaaatggggtgttgaaaataataattggtgtggtattccagatacatgtgataataaaactccagacaataatactactccaattgcatcaaatgacgatccagataatttcttcaataataagatttactgtaaccaagaccgtaaagatcgtgttcaatcttctattaatagattaagtggtgaattaaaagctaaagcccaaaaaatccaagacgccccaacagctatttggttatcttgggataaagcaccagaaacagtttcgttccatcttgatgaagctggtaatcaaacagccgttttcattttatattggattccaactcgtgattgtaacagtatcgcctctcaaggtggtgctcaaagcatggatgaatatcacacttatgttaacagaattgttaacggtttcaaaagtcatccaaacagtaagatcgttgttgttgttgaaccagatactcttggtaatatgattacttctcaaagtaatgataattgtaaaaaggttcacaatcttcataaacaagctattgcttacgctattgatacctttggtcaaattgacaatgttcgtacttatattgatgctgctcatggtagatggttaggttcacatgctgatgaagcagctgctattattaaagaaattattgatatggcaccaaacagtaatgttcgtggtttatctactaatgtttctaactaccaaccaactgaagatgaatatgcttaccatcaaaaacttagcgctgagcttgaaaagcttggtgttcataatatgaaatttattgttgatactgcccgtaatggtgtagatgtcgcagaatctttagttaaaactggcacttggtgtaatgttaaaggtacaggttttggtgaacgtccaagaggttccccagacccagttaataaaccattattagatgcttacatgtggttaaaaccaggaggtgattctgatggttcatctactggtgatcatgctgatcctgtttgtgaacatgaagattctttaccaggagctggtgatccaggagattggttccatgaatactttgtacaattactcacaaatgccaacccaccaattga

SEQ ID NO: 17576 - DNA, 579 bp, Piromyces finnis
  Cellulase
gacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatca

SEQ ID NO: 17577 - DNA, 483 bp, Piromyces finnis
  Cellulase
aaatgaaccaagaaaagtcggggaccctgttgaatggacaggagatcaagaaggatataactttgttaatgaaatgaatgaagttttcattaaaacaattcgttccactggtggtaataatgctcttcgtcatcttatgattccaccatatgctgctggtgttatggatgcaagtcttaacactttcagagttccaagagatgatgataaaattattgtttcacttcattcctacagtccttataattttgctttaaataatggatctggcgccatttctaatttctatgatggtagtgaaattgattatgtcatgaatactattcatcaaagatatatcagccaaaatattcctgttattattggtgaattcggagccatgaatcgtgataatgaagtcgatagagctagatgggctgaatattatattaagaaggctacttctattggtgttccatgcgttttatgggataatgcttacta

SEQ ID NO: 17578 - DNA, 738 bp, Piromyces finnis
  Cellulase
aaatggaaaggctgtatttcttgaagataatatggaagctatcgattactttatagcagcagcatcacaaagaaatatcagattagttttaggttttactaataattggactgattatggtggtatggatgaatgggttaaaggttatggtggtaaatatcatgatgatttctatactaatacagatatccgtaaggcattcaaaagctatattaaattgttaattactcgtattaatcgtcataccaatattcgttatagtgatgatcctacaatattttcttggcaattagctaatgagccaagatgcggaaatggtccttctggacttcctcaatcaggtaaatgcactcctgaggttataactgaatgggctaatgatattagttcatatattaaagaactagaccccaaccacttagtatcagtcgggtgtgaaggttttggtcttgaagctccagagggatctaaaggattatatgcatacaaatatgatgaaggtactgattttgaggctttaacagcacttccaaatattgattataatacttatcattattatcctattccatggggaatgaaagatttagtttctcatactaaagattggattgaatcacatcaagctgtaggaaaaaaattaaataaaccagtagtatttgaagaatggggtcttgaaattccaactgactgttcaaaagaagaacgtattcaatattacaaaacatggacaaagca

SEQ ID NO: 17579 - DNA, 876 bp, Piromyces finnis
  Cellulase
agttgatttggctctcgaaacatatgctagacataaccttaatgttgttagagcatgggctttctgtgatgaatgtgaagatgcaacaagattagttgatttttctggtccagaagttacacttaacagtgaaaatatggaaaaggttgattattatcttgctgctgctgctcaaagaaacattcgtgttgttttaacccttactaataattggactgattatggtggtatggatgtttgggttaaacaattcggtggaaaatatcatgatgaattttacactaacagagatattgttaatggttacaaacaatatattaaggctatgattaatcgtgttaatacctatactggtcaatattataaggatgacccaactattttctcatggcaacttgccaatgaagcccgttgtaataatggtccacatggtcttccagtcaaaaattgtaatactgacactatcactaaatggatggatgaaattgcttctttcattcatgaagaagatccaaatcacttagtttcttctggtattgaaggtattggtcttactccaccagctggtgttgatccaaatacttatgtctactcatacattgaaggtactgattatgaagctattagtgctctcgactcaattgattacaatactgttcatatgtacccagttggttggggattaaaagattataccaaagatggtatgaaatggattcaagctcatgctgatgttgataagaaatttaataaaccaactgttgtagaagaatggggtcttagtacttctgctgataatgtaccacttgaagaacgtgatccaatttatactaaatggatggaaactgttttggaaaatgacaacattggtatgaa

SEQ ID NO: 17580 - DNA, 933 bp, Piromyces finnis
  Cellulase
tgatgaaaagggccgtaaagttattttaggtggtctctcatggttcggtggtgaaactactaacctttctccacacggtttatgggctaactctttagaaaacttcattaagatcgttaaggatcacggttacaatcaccttcgttacccatggactaacgaaatgttattcccaggtgccgaaactcaatctgttgaccaagttaacaacccagatcttgctaacctcagtccattagaagttatggatgccgttattgatgcttgtggtaaggccggtttaaaggtttaccttgatcgtcacagaccactttctggtggacaaagtgaattatggtacattccagaagttccagaagaacaatggattgaagactggcaattccttgctaagcgttacaagggtaacccaaccgttattggtgctgatcttcacaacgaaccacacagttctgcctgctggggttgtggtgaaatcgaacgtgattggagacttgctgctgaaagatgtggtaacgctattcacgaagttaacccagactggcttattattgttgaaggtaatgatcactatggcgaagaaggttggcaaaaaggtgaatcctactggtggggtggtatgttaaagggagctaaggaattcccagttagattaaacgttccaaataagcttgtttactccgctcacgattatgataagaatgtccacatgcaagattggttcaaggaaccagacttcccagacaacatggaaccaatttgggatgacaaatggggataccttgttaaggaaaacactgctccagttcttattagtgaatttggttccctcttaagagatgctactgatattaaatggttaggtaacttagttagctacatgaaggaaaatgatgttcactggactttctggtgcttaaatccaaactctgg

SEQ ID NO: 17581 - DNA, 870 bp, Piromyces finnis
  Cellulase
agttaatcaatttgaaactgcttggggaaatccagctgcaactgagcaattaattggagctattaaagataatggttttaacagtattcgtattccagttgcttggagtaatcttatgagttccgattacactattaattctaatttattaaaaagagtaaaagaagttgttagttgggttactaataaaaacatgtatgctatcataaatatccactatgacggtggttggttcgaacaattcggtacttctcaatctactcaagcaaatcaaaaatttaacaagatatggacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatca

SEQ ID NO: 17582 - DNA, 870 bp, Piromyces finnis; identical to SEQ ID NO: 17581
  Cellulase

SEQ ID NO: 17583 - DNA, 846 bp, Piromyces finnis
  Cellulase
tgaaaagaacccaattggttctgaaacctgctggggtaacgtcaagactaatgaagatatcttcaagactttaatggacaaccaattcaatgttttccgtattccaactacttggactggtcacattggtgaagctccagaatacaagattaacgaacaatggatgaagagagttcacgaaattgttgattacccatacaagaacggtgcttttgttatcttaaacattcaccacgaaacatggaaccatgctttcgctgaaaccgttgatgaagctaaggttgaattagctcaagtttggaagcaaattgctgaagaattcaagggttacggtgaacgtttaatcttcgaaggtcaaaacgaaccaagaaagaacggtactccagttgaatggaacggtggtgataaggaaggttgggatgttgttaatgcaatgaacgctgtcttcttagaaaccgttcgtagttctggtggtaacaatgctaagcgtcatcttatgattccaccatacgctgctgcttgtaatgaaaactctttcaagaactttgacttcccagaagatgatgacaaggttattgcttctgttcacgcttactctccatacaactttgccttaaataatggtgaaggagctgttgataagtttgatgcttctggtaagaatgaactcgactggaatattaacttaatgaagaagagattcgttgaccaaggtattccaatgattttaggtgaatatggtgccatgaaccgtgataatgaagaagaacgtgctgcttgggccgaatactacatggaaaagattactgctttaggtgttccacaagtctggtgggataatggtgt

SEQ ID NO: 17584 - DNA, 846 bp, Piromyces finnis; identical to SEQ ID NO: 17583
  Cellulase

SEQ ID NO: 17585 - DNA, 870 bp, Piromyces finnis; identical to SEQ ID NO: 17581
  Cellulase

SEQ ID NO: 17586 - DNA, 324 bp, Piromyces finnis
  Cellulase
agcttatgttgttccaaaagatgatcgtgttatggtttctgttcattattataccccttctaccttcactattcttgaagaagatgctgattggggtaaagcccaaccaacttggggatcagaaagtgaagttgaatatcttcttaacgatttcaaaaaaataaaaacacgttttgtcgataatggtattccagtagttattggtgaatatggtactgttaccaaaaataaggatattaatagtgttcataaattcttaaaaactgttgctgaaacttcacttaattctggtatgtgtccattcttatgggataatggtgaaca

SEQ ID NO: 17587 - DNA, 759 bp, Piromyces finnis
  Cellulase
ttggagtaatcttatgttggataattatattatcaatccattattactttctagggttaaagaagttgttgattatattgttaataatgatatgtacgctattgttaacattcattgggatatgggatggtttacaaaattcgctactaatgaaaaagaagctttcaaaaaatatacaagtatttggggtcaaatatctcaatattttaaagattatgatgaacatttggttttcgaatctttaaatgaagaaggttgttgggatgaaatatggaatcaatggagtaatcaaggggataagaaaaaggcttttaaccttttgaataatattaaccaagaatttgttgatattttccgtaattctagcgaaaataatgcgaaaagacacttacttttagctggttattgcactagtcttgatttaactagtgatgaattatatgttattccaaaagatgatagagtaatgatttctgttcattactacggtccatctacatttaccattcttgaagaagatgctgattggggaaaagctgcatactcttggggtacagaaaaagaaattaattaccttgttgatgaacttaaaaaaataaaaaagaactttattgataaaggtattccaataattgttggtgaatatggtactgctataactaataaggaaccagctagtgttattagatggttgaaaactgttgctaaaactacttcctcctttggtatggttccatgtctttgggatgctggacaata

SEQ ID NO: 17588 - DNA, 762 bp, Piromyces finnis
  Cellulase
agatgttaaagccatcgaaactactatcgaacaaggtatgaacgctttccgtatttgtaacagatgggaacgtttacagcatgaattatttggtgaatttaatgaattcgatatcactgaatttaaaaaggttgttgatgctactactgctaagggtgccattgctattattgatccacataactatgctcgttacaacaataaacttattggttctgaagatgttccaattgaagctttcgttgacttctggactagacttgctgaaattttcaaagataatgaaaatgtttggttcggtttagttaatgaaccacacgatatggaaactgatgattggttcaaggcagctcgtgctgctgttgatggtattcgttccactggtgctaagaacaacattttaattccaggtaacggttggactggagcttggagttggggtaaggaagcttggtatggtgaagctaatgctgatgttgccttaagatatttctcatctgaagatgaaaatattctttttgaagttcaccaatactttgataaagattactctggtacaggtgatcaatgtgttcaacgcccatgtcaaaatctctttaaagaatttgttgaatggcttaagaccaacaatttaaagggatggattggagaaattggttcataccttactgatgaatgccgtgaatgtgttcaagaatccattgaatatctccaagaaaacaatgaatatgttcttggtactttatggtgggcagcaggtcc

SEQ ID NO: 17589 - DNA, 762 bp, Piromyces finnis; identical to SEQ ID NO: 17588
  Cellulase

SEQ ID NO: 17590 - DNA, 784 bp, Piromyces finnis
  Cellulase
ttataagtgttgttcccattgtgatgtttacttaacagatgaagtgggacaatggggtgttgaaaacaattattggtgtggtattccagaatcatgtaatgtttctggaccaactaacaatgctccaactgaaaacttctttgataatgaactttacattagtccaagatacgttgaagaaattgaatcttccatgccagatatgagcgatgaattaaaggctaaggctaagaatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctctt

SEQ ID NO: 17591 - DNA, 1143 bp, Piromyces finnis
  Cellulase
caacaacaacaatcaatggaatcaatgggaccaaggaaataacaacaatcaatggaataacaacaacaacaatcaatggaacaacaataacaacaacaacaaccaatggaacaacaacaataaccaagtttctaacaacaacggtagtagcggaagcagccaaaacttcttcttaaacgaaatctatgctaatccaagattcattgaagaaatcgattcttcaattccaaagttaagtggtgatttagctgctaaggccgaaaaggtcaagcaagttccaactgctgtttggttagcttgggatggtgctccaggtgaagttgaaggtcaccttgctgctgctggttctaagactgttgtcttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatccccattcta

SEQ ID NO: 17592 - DNA, 1230 bp, Piromyces finnis
  Cellulase
tcaagttatagaaactgatgatgaaggtagatggggtagccttaacggtgaatggtgtttcatcgatgaaagcaaatgtggtgatcttttaaacaattgtaaatttgaacaatacggttataagtgttgttcccattgtgatgtttacttaacagatgaaatgggacaatggggtgttgaaaacaattattggtgtggtattccagaatcatgtaatgtttctggaccaactaacaatgctccaactgaaaacttctttgataatgaactttacattagtccaagatacgttgaagaaattgaatcttccatgccagatatgagcgatgaattaaaggctaaggctaataatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaaatccccattcta

SEQ ID NO: 17593 - DNA, 1230 bp, Piromyces finnis
  Cellulase
tcaagttatagaaactgatgatgaaggtagatggggtagccttaacggtgaatggtgtttcatcgatgaaagcaaatgtggtgatcttttaaacaattgtaaatttgaacaatacggttataagtgttgttcccattgtgatgtttacttaacagatgaaatgggacaatggggtgttgaaaacaattattggtgtggtattccagaatcatgtaatgtttctggaccaactaacaatgctccaactgaaaacttctttgataatgaactttacattagtccaagatacgttgaagaaattgaatcttccatgccagatatgagcgatgaattaaaggctaaggctaataatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttccagagctgatccagtttgtggtcgtgaagattcattcccaggttctccagatgctggttcatggttcagtgaatatttcattagtatgttagaaaagtctccattcta

SEQ ID NO: 17594 - DNA, 1459 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattgttactggtggaaatagcaattacgatgattctaacccaagcattggttcccaatacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17595 - DNA, 1345 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattgttgctggttcctctccatctactggtggtaacactagctacgatgactccaacccaagcatcggttcccaatacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 17596 - DNA, 1327 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattgttactggtggaaatagcaattacgatgattctaacccaagcattggttcccaatacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17597 - DNA, 1597 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattccaaaggctgaaagctgctggtctcaaccattaggttacccatgctgtacttctacctctactgctgtttacactgatggtgatggtgcttggggtattgaaaacggcgattggtgtggtatcaacggtaattccagccaaggttctactccaaatgttggtaatgatgaaaacccagttattggttcccaatatactcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17598 - DNA, 1465 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattccaaaggctgaaagctgctggtctcaaccattaggttacccatgctgtacttctacctctactgctgtttacactgatggtgatggtgcttggggtattgaaaacggcgattggtgtggtatcaacggtaattccagccaaggttctactccaaatgttggtaatgatgaaaacccagttattggttcccaatatactcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17599 - DNA, 1459 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattgttactggtggaaatagcaattacgatgattctaacccaagcattggttcccaatacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 17600 - DNA, 1465 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattccaaaggctgaaagctgctggtctcaaccattaggttacccatgctgtacttctacctctactgctgtttacactgatggtgatggtgcttggggtattgaaaacggcgattggtgtggtatcaacggtaattccagccaaggttctactccaaatgttggtaatgatgaaaacccagttattggttcccaatatactcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 17601 - DNA, 1345 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattgttgctggttcctctccatctactggtggtaacactagctacgatgactccaacccaagcatcggttcccaatacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17602 - DNA, 1477 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17603 - DNA, 1345 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattgttgctggttcctctccatctactggtggtaacactagctacgatgactccaacccaagcatcggttcccaatacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17604 - DNA, 1459 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattgttactggtggaaatagcaattacgatgattctaacccaagcattggttcccaatacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17605 - DNA, 1477 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 17606 - DNA, 1597 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattccaaaggctgaaagctgctggtctcaaccattaggttacccatgctgtacttctacctctactgctgtttacactgatggtgatggtgcttggggtattgaaaacggcgattggtgtggtatcaacggtaattccagccaaggttctactccaaatgttggtaatgatgaaaacccagttattggttcccaatatactcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 17607 - DNA, 1327 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattgttactggtggaaatagcaattacgatgattctaacccaagcattggttcccaatacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaaaagcactttgaacaaggtcttgaaaatgctaacccaccactt

SEQ ID NO: 17608 - DNA, 1597 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattccaaaggctgaaagctgctggtctcaaccattaggttacccatgctgtacttctacctctactgctgtttacactgatggtgatggtgcttggggtattgaaaacggcgattggtgtggtatcaacggtaattccagccaaggttctactccaaatgttggtaatgatgaaaacccagttattggttcccaatatactcactctggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17609 - DNA, 1477 bp, Piromyces finnis
  Cellulase
gaaggcctctattgctttaactgctgctgctgctcttgccgctaaggcttctgctgcctgctggtctcaaagtttaggttacccatgttgttcctctgctagtgctaaggttgaatacactgatgccgatggtaagtggggtattgaaaacggtaactggtgtggtattccagctgctactagttccgcttcttgctgggctaagccattaggttacaactgttgtacttcaactactcaagctgtctacactgatagcgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaagttcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17610 - DNA, 1327 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattgttactggtggaaatagcaattacgatgattctaacccaagcattggttcccaatacactcacagtggtaacccattcaagggtcacaagttcttcatcaacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17611 - DNA, 1465 bp, Piromyces finnis
  Cellulase
gaaggcctctattgctttaactgctgctgctgctcttgccgctaaggcttctgctgcttgctggtcccaaaaattaggttacccatgctgttcttccagctctgctcaagtttggttcaccgataatgatggtgaatggggtgttgaaaacggtgactggtgtggtattccaaaggctgaaagctgctggtctcaaccattaggttacccatgctgtacttctacctctactgctgtttacactgatggtgatggtgcttggggtattgaaaacggcgattggtgtggtatcaacggtaattccagccaaggttctactccaaatgttggtaatgatgaaaacccagttattggttcccaatatactcactctggtaacccattcaagggtcacaagttcttcatcaacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17612 - DNA, 1378 bp, Piromyces finnis
  Cellulase
gaaattctctgctttaattggtactttattcgcaactggagctttagcctctagctgtcacccatactacaattgctgtaataattgtgatgtttattacactgataacgaaggtaagtggggtgttcaaaacaacgactggtgtttcattgataacaaccgttgtggtggtaacaacaacagcggttactgcaagttcgaaagtttaggttaccgttgctgtaacggttgtgacgttgtttacaccgatagtgatggtaactggggtgttgaaaatggtaactggtgtggtattagagacaactgtaacaacaacaacaacaacaacaactacagaactactactaccaccagaagaaccactaccaccactagagttagtgtcccaactagcgacaacttctttgataatactctctacagtaacttcaagttccaagctgaagttcaatcttctattaacaagttaagtggttccttagctgaaaaggctaagaaggttaagtacgtcccaactgctgcttggttagcttgggaaggtgctccagctgaagttccacaataccttgatgaagctggttccaacactgttgttttcgtcttatatatgattccaactcgtgattgtaacgctaacgcctctgctggtggtagttccaacattgaaaagtacaagggttacgttgacaagatctacaacactattaaccaatatccaaactctagaattgttatgattcttgaaccagatactattggtaaccttgttactgctaacaatgacaactgtagaaacgtccaaaacatgcacaagcaagccctttcttacgctattagtaagttcggtacccaaagtaacgtcagagtttaccttgatgctgctcacggtgcttggttatctagccacgctgacaagactgcccaagttattaaggaaatcttaaacaacgctggtaacggtaaacttcgtggtatcagtactaacgtttctaactaccaaactgttaacgatgaatacaactaccacatgagacttaacagtgccctcgaaaaccttggtgttagaggtatgaaattcattgttgatacttcccgtaacggtgctaacatttctggtgctttcaatgctagtggtacctggtgtaacttcaagggtgctggtttaggtgctcgtccacaaggtagcccagacccaagcaagccattacttgatgcttacatgtggattaagactccaggtgaagctgatggttcttctagcggttctagagctgatccagtctgtgctcgttacgattctcttcaaggtgctccagatgctggttcttggttccatgattacttcgttatgttagtccaaaacgctaacccagccttc

SEQ ID NO: 17613 - DNA, 1297 bp, Piromyces finnis
  Cellulase
tggtattccagccgctactaactctgcttcttgctgggctaaggctttaggttacaactgttgtacttccactactcaagctatttacactgatagtgatggtaagtggggtgttgaaaacggtgactggtgtggtattgttactggtggaaatagcaattacgatgattctaacccaagcattggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17614 - DNA, 1300 bp, Piromyces finnis
  Cellulase
tactaactctgcttcttgctgggctaaggctttaggttacaactgttgtacttccactactcaagctatttacactgatagtgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacattgaatctactccagcttgtgctaagtctgaaaagtactactacgatggtcacgcttacttaattaagaagttcggtgttcttccacacgtttctatgtaccttgatattggtcacgctttctggttaggttgggatgacaaccgtgaaaaggccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17615 - DNA, 1300 bp, Piromyces finnis
  Cellulase
tactaactctgcttcttgctgggctaaggctttaggttacaactgttgtacttccactactcaagctatttacactgatagtgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17616 - DNA, 1297 bp, Piromyces finnis
  Cellulase
tggtattccagccgctactaactctgcttcttgctgggctaaggctttaggttacaactgttgtacttccactactcaagctatttacactgatagtgatggtaagtggggtgttgaaaacggtgactggtgtggtattgttactggtggaaatagcaattacgatgattctaacccaagcattggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacattgaatctactccagcttgtgctaagtctgaaaagtactactacgatggtcacgcttacttaattaagaagttcggtgttcttccacacgtttctatgtaccttgatattggtcacgctttctggttaggttgggatgacaaccgtgaaaaggccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17617 - DNA, 1315 bp, Piromyces finnis
  Cellulase
tggtattccagctgctactagttccgcttcttgctgggctaagccattaggttacaactgttgtacttcaactactcaagctgtctacactgatagcgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacattgaatctactccagcttgtgctaagtctgaaaagtactactacgatggtcacgcttacttaattaagaagttcggtgttcttccacacgtttctatgtaccttgatattggtcacgctttctggttaggttgggatgacaaccgtgaaaaggccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17618 - DNA, 1284 bp, Piromyces finnis
  Cellulase
tactagttccgcttcttgctgggctaagccattaggttacaactgttgtacttcaactactcaagctgtctacactgatagcgatggtaagtggggtgttgaaaacggtgactggtgtggtattgttactggtggaaatagcaattacgatgattctaacccaagcattggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccacagat

SEQ ID NO: 17619 - DNA, 1299 bp, Piromyces finnis
  Cellulase
tggtattccagccgctactaactctgcttcttgctgggctaaggctttaggttacaactgttgtacttccactactcaagctatttacactgatagtgatggtaagtggggtgttgaaaacggtgactggtgtggtattgttactggtggaaatagcaattacgatgattctaacccaagcattggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccacagat

SEQ ID NO: 17620 - DNA, 1315 bp, Piromyces finnis
  Cellulase
tggtattccagctgctactagttccgcttcttgctgggctaagccattaggttacaactgttgtacttcaactactcaagctgtctacactgatagcgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17621 - DNA, 1317 bp, Piromyces finnis
  Cellulase
tggtattccagctgctactagttccgcttcttgctgggctaagccattaggttacaactgttgtacttcaactactcaagctgtctacactgatagcgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccacagat

SEQ ID NO: 17622 - DNA, 1282 bp, Piromyces finnis
  Cellulase
tactagttccgcttcttgctgggctaagccattaggttacaactgttgtacttcaactactcaagctgtctacactgatagcgatggtaagtggggtgttgaaaacggtgactggtgtggtattgttactggtggaaatagcaattacgatgattctaacccaagcattggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactt

SEQ ID NO: 17623 - DNA, 1282 bp, Piromyces finnis
  Cellulase
tactagttccgcttcttgctgggctaagccattaggttacaactgttgtacttcaactactcaagctgtctacactgatagcgatggtaagtggggtgttgaaaacggtgactggtgtggtattgttactggtggaaatagcaattacgatgattctaacccaagcattggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacattgaatctactccagcttgtgctaagtctgaaaagtactactacgatggtcacgcttacttaattaagaagttcggtgttcttccacacgtttctatgtaccttgatattggtcacgctttctggttaggttgggatgacaaccgtgaaaaggccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccactc

SEQ ID NO: 17624 - DNA, 1302 bp, Piromyces finnis
  Cellulase
tactaactctgcttcttgctgggctaaggctttaggttacaactgttgtacttccactactcaagctatttacactgatagtgatggtaagtggggtgttgaaaacggtgactggtgtggtattgttgctggttcctctccatctactggtggtaacactagctacgatgactccaacccaagcatcggttcccaatacactcacagtggtaacccattcaagggtcacaaattcttcatcaacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatggttactgtggtcacagaaccgccatgaagccagctccagaagccggtcaatggttccaagccttcttcgaagaaggtcttaagaacgctaacccaccacagat

SEQ ID NO: 17625 - DNA, 588 bp, Neocallimastix californiae
  CELLULASE (GLYCOSYL HYDROLASE FAMILY 5) PROTEIN-RELATED
ttctactaagggtcacaatattgttgattcaaagggtcgtaaggttcaattatctggtctttcatggttcggtggtgaaactactaacctttccccacacggtttatggaccaattctttagctaactttattaagattgtcaaggataatggttacaaccatcttcgttacccatggactaatgaaatgttctttgaaggtgctaagactcaatctattgatcaaatgaacaatccagatcttgttgatctttctccattagaagttatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggagctgatcttcacaatgaaccacacggtaaggcttgctggggttgtggtgaagaagaacgtgattggagacttgcagctgaaagatgtggtaatgctattcatgaagttaatccagactggcttattattgttgaaggtaa

SEQ ID NO: 17626 - DNA, 951 bp, Neocallimastix californiae
  CELLULASE (GLYCOSYL HYDROLASE FAMILY 5) PROTEIN-RELATED
ctctactaagggacacaacattgttgattctaagggacgtaaggttcaattatctggtctttcttggttcggtggtgaaaccactaacctttccccacacggtttatgggctaactctttagctaacttcattaagattgttaaggataatggttacaatcatcttcgttacccatggaccaatgaaatgttctttgaaggtgctaagactcaatcagttgatcaagttaacaacccagatcttgctgatctctctcctttagaaattatggatgccgttattaatgaatgtggtaaggctggtcttaaggtttatcttgatcgtcacagaccactttctggtggacaaagtgaattatggtatgttgatgaagttgatgaagctaaatggattgaagactggcaattccttgctaagcgttacaagggtaatccaaccgttattggtgctgatcttcacaatgaaccacacggtaaggcctgctggggttgtggtgaagaagaacgtgattggagacttgcagctgaaagatgtggtaatgctattcatgaagttaatccagactggcttattattgttgaaggtaatgatcactatggtgaagaaggatggcaaaagggagaatcctactggtggggaggtatgttaaagggagttaaagaattcccagttagattaaatactccaaacaagcttgtctattctgctcacgattatgataagaatgtccatatgcaagattggttcaaagaagccgatttcccagataacatgccaccaatttgggatgataaatggggatacattgttaaggaagatattgcaccagttcttattggtgaattcggttcactcttaagagatgccacagatgttaaatggttaagtaacttaattgactatatgaaagaaaatgaagttcactggactttctggtgtttaaatccaaa

SEQ ID NO: 17627 - DNA, 951 bp, Neocallimastix californiae
  CELLULASE (GLYCOSYL HYDROLASE FAMILY 5) PROTEIN-RELATED
ttcaactaaaggtagacacattgttgacgaaaagggtcgtaaggttagattagctggtatctcatggtttggaggtgaaactactaatctttctccccatggattatgggctaagccattagaccatttcattaaagtaataaaggatcatggttacaaccatattcgttatccatggactaatgagatgctcttcccaggtgctaaaactgaatctattaatgctatggaaaatcctgatcttgttgatcttaccccattagaagttatggacgctgttattgatgcctgtggtaaggctggtttaaaagtttatcttgatcgtcacagaccactttctggtggtcaaagtgaattatggtatatttctaaggttgatgaaaagaaatggattgaagactggcaattcctagccaaacgttacaagggtaatccaactgttattggtgctgatcttcacaatgaaccacatggtactgcctgttggggttgtggtgaaactcaacgtgattggagacttgctgctgaaagatgtggtaatgctattcatgaagttaaccctgattggcttattattgtagaaggtaatgatcattatggtgaagaaggttggcaaaaaggtgaaggctactggtggggtggtatgttgaagggtgttaaagaaaatcctgtcagattaaagaaaccaaacaagcttgtttattctgctcacgattatgataagaatgttcacatgcaagattggttcaaagtttcttctttcccagataacatgcctgaaatttgggatgataaatggggttacattgtgaaagaagatatagctcctgttcttattggtgaatttggttcacttttaagagataaaactgatgttaaatggttacaaaatttaatttcttacatgaataaaaataccgttcactggactttctggtgcttaaatccaaa

SEQ ID NO: 17628 - DNA, 909 bp, Neocallimastix californiae
  CELLULASE (GLYCOSYL HYDROLASE FAMILY 5) PROTEIN-RELATED
ttctactaagggtcacaatattgttgattcaaagggtcgtaaggttcaattatctggtctatcatggttcggtggtgaaactactaacctttccccacacggtttatgggctaactctttagctaactttattaagattgtcaaggataatggttacaaccatcttcgttacccatggactaatgaaatgttctttgaaggtgctaagactcaatctgttgatcaagtgaacaatccagatcttgctgatctttctccattagaaattatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagaatccgatttcccagataacatgccaccaatttgggatgataaatggggatacattgttaaggaagatattgcaccagttcttattggtgaattcggttcactcttaagagatgccacagatgttaaatggttaagtaacttaatttattacatgaa

SEQ ID NO: 17629 - DNA, 951 bp, Neocallimastix californiae
  CELLULASE (GLYCOSYL HYDROLASE FAMILY 5) PROTEIN-RELATED
atctactaaaggtaaatacattgttgatgaaaagggtcgtaaagttaaattagctggtctttcatggtttggaggtgaaactccaaatctttcacctcatggtttatgggctaaaccattagctcatttcattaaagtaattaaagatcatggttacaaccacattcgttatccatggactaatgaaatgtttgtagaaggtgcaaagactgaatctattaatgctatggaaaatccagatcttgttgatcttactccattagaagttatggatgcagtaattgatgcttgtggtaaggctggtttaaaggtttaccttgaccgtcacagaccaactgccgctggacaaagtgaattatggtatatttcaaaggttgatgaaaagaaatggattgaagactggaaattccttgctaagcgttataagggaaatccaaccgtaattggtgctgatcttcacaatgaaccacatggtactgcttgctggggatgtggtgaaactgaacgcgattggagacttgctgctgaaagatgtggtaatgctattcatgaagttaacccagactggcttattattgttgaaggtaatgatcactttggtgaagaaggttggcaaaagggtgaatcctactggtggggaggtatgttaaagggtgttaaagaaaacccagtcagattaaataaaccaaataagcttgtttactctgctcatgactacgataagaacgtccatatgcaagaatggttcaagctttctactttcccagataatatgccagaaatttgggatgatgtttggggatatatttctaaggaagatattgctccagtccttattagtgaattcggttcacttttaagagataagactgatgttaagtggttagaaaaccttgtttcctacatgaatgataatgctgttcactggactttctggtgtttaaatccaaa

SEQ ID NO: 17630 - DNA, 951 bp, Neocallimastix californiae
  CELLULASE (GLYCOSYL HYDROLASE FAMILY 5) PROTEIN-RELATED
atctactaagggtagaaatattgtagaccagaaaggtcgtaatgttaaattagctggtatttcatggttcggaggagaaactgataatctttctccacatggtttatggtcaaaatcgttagctcacttcattaaggttattaaggataatggctataatcatattcgttacccatggactaatgaaatgcttctctcaggtgccagaactaaatctattaatgctatggaaaatccggatcttgctaatcttacaccattagaagttatggatgccgttattaatgctgctggtaaggcaggtttaaaggtttaccttgatcgtcatagaccaactgcagctggtcaaagtgaactttggtatatttctaaagtggatgaaaagaaatggattgaagattggaaattccttgctaagcgttacaagggtaatccaacagttatcggtgctgatattcataatgaaccccatggtactgcttgttggggttgtggagaaactaagcgtgattggagacttgctgctgaaagatgtggtaatgccattcatgaagtaaatcccgattggcttattattgttgaaggtaatgatcattatggtgaagaaggttggcaaaagggtgaatcctactggtggggaggtatgttaaagggtgttaagcaataccctgttagattaaataagaagaacaagcttgtttattctgcacatgattatgataagaatgttcatttacaagattggtttaaggtatctaacttcccagacaatatgccatctatttgggatgataaatggggttacattgcaaaacaaaatattgcaccagtacttattagtgaatttggttctctcttaaaggataaaactgatgtaaaatggttacaaaaccttatttcttatatgaataagaatggtgttcattggactttctggtgtctaaatccaaa

SEQ ID NO: 17631 - DNA, 951 bp, Anaeromyces robustus
  CELLULASE (GLYCOSYL HYDROLASE FAMILY 5) PROTEIN-RELATED
ttcaactaaaggtagatatattgttgacgaaaaaggtcgtaaagttaaattagctggtatatcttggtttggtggtgaaactactaacctttcaccacacggtttatgggctaagccattatctcacttcattaaaattattaaggatcttggttataaccatattcgttacccatggactaatgaaatgctcttcccaggtgccaaaactcaatctgttgatcaattacaaaatccagatcttgctgatcttactccattagaagttatggatgctgttattgatgcttgtggtaaagctggtattaaggtttatctcgatcgtcacagacctctttctggtggacaaagtgaattatggtatgttgctaaagtagatgaagataaatggattgaagactggcaattccttgctaagcgttacaagggtaatccaactgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagtttctaacttcccagacaacatgccagaaatttgggatgataaatggggttacattgctaaagaagacattgcaccagtacttattggtgaattcggttctcttttaatggataataaagatgttaaatggttacaaaatttaatttcttacatgaacaagaatgatgttcactggactttctggtgtttaaatccaaa

SEQ ID NO: 17632 - DNA, 1056 bp, Anaeromyces robustus
  CELLULASE (GLYCOSYL HYDROLASE FAMILY 5) PROTEIN-RELATED
tcaaccacaacctactcaaccatcccaaccatctccaactcaaccagccactccaactcaaccaaataatccaccagttaataataatgatccaataggtttcctttctactaagggtcaccttattgttgatgaaaagggtcgtgctgttaaattagctggtatttcatggttcggtggtgaaactactaacctttctccacacggtttatgggctaaaccattaagtcatttcattaaaactattaaggatcttggttataaccatattcgttacccatggactaatgaaatgtttaaagaaggagctaaaactgaatctgttgattccgtcaataacccagatcttgctgatttaactccattagaagttatggatgctgttattgaagctgctggtgctgctggtattaaggtttaccttgatcgtcacagaccacttgctggtggacaaagtgaattatggtacattgatgaagttccagaatctcaatggattgaagactggcaattccttgctaaacgttacaagggtaacccaactgttattggtgctgatcttcataatgaaccacacggtaccgcttgttggggttgtggtgaagaagttcgtgattggagacttgctgctgaaagatgtggtaatgctattcatgaagttaacccagactggcttattattgttgaaggtaatgatcactatggtgaagaaggatggcaaaagggtgaaagttactggtggggaggtatgttaaagggtgttaaggaaaacccagttagattgaaggttccaaacaagcttgtttactctgcccacgattacgataagaatgttcacttacaagattggttcactacttctgatttcccagacaacatgccagaaatttgggatgataaatggggttacattgttaaggaagatattgctccagttcttattggtgaatttggttcagtcttaagagatgctgttgatgttaaatggttaactaatttagttacctatatgcatgaaaatggtgtccactggactttctggtgtttaaatccaaa

SEQ ID NO: 17633 - DNA, 951 bp, Anaeromyces robustus
  CELLULASE (GLYCOSYL HYDROLASE FAMILY 5) PROTEIN-RELATED
ttctactaaaggtagatcaatcgttgatcaaaatggtcgtaaaataaagttagctggtatttcatggtttggaggtgaaactaataatctttctccacatggtttatgggctaagccattagatcattttattaaaactattaaggatcttggttataatcatattcgttatccatggacaaatgaaatgcttacaccaggagctaaaacaaattcaattgattctacaagtaatccagatcttgttaatcttactccattagaagttatggatgctgttattaatgcctgtggtaaagttggtcttaaagtttatcttgatcgtcatagacctcaatctggtggacaaagtgaattatggtatattccagaagtagatgaaagtaaatggattgaagattggcaatttcttgctaaacgttacaagggaaatccaactgttattggtgctgatattcataatgaacctcatggtgaagcatgttggggatgtggagaaagtaaacgtgattggaaagctgctgctgaaagatgtggtaatgccattcatcaagttaacccagattggcttattattgttgaaggtaatgatcattatggtgaagaaggttggcaaaagggtgaatcatactggtggggtggtatgttaaagggtgttaaagaaaacccaattaaattaaataaaccaaataaacttgtatattctgctcatgattatgataagaatgttcatatgcaagattggtttaaggaatccaatttcccagataatatgccaaccatttgggatgataaatggggtttcattgctaaacaaaatattgcaccagttcttattggtgaatttggttcccttttaaaagatgcaaccgatagtaaatggttacaaaatttagttacttatatgactaagaatgaaattcattggactttctggtgtttaaatccaaa

SEQ ID NO: 17634 - DNA, 951 bp, Piromyces finnis
  CELLULASE (GLYCOSYL HYDROLASE FAMILY 5) PROTEIN-RELATED
ctcaaccaagggtaagtacatcgttgatgaaaagggccgtaaagttattttaggtggtctctcatggttcggtggtgaaactactaacctttctccacacggtttatgggctaactctttagaaaacttcattaagatcgttaaggatcacggttacaatcaccttcgttacccatggactaacgaaatgttattcccaggtgccgaaactcaatctgttgaccaagttaacaacccagatcttgctaacctcagtccattagaagttatggatgccgttattgatgcttgtggtaaggccggtttaaaggtttaccttgatcgtcacagaccactttctggtggacaaagtgaattatggtacattccagaagttccagaagaacaatggattgaagactggcaattccttgctaagcgttacaagggtaacccaaccgttattggtgctgatcttcacaacgaaccacacagttctgcctgctggggttgtggtgaaatcgaacgtgattggagacttgctgctgaaagatgtggtaacgctattcacgaagttaacccagactggcttattattgttgaaggtaatgatcactatggcgaagaaggttggcaaaaaggtgaatcctactggtggggtggtatgttaaagggagctaaggaattcccagttagattaaacgttccaaataagcttgtttactccgctcacgattatgataagaatgtccacatgcaagattggttcaaggaaccagacttcccagacaacatggaaccaatttgggatgacaaatggggataccttgttaaggaaaacactgctccagttcttattagtgaatttggttccctcttaagagatgctactgatattaaatggttaggtaacttagttagctacatgaaggaaaatgatgttcactggactttctggtgcttaaatccaaa

SEQ ID NO: 17635 - DNA, 93 bp, Neocallimastix californiae
  Cellulose docking domain, dockering
atgttgttcttctccaaatgctgaagtttattacactgataacgatggtaagtggagtgtcgaaaacaacgattggtgtggtattccagttaa

SEQ ID NO: 17636 - DNA, 117 bp, Neocallimastix californiae
  Cellulose docking domain, dockering
atgctgggctaagaagttaggatattcttgctgtacttcaacctctagagttgaatacactgataatgatggtaagtggggtattgaaaatggtaactggtgtggtattgttgacgg

SEQ ID NO: 17637 - DNA, 102 bp, Neocallimastix californiae
  Cellulose docking domain, dockering
cgcttaccaatgctgtaactcttgtactactacctacactgataatgatggtagatggggttatgaaaatggtgactggtgtggtattaagtactcttgtcc

SEQ ID NO: 17638 - DNA, 126 bp, Neocallimastix californiae
  Cellulose docking domain, dockering
ctgttgggctcaaagccaaggttacaaatgttgtgataacccaggtagcactaaagttgaattctctgatggcagtggtcaatggggtattcaaaatggtgattggtgtggtattgactacagtta

SEQ ID NO: 17639 - DNA, 102 bp, Neocallimastix californiae
  Cellulose docking domain, dockering
taattacccatgctgtaatacttgtactgctacttataccgatggtgaaggtaagtgggccattgaaaatggtaactggtgtggtattaaaaattcttgtgg

SEQ ID NO: 17640 - DNA, 120 bp, Neocallimastix californiae
  Cellulose docking domain, dockering
tccagcctctatcactcgtcaaggttacaaatgttgtagagttggatgtactgttgaatacactgataatgatggtgaatggggtgttgaagatggtgactggtgtggttgtggtaaggc

SEQ ID NO: 17641 - DNA, 123 bp, Neocallimastix californiae
  Cellulose docking domain, dockering
taatgccaatgttattgctcaaggttacaattgctgtaaatcttgtggtactgtttacttcgaagatggtgatggcaaatggggtgttgaaaacaataactggtgtggtatgccattaaactg

SEQ ID NO: 17642 - DNA, 114 bp, Neocallimastix californiae
  Cellulose docking domain, dockering
tattaccaaccaaggttacaaatgctgttcaacctgtggtaccgtttactacactgatgctgatggtgattggggtgttgaaaacaacgactggtgtggtatgccaaccaactg

SEQ ID NO: 17643 - DNA, 114 bp, Neocallimastix californiae; identical to SEQ ID NO: 15090
  Cellulose docking domain, dockering

SEQ ID NO: 17644 - DNA, 123 bp, Neocallimastix californiae
  Cellulose docking domain, dockering
tccagcttctatcaccaaccaaggttacccatgctgttcatcctgtggtaccgtctactacactgataatgatggtttatggggtgttgaaaacaatgactggtgtggtatgccaacagactg

SEQ ID NO: 17645 - DNA, 114 bp, Neocallimastix californiae; identical to SEQ ID NO: 15091
  Cellulose docking domain, dockering

SEQ ID NO: 17646 - DNA, 114 bp, Neocallimastix californiae
  Cellulose docking domain, dockering
tattaccaaccaaggttacaagtgctgttcttcatgttccactgtttactacagcgataatgatggtgattggggtgttgaaaacaatgactggtgtggtatgccaaccagttg

SEQ ID NO: 17647 - DNA, 117 bp, Neocallimastix californiae
  Cellulose docking domain, dockering
ttcagcagctatcactaaccaaggttacaagtgctgttcagctaactgtgaagttgtttacaccgatggtgatggtgactggggtgttgaaaacaatgaatggtgtggttgtggtgg

SEQ ID NO: 17648 - DNA, 123 bp, Neocallimastix californiae
  Cellulose docking domain, dockering
tccagcttctatcaccaatcaaggctataagtgctgttcttcatgttccactgtttactacaccgataatgatggtgcttggggtgttgaaaataatgactggtgtggtatgccaaccaattg

SEQ ID NO: 17649 - DNA, 117 bp, Neocallimastix californiae
  Cellulose docking domain, dockering
ctcagcttctattgttgctcaaggttacaaatgttgctctgctaactgtgaagttgtttacactgataatgatggtgattggggtgttgaaaatggtcaatggtgtggttgtggtgg

SEQ ID NO: 17650 - DNA, 114 bp, Neocallimastix californiae; identical to SEQ ID NO: 17646
  Cellulose docking domain, dockering

SEQ ID NO: 17651 - DNA, 117 bp, Neocallimastix californiae; identical to SEQ ID NO: 17647
  Cellulose docking domain, dockering

SEQ ID NO: 17652 - DNA, 76 bp, Neocallimastix californiae; identical to SEQ ID NO: 15099
  Cellulose docking domain, dockering

SEQ ID NO: 17653 - DNA, 120 bp, Neocallimastix californiae
  Cellulose docking domain, dockering
ctgtttcagtgtaaaccttggctacagttgttgtaacggttgtgaagttgcttacactgattctgatggtaaatggggtgttgaaaatggtaattggtgtggaataaagtcatcatgtaa

SEQ ID NO: 17654 - DNA, 111 bp, Neocallimastix californiae; identical to SEQ ID NO: 15103
  Cellulose docking domain, dockering

SEQ ID NO: 17655 - DNA, 117 bp, Neocallimastix californiae
  Cellulose docking domain, dockering
ttttagcataaaccttggttacaaatgttgttctggttgtgatattgtatatgttgatcaagatggtaattggggtgttgaaaatgatcaatggtgtggaattaaaaactcttgcaa

SEQ ID NO: 17656 - DNA, 123 bp, Neocallimastix californiae
  Cellulose docking domain, dockering
taatgccaatattattgctcaaggttacaagtgctgtaaatcttgtggtactgtttactacgaagatggtgatggtcaatggggtgttgaaaacaatgactggtgtggtatgccattaaactg

SEQ ID NO: 17657 - DNA, 117 bp, Neocallimastix californiae
  Cellulose docking domain, dockering
tccagcctctatcactcgtcaaggttacaaatgttgtagagttggatgtactgttgaatacactgataatgatggtgaatggggtgttgaagatggtgactggtgtggttgtggtaa

SEQ ID NO: 17658 - DNA, 120 bp, Neocallimastix californiae
  Cellulose docking domain, dockering
ttgttggtctacaagtttaggttatccatgttgttcatcttccagtgctcaagtttattacactgataatgatggtaaatggggtgttgaaaatggtgactggtgtggtattccaactgg

SEQ ID NO: 17659 - DNA, 114 bp, Neocallimastix californiae
  Cellulose docking domain, dockering
ttgttttgctgaaagattaggttacccatgttgtaaaggaaacactgttgcttacactgataatgatggtaaatggggtgtcgaaaatggtaactggtgtggtattgctgatac

SEQ ID NO: 17660 - DNA, 117 bp, Neocallimastix californiae
  Cellulose docking domain, dockering
ttgttttgccaaatctgatggatacgactgttgtttcgataatgaagttgtttatgaagatgaaacaggtaaatggggtattaatgatgaaggtgaatggtgtggtgttgaacaacc

SEQ ID NO: 17661 - DNA, 132 bp, Neocallimastix californiae
  Cellulose docking domain, dockering
ttgttgggcagaagctttaggttacaagtgttgtactccaggtgcctacactccagttcttttaactgatgaaagtggtgattggagtgctgaaaatggtgaatggtgtggtctcttaaagagtgaatgttg

SEQ ID NO: 17662 - DNA, 117 bp, Neocallimastix californiae
  Cellulose docking domain, dockering
atgttgggctaatgcctatggttatgactgctgtgttgatggtactcttacatacttagaagatgaaactggaaaatggggtgttacctctgactaccaatggtgtggtattaagaa

SEQ ID NO: 17663 - DNA, 120 bp, Neocallimastix californiae
  Cellulose docking domain, dockering
ttgctggtccctttctcaaggttacccatgctgttcctcttcaaatgctgaagtttggtacactgatgcctcaggtaaatggggtgttgaaaatggagactggtgtggtattccaactgg

SEQ ID NO: 17664 - DNA, 87 bp, Neocallimastix californiae
  Cellulose docking domain, dockering
atgttgttctggaaatgacgttgtttacaccgacaatgatggtaaatggggtgtagaaaatggtaactggtgtggtattgctgatac

SEQ ID NO: 17665 - DNA, 123 bp, Neocallimastix californiae
  Cellulose docking domain, dockering
ctgttggtcaactaaatttggttatccatgttgtaaaaagacatgtactgctatagaaaaagataaagatggttcatgggctattgaaggatcacactggtgtggtattccagctaattgttc

SEQ ID NO: 17666 - DNA, 123 bp, Neocallimastix californiae
  Cellulose docking domain, dockering
atgtatctccgaatttctcggttatccatgttgtagtagcagtaatactcctgtttattacaaagatgatgatggtgattggggtattgattcagctactggtgattggtgtggtattaccaa

SEQ ID NO: 17667 - DNA, 123 bp, Neocallimastix californiae
  Cellulose docking domain, dockering
atgtgtctccgaatttctcggttatccatgttgtagtagcagtaacactcttgtttattacaaagatgatgatggtgattggggtgttgatccagctactggtgattggtgtggtattaccaa

SEQ ID NO: 17668 - DNA, 114 bp, Neocallimastix californiae
  Cellulose docking domain, dockering
ctgttggtcaactaaattaggttatccatgttgtaaaaagacatgtactgctattgaaaaagataacgatggtgcatgggctattgaaggatcacactggtgtggtattccagc

SEQ ID NO: 17669 - DNA, 120 bp, Neocallimastix californiae
  Cellulose docking domain, dockering
ctgtaaattcgaagctcttggttacaagtgctgttctcactgtgttagttaccttgaagatgaagatggtttatggggtgttgaaaatggtgaatggtgtggaattacagatgaatgtat

SEQ ID NO: 17670 - DNA, 117 bp, Neocallimastix californiae
  Cellulose docking domain, dockering
atgttggtctaataaattcggttacccatgctgtgatacctgtgacgttttcttaactgatgaatctggtgattggggtgttaaagaccttgattggtgtggtgttccatccacttg

SEQ ID NO: 17671 - DNA, 117 bp, Neocallimastix californiae
  Cellulose docking domain, dockering
ttgttggtctgaaagcttaggttacccatgctgttcttccaatactggtgttgcatacattgataatgatggtgaatggggtgttgaaaatggtggctggtgtggtattaaaggaga

SEQ ID NO: 17672 - DNA, 120 bp, Neocallimastix californiae
  Cellulose docking domain, dockering
ttgttggtctcaaaaacttggttacccatgttgttcttcttctagtgctgaagtttggtacaccgacaatgatggtaaatggggtgttgaaaacaatgactggtgtggtattccagttga

SEQ ID NO: 17673 - DNA, 117 bp, Neocallimastix californiae
  Cellulose docking domain, dockering
ttgttggtctgaaagcttaggttacccatgctgttcttccaatactggtgttgcatacattgataatgatggtgaatggggtgttgaaaatggtggctggtgtggtattccagttga

SEQ ID NO: 17674 - DNA, 123 bp, Neocallimastix californiae
  Cellulose docking domain, dockering
ctgttggtctgaatctcaaggctacaaatgctgtaagaattctaacacaaaggttgaattcactgatgatagtggagaatggggtattgaaaataatgattggtgtggaattccaaaggaaga

SEQ ID NO: 17675 - DNA, 120 bp, Neocallimastix californiae
  Cellulose docking domain, dockering
atgtttttctgaaaaaatgggtattcaatgctgtccagaaggaactgaaatatattataccgataatgatggtaactggggtatttacaaaaatgattggtgtggtattgccgatagtac

SEQ ID NO: 17676 - DNA, 117 bp, Neocallimastix californiae
  Cellulose docking domain, dockering
ttgctgggctgaagctttaggattcaagtgttgtgaaactactaatgaagtagttttcactgacgatagtggtaaatggggtgttgaaaatggtgaatggtgtggtataaatggtaa

SEQ ID NO: 17677 - DNA, 96 bp, Neocallimastix californiae
  Cellulose docking domain, dockering
ctatccatgctgtagtgatccaaatactactcctatagaaactgatgatagtggtgaatggggattagaaaatggtgattggtgtggtattattag

SEQ ID NO: 17678 - DNA, 108 bp, Neocallimastix californiae
  Cellulose docking domain, dockering
agctaatcctttcccatgttgttctgatccaaatgcaactgttgaatatactaatgataaaggagattggggtgttgaaaatggtcaatggtgtggtataattaaaac

SEQ ID NO: 17679 - DNA, 129 bp, Neocallimastix californiae
  Cellulose docking domain, dockering
atgttggtcagaaaaatatggatatccttgttgtgaaagattaaatcattcttatattgaacaaggtactgaagaagaaaatgcatattgggcaattgaaaatggaaattattgtggtgtaccaaaatg

SEQ ID NO: 17680 - DNA, 102 bp, Neocallimastix californiae
  Cellulose docking domain, dockering
tccacctattccatgttgtacaggaaaagatttaaaagttatcgaagaagattcaaatggaaaatggtctgaagaaaatggggaaaagtgtggtattccagt

SEQ ID NO: 17681 - DNA, 108 bp, Neocallimastix californiae
  Cellulose docking domain, dockering
agactatccatgctgtagtgatccaaatactactcctatagaaattgatggtagtggtgaatggggtgttgaaaatggtgaatggtgtggtattcgtaagaataataa

SEQ ID NO: 17682 - DNA, 111 bp, Neocallimastix californiae
  Cellulose docking domain, dockering
tacaaaggatggtttcagctgctgtaaaaagtgtgatgtcgtcttagttgatgacaatggtaaatggggtgttgaagacaatcaatggtgtggtattgactcttcttgtga

SEQ ID NO: 17683 - DNA, 120 bp, Neocallimastix californiae
  Cellulose docking domain, dockering
gtgttggtctgaagctgaaggctacccatgctgtagttcaaatactgctgttgttctcactgacagcaaaggaaaatggggtatagaaaacggtgattggtgtggtattattgaaacttc

SEQ ID NO: 17684 - DNA, 129 bp, Neocallimastix californiae
  Cellulose docking domain, dockering
ctgttgggcttcaggtttaggttacaaatgctgttctggctgtgatgtcattttatctgacagtaatggaaagtggggatttgattttgaaactaatgattggtgtggtattattgaatctaaatgtaa

SEQ ID NO: 17685 - DNA, 87 bp, Neocallimastix californiae
  Cellulose docking domain, dockering
ctgttgggcttcaggtttaggttacaaatgctgttctggctgtgatgtcattttatctgacagtaatggaaagtgggcagcctcaaa

SEQ ID NO: 17686 - DNA, 120 bp, Neocallimastix californiae
  Cellulose docking domain, dockering
ttgttggtctgaagctgaaggctacccatgctgtagttcaaatactgctgttgttctcactgacagcaaaggaaaatggggtatagaaaacggtgattggtgtggtattattgaaacttc

SEQ ID NO: 17687 - DNA, 117 bp, Neocallimastix californiae
  Cellulose docking domain, dockering
ctgttgggcttcaggtttaggttacaaatgctgttctggctgtgatgtcattttatctgacagtaatggaaaatggggtatagaaaacggtgattggtgtggtattattgaaacttc

SEQ ID NO: 17688 - DNA, 114 bp, Neocallimastix californiae
  Cellulose docking domain, dockering
atgcttctctcaaagtttaggttatccatgttgttctggaaatgacgttgtttacatcgataatgatggtaaatggggtgttgaaaatggtaactggtgtggtattgctgatac

SEQ ID NO: 17689 - DNA, 120 bp, Neocallimastix californiae
  Cellulose docking domain, dockering
ttgctggtcaacaagtttaggttatccatgttgttcatcttctagtgcccaagtttactacactgataatgacggaaagtggggtgttgaaaataatgactggtgtggtattccaactgg

SEQ ID NO: 17690 - DNA, 120 bp, Neocallimastix californiae
  Cellulose docking domain, dockering
ttgttggtcacaacctctcggatatccatgttgttcttctccaaatgctgaagtttattacactgataacgatggtaagtggagtgtcgaaaacaacgattggtgtggtattccagttaa

SEQ ID NO: 17691 - DNA, 123 bp, Neocallimastix californiae
  Cellulose docking domain, dockering
ttgttgggctgctgctgaaggttacccatgttgtactagtaccactactgttgaaattgttgacagtaaaggtaaatggggtattgaaaatggaaactggtgtggtattgttgaaaactctgc

SEQ ID NO: 17692 - DNA, 123 bp, Neocallimastix californiae
  Cellulose docking domain, dockering
ctgttgggcttcatctcaaggttataattgttgttctggttgtgacccaattctcactgatggtagtggaaagtggggttttgaaaatggtaactggtgtggtattattgaatctaaatgtaa

SEQ ID NO: 17693 - DNA, 108 bp, Neocallimastix californiae
  Cellulose docking domain, dockering
aaaggacggttacccatgctgtaagggttgttccgttgttgatcaagatggttccggtaaatggggtattgaaaatggtaattggtgtggtattgactcttcatgtga

SEQ ID NO: 17694 - DNA, 120 bp, Neocallimastix californiae
  Cellulose docking domain, dockering
atgttggtctgaaaagttaggatataaatgttgttcaacatgtacccaagtttattataatgatcaagatggtagttggggtgttgaaaacaatgactggtgtggtattccaaccaactg

SEQ ID NO: 17695 - DNA, 120 bp, Neocallimastix californiae
  Cellulose docking domain, dockering
atgttgggctacttctttgggctacaagtgttgtagtaatccaaacactgaaagtgtttatgaagatgaaagtggtgaatggggtgttgaaaataatgactggtgtggtattgttaaagc

SEQ ID NO: 17696 - DNA, 111 bp, Neocallimastix californiae; identical to SEQ ID NO: 15148
  Cellulose docking domain, dockering

SEQ ID NO: 17697 - DNA, 117 bp, Neocallimastix californiae
  Cellulose docking domain, dockering
ttgttggtctactgtattgggttacccatgttgtgaagttaacgattttattgttaacactgatgaatacggaagttggagtgttgaaaataacgattggtgcggtattaaaaacgc

SEQ ID NO: 17698 - DNA, 120 bp, Neocallimastix californiae
  Cellulose docking domain, dockering
atgttggtctattgcattaggctacccatgttgtgaggttaatgattttgttgttcaaactgatgaaaatggtgactggagtgttgaaaacaacgattggtgtggtattaagaactcttc

SEQ ID NO: 17699 - DNA, 123 bp, Neocallimastix californiae
  Cellulose docking domain, dockering
atgttggtctactgctttaggcttcccatgttgtgaagttaatgataatgttgttcactctgatgaatatggagattggggtgttgaaaacaatgattggtgtggtattaaaaattcttccgc

SEQ ID NO: 17700 - DNA, 126 bp, Neocallimastix californiae
  Cellulose docking domain, dockering
atgtttctcacttaatcttggttatccatgctgtgaaaatgatagtgacgataatattattttcaccgatgaaaatggtgattggggtattgaaaacaataattggtgtggcattggtaaatcttc

SEQ ID NO: 17701 - DNA, 109 bp, Neocallimastix californiae
  Cellulose docking domain, dockering
ttgttggtctcaagcccttggatatccatgttgtaaatcaacatccgatgtttattacactgatgatgatggtaactggggtgtagaaaatggaaattggtgtggtctt

SEQ ID NO: 17702 - DNA, 117 bp, Neocallimastix californiae
  Cellulose docking domain, dockering
atgtttctctattgctcttggttatccatgttgtaaaggtaatgacattgtttatacagatgatgacggtaattggggtgttgaaaacaacgaatggtgtggtattaatgatagtga

SEQ ID NO: 17703 - DNA, 123 bp, Neocallimastix californiae
  Cellulose docking domain, dockering
ctgctgggctaagaatcttggctacccatgttgttctactaacacctgtagaaccgtttactatactgatgctgatggtaagtgggatgtcgaaaacaatgactggtgtggtattacctctgc

SEQ ID NO: 17704 - DNA, 117 bp, Neocallimastix californiae
  Cellulose docking domain, dockering
ctgttgggctactaaattaggttacccttgctgtaaaactaccaccactactgaatacactgatgctgatggtgaatggggtattgaaaacggaaactggtgtggtcttattaagac

SEQ ID NO: 17705 - DNA, 111 bp, Neocallimastix californiae; identical to SEQ ID NO: 15155
  Cellulose docking domain, dockering

SEQ ID NO: 17706 - DNA, 117 bp, Neocallimastix californiae
  Cellulose docking domain, dockering
ttgttggtctaagaaacttggttatccatgctgttcaaataagaatgcctcagttgaatacactgatggtgatggtcaatggggtattgaaaatggtgattggtgtggtattgttag

SEQ ID NO: 17707 - DNA, 126 bp, Neocallimastix californiae
  Cellulose docking domain, dockering
ctgttgggctagatctcttggttacaactgttgtagcacttctacttgtagaaatgctcaattctctgataatgatggtcaatgggatattgaaaacggtaactggtgtggtatcgcaactaccaa

SEQ ID NO: 17708 - DNA, 114 bp, Neocallimastix californiae
  Cellulose docking domain, dockering
ctgttgggctaaagctttaggttacccatgttgtactcaagctactgaagttgtttacactgattctaatggtcaatggggtatccaaaataacgactggtgtggtaagccaga

SEQ ID NO: 17709 - DNA, 114 bp, Neocallimastix californiae
  Cellulose docking domain, dockering
atgtttcagtgttgccttaggttacccatgttgtaagggtagtgaagttgtttacactgataacgatggtaagtggggatttgaaaatggtcaatggtgtggtattgctgatgg

SEQ ID NO: 17710 - DNA, 105 bp, Neocallimastix californiae
  Cellulose docking domain, dockering
tggttacaagtgctgtactcaatctaaccctaccgttgtatacactgatgcttctggagaatgggctgttgaaaacggagattggtgtattattaagaagcaaga

SEQ ID NO: 17711 - DNA, 105 bp, Neocallimastix californiae; identical to SEQ ID NO: 15161
  Cellulose docking domain, dockering

SEQ ID NO: 17712 - DNA, 111 bp, Neocallimastix californiae
  Cellulose docking domain, dockering
ttgtttcgctaaagctttaggttatgaatgttgtaatgataatgaaattgttacatctgatgaatctggtgattggggtgttaaggatggtgaatggtgtggtattggtgg

SEQ ID NO: 17713 - DNA, 102 bp, Neocallimastix californiae
  Cellulose docking domain, dockering
tgaaggttacagtaaatgtagtaactgtgatgttcaatactctgatggatccggtgattggggtgttgaaaatggtgactggtgtggtatcagcagtaaatg

SEQ ID NO: 17714 - DNA, 99 bp, Neocallimastix californiae
  Cellulose docking domain, dockering
ttacccatgctgtaatgaatgtgacgttgtttatacagatgattctggtgactggggtattgaaaacaatgattggtgtttactcaagaaatcttgtaa

SEQ ID NO: 17715 - DNA, 120 bp, Neocallimastix californiae
  Cellulose docking domain, dockering
ttgtttcagtgtaaaccttggctacagttgttgtaacggttgtgaagttgtttacactgattctgatggtaaatggggagttgaaaatggaaattggtgtggaataaagtcatcttgtaa

SEQ ID NO: 17716 - DNA, 111 bp, Neocallimastix californiae; identical to SEQ ID NO: 15165
  Cellulose docking domain, dockering

SEQ ID NO: 17717 - DNA, 120 bp, Neocallimastix californiae
  Cellulose docking domain, dockering
ttgtttcagtgtaaaccttggctacagttgttgtaacggttgtgaagttgtttacactgattctgatggtaaatggggagttgaaaatggtaattggtgtggaataaagtcatcttgtaa

SEQ ID NO: 17718 - DNA, 111 bp, Neocallimastix californiae; identical to SEQ ID NO: 15165
  Cellulose docking domain, dockering

SEQ ID NO: 17719 - DNA, 96 bp, Neocallimastix californiae
  Cellulose docking domain, dockering
atatccatgctgtgtcggtagtaaggtaattgaaacagacaaacaaggtgattggggttatgaagataatcactggtgtggtatagttaagaagga

SEQ ID NO: 17720 - DNA, 96 bp, Neocallimastix californiae
  Cellulose docking domain, dockering
ttatccatgttgtaaaggtaatgatattataacaacagatagtcaaggagattggggttatgaagataaacattggtgtggtataataaagaaaac

SEQ ID NO: 17721 - DNA, 123 bp, Neocallimastix californiae
  Cellulose docking domain, dockering
ttgctggtcaacagtcctgggatatgactgttgtaaaggatgtcatgtttatgaagaagatactgacggaaaatggggttatgaaaataaaaaatggtgtggtattgatgatgaagtatgcaa

SEQ ID NO: 17722 - DNA, 123 bp, Neocallimastix californiae
  Cellulose docking domain, dockering
ttgctggtcgacagtcttgggatatgactgttgtaaaggatgtcatgtttatgaagaagatactgacggaaaatggggttatgaaaataaaaaatggtgtggtattgatgatgaagtatgcaa

SEQ ID NO: 17723 - DNA, 96 bp, Neocallimastix californiae; identical to SEQ ID NO: 17719
  Cellulose docking domain, dockering

SEQ ID NO: 17724 - DNA, 96 bp, Neocallimastix californiae; identical to SEQ ID NO: 17720
  Cellulose docking domain, dockering

SEQ ID NO: 17725 - DNA, 123 bp, Neocallimastix californiae
  Cellulose docking domain, dockering
ttgctgggcagaagctgaaggtttcagatgctgtaaaggttgcgaagctatctatattgatggtgataaaagatggggtgttgaaaatatggaatggtgtggtattatcgaatctaattgtaa

SEQ ID NO: 17726 - DNA, 117 bp, Neocallimastix californiae
  Cellulose docking domain, dockering
ttgttgggctttagctgaaggttataattgttgtagtcctggtaccccagtatcaattactgatagcaaaggtaaatggggtattgaaaatgaagaatggtgtggtattattgatac

SEQ ID NO: 17727 - DNA, 111 bp, Neocallimastix californiae
  Cellulose docking domain, dockering
tttaaaagatggttataattgttgtagtggttgttctgtttcttatgaagatgaaactggtaaatggggtattgaaaatggtcaatggtgtggtattgactcttcctgtga

SEQ ID NO: 17728 - DNA, 121 bp, Neocallimastix californiae
  Cellulose docking domain, dockering
ttgttggtcacttccatttggatacccatgttgtccacattgtaaggctcttactaaggatgagaatggtaaatggggagaattaaatggagaatggtgtggtattgttgctgataaatgt

SEQ ID NO: 17729 - DNA, 117 bp, Neocallimastix californiae
  Cellulose docking domain, dockering
atgttggtccgaaaagtatggttatgaatgttgttcaccaaacaatactaaggttgtagtcagtgatgaaagtggtaaatggggtgttgaaaatggtaactggtgtggtgttctcaa

SEQ ID NO: 17730 - DNA, 121 bp, Neocallimastix californiae
  Cellulose docking domain, dockering
ttgttggtcacttccatttggatacccatgttgtccacattgtaattctcttactaaggatgagaatggtaaatggggagaattaaatggagaatggtgtggtattgttgctgataaatgt

SEQ ID NO: 17731 - DNA, 117 bp, Neocallimastix californiae
  Cellulose docking domain, dockering
atgttggtccgaaaagtatggttatgaatgctgctcaccaaacaatactaaggttgtagtcagtgatgaaaatggtaaatggggtgttgaaaatggtaactggtgtggtgttttgaa

SEQ ID NO: 17732 - DNA, 108 bp, Neocallimastix californiae
  Cellulose docking domain, dockering
atgttttggctacaagtgctgtgaaacatgtgaagttcaatactctgatgatactggatcttggggtattgaaaataatgattggtgtggtattccagattcatgcaa

SEQ ID NO: 17733 - DNA, 90 bp, Neocallimastix californiae
  Cellulose docking domain, dockering
ttacccaacatgttcagctaatattgaaattgcttacgttgatgacagaatttggggtattgaaaatggcgactggtgtattattaaatc

SEQ ID NO: 17734 - DNA, 120 bp, Neocallimastix californiae
  Cellulose docking domain, dockering
ttgctggtctctttctcaaggttatccatgctgttcttcttcaaatgctgaagtttggtacaccgatgcctcaggtaaatggggtgttgaaaatggagactggtgtggtattccaactgg

SEQ ID NO: 17735 - DNA, 111 bp, Neocallimastix californiae
  Cellulose docking domain, dockering
ttgtttcgctgaaagattaggttacccatgttgttctggtaacgaagttgtttacaccgataacgatggaaagtggggtgtagaaaatggtaattggtgtggtattgccga

SEQ ID NO: 17736 - DNA, 120 bp, Neocallimastix californiae
  Cellulose docking domain, dockering
atgttggagtaaagcccttggatatccatgctgtactactacaaaggaagttgtatataccgatgaaagcggtaaatggggtcttgaaggaaatgatgaatggtgtggtattgttgatgg

SEQ ID NO: 17737 - DNA, 108 bp, Neocallimastix californiae
  Cellulose docking domain, dockering
tggctatccatgttgtgataaaacaactgaagttgtttatgaagatgaagatggtaaatggggtgttcaaaatggtgatgaatggtgtttaataaaggaaaataaagc

SEQ ID NO: 17738 - DNA, 114 bp, Neocallimastix californiae
  Cellulose docking domain, dockering
agctgctcaagaatatggtgaatgtacttcttgtgttgttcaatataaggatcaagatggtaactggggttatgaaaatgatgactggtgcttaattaatgataaaaaatgtga

SEQ ID NO: 17739 - DNA, 117 bp, Neocallimastix californiae
  Cellulose docking domain, dockering
ttgtactggaaagagtgaaggttataagtgctgtgacaactgtgatgtagtttacactgatgactctggtgcttggggtattatgaatggagattggtgtggtattaagagtacttg

SEQ ID NO: 17740 - DNA, 102 bp, Neocallimastix californiae
  Cellulose docking domain, dockering
ttatccatgttgtagctcttgtactgttgtctacaatgacagtgatggtgattggggtgttgaaaatggtaactggtgtaagattaaggccgataaatgtgg

SEQ ID NO: 17741 - DNA, 111 bp, Neocallimastix californiae
  Cellulose docking domain, dockering
ctgtttctcattagcattaggttacccatgttgttctggaactactgttgaatattcagataatgatggtgactggggtttcgaaaatggtgattggtgtggtattggtag

SEQ ID NO: 17742 - DNA, 117 bp, Neocallimastix californiae
  Cellulose docking domain, dockering
atgttggagtaaagctttaggttatgactgttgtaaggaaggtaccgaagttgtttatactgatgaaagtggtaaatggggtgttactggtgacaactggtgtggtataatcgatac

SEQ ID NO: 17743 - DNA, 96 bp, Neocallimastix californiae
  Cellulose docking domain, dockering
cccatgttgtacttcttgtaatagcgtttacgaagatgatgatggtaaatggggtgttgaaaatgatgactggtgtttaattaagaagtcttgtgg

SEQ ID NO: 17744 - DNA, 105 bp, Neocallimastix californiae
  Cellulose docking domain, dockering
cggttatgaatgttgtaaatcttgtgatgttgaattaactgacgatgatggtgaatggggtattgaaaataatcaatggtgtggtattgatgtcgaaaagtgtca

SEQ ID NO: 17745 - DNA, 114 bp, Neocallimastix californiae
  Cellulose docking domain, dockering
ttgtttctctacaaagttaggttatccatgttgtacctccacttctgatgttgtttacactgatgatgatggtgactggggtattgaaaacaataattggtgtggtattgaaac

SEQ ID NO: 17746 - DNA, 120 bp, Neocallimastix californiae
  Cellulose docking domain, dockering
ctgttggtctcttaagttaggttacccatgttgtcaaaacactaatgtcgtctattacacagatgatgatggtgattggagtgttgaaaataatgactggtgtggtattgttaagggtaa

SEQ ID NO: 17747 - DNA, 114 bp, Neocallimastix californiae
  Cellulose docking domain, dockering
ttgtttttcagaaaaacttggttataaatgttgtaaaagaaatgaagttgtttataccgataatgatggtgattggggtgttgaagataatgaatggtgtggtatttcatccgg

SEQ ID NO: 17748 - DNA, 117 bp, Neocallimastix californiae
  Cellulose docking domain, dockering
atgctggtctactgcattaggttacccatgttgtaaaaactctagtattgtttatttcactgataatgatggtaaatggagtgttgaaaataatgattggtgtggtattattgaagg

SEQ ID NO: 17749 - DNA, 120 bp, Neocallimastix californiae
  Cellulose docking domain, dockering
ttgtttttctgaagcattaggttatccttgttgtagtagtggtgtagcagtcgtatacactgataatgatggaccatggggtgtggaaaacaatgattggtgtggtattactaataattc

SEQ ID NO: 17750 - DNA, 117 bp, Neocallimastix californiae
  Cellulose docking domain, dockering
ttgtttctctgttgcacttggttacaattgttgtcaacatacaacagaggttatttatgttgataatgatggatcatggggtattgaaaacaatgattggtgtggaataggcaacac

SEQ ID NO: 17751 - DNA, 96 bp, Neocallimastix californiae
  Cellulose docking domain, dockering
ttacccatgttgtagtacttgtgaagcttcctatgttgataatgaaggtggttggaatgttgaaaataatgactggtgtaagattgatgacaaaaa

SEQ ID NO: 17752 - DNA, 108 bp, Neocallimastix californiae
  Cellulose docking domain, dockering
ctgtttcgcccttgatttaggtttcaaatgttgtaataataatgaagttgtctataccgatcaagatggtaagtggggatataccgatgactggtgtggtattggtgg

SEQ ID NO: 17753 - DNA, 120 bp, Neocallimastix californiae
  Cellulose docking domain, dockering
atgtttcgccacaaagcttggttatgattgttgttcaggttgtgatgttaactacactgatggcgatggtgcctggggtattgaaaatggtaactggtgtggaattaaggattcttgttc

SEQ ID NO: 17754 - DNA, 120 bp, Neocallimastix californiae
  Cellulose docking domain, dockering
atgtttcgccactaaactcggttatggttgctgtactggttgtgaagttaactacactgatgatgatggtgcttggggtattgaaaatggtaactggtgtggaattccagattcatgtaa

SEQ ID NO: 17755 - DNA, 126 bp, Neocallimastix californiae
  Cellulose docking domain, dockering
atgttgggctaatactcttggttatcaatgttgtaatacctctaattgtagaaatattatatatgaagataatgatggtcaatgggatgttgataataatcaatggtgtggtattacatccgaaaa

SEQ ID NO: 17756 - DNA, 126 bp, Neocallimastix californiae
  Cellulose docking domain, dockering
ttgttggtcagaagcattaggatattcatgttgtactaattcatcttctccagtagtttatactgatgatgatggtcaatggagtgttgaaaataatgaatggtgtggtattttgaaaaataattc

SEQ ID NO: 17757 - DNA, 73 bp, Neocallimastix californiae; identical to SEQ ID NO: 15207
  Cellulose docking domain, dockering

SEQ ID NO: 17758 - DNA, 117 bp, Neocallimastix californiae
  Cellulose docking domain, dockering
ttggtcacaatctctcggatatccatgttgttcttctccaaatgctgaagtttattacactgataacgatggtaagtggagtgtcgaaaacaacgattggtgtggtattccagttaa

SEQ ID NO: 17759 - DNA, 112 bp, Neocallimastix californiae
  Cellulose docking domain, dockering
tgctcaaggatatccatgctgccaaaattcttgtattgtatactctaccgatgctgacggtagatggagtattgaaaatggtgactggtgtttaataaaaaataacagttgt

SEQ ID NO: 17760 - DNA, 120 bp, Neocallimastix californiae
  Cellulose docking domain, dockering
ttgctggtcttctagattaggttatccatgttgtaagagctgcaatgttgttttcactgataatgatggaaaatggggtgttgaaaatgatgactggtgtggtatttccagtacttgtaa

SEQ ID NO: 17761 - DNA, 120 bp, Neocallimastix californiae
  Cellulose docking domain, dockering
ctgttgggcttctgctttaggtttcaactgttgtaagactactaagactgttgtctttgaagatcaagatggtagttggggtgttgaagatgatttctggtgtggtatcgttgaagataa

SEQ ID NO: 17762 - DNA, 99 bp, Neocallimastix californiae
  Cellulose docking domain, dockering
ccaaggttatccatgttgtaagactgcaactgaagttttctacactgataatgatggtaaatggagtgttgaaaacgatgattggtgtttaattccaaa

SEQ ID NO: 17763 - DNA, 117 bp, Neocallimastix californiae
  Cellulose docking domain, dockering
ttcttcaattattgctcaaggttataaatgctgttcttctaattgtgaagtagtttatgtagatgatgatggtaactggggtgttgaaaatggacaatggtgtggttgtggtgtgag

SEQ ID NO: 17764 - DNA, 70 bp, Neocallimastix californiae; identical to SEQ ID NO: 15214
  Cellulose docking domain, dockering

SEQ ID NO: 17765 - DNA, 108 bp, Neocallimastix californiae
  Cellulose docking domain, dockering
cgaaaattctggttaccaatgttgtgataattgtgacgttgtttatgaagatgaatctggaaaatggggtattaaggataatgattggtgtgttctttctgataaatg

SEQ ID NO: 17766 - DNA, 108 bp, Neocallimastix californiae
  Cellulose docking domain, dockering
tccagctgatggatatgaatgttgtagtggatgcagtgttgttgataactcagatggaatcaaatggggtgttgaaaatgacaactggtgtattatcaagaacacttg

SEQ ID NO: 17767 - DNA, 120 bp, Neocallimastix californiae
  Cellulose docking domain, dockering
ttgctggtcttcaagattaggttatagctgttgtactggttgtgaagtctcatatactgataatgatggtgattggggatatgaaaacaatgattggtgtggtattccagattcctgtaa

SEQ ID NO: 17768 - DNA, 108 bp, Neocallimastix californiae
  Cellulose docking domain, dockering
cccacaatacaattgctgtaattcttgtgacgttgtatacactgataatgaaggtgaatggggtgtcgaaaataacaattggtgttttataaatgatgcaaagtgtca

SEQ ID NO: 17769 - DNA, 123 bp, Neocallimastix californiae
  Cellulose docking domain, dockering
atgtaaatttgaagctcttggttacccatgttgtagtcattgtaactctatttaccatgatgaaagtggtgattggggtgttgaaaatggtgattggtgtggtattcaagagagtaactgtgg

SEQ ID NO: 17770 - DNA, 114 bp, Neocallimastix californiae
  Cellulose docking domain, dockering
ttgctggtctcaagcattaggttacccatgctgtagtcacaagaatgttgtttacactgataatgatggtgactggggtgttgaaaatggtgattggtgtggtattattaaggg

SEQ ID NO: 17771 - DNA, 114 bp, Neocallimastix californiae
  Cellulose docking domain, dockering
ctgtttctcagaaagattaggttacccatgttgtaaaggtaacactgtcgtttacaccgataatgatggaaagtggggtgttgaaaataataattggtgtggtatcggttccac

SEQ ID NO: 17772 - DNA, 114 bp, Neocallimastix californiae
  Cellulose docking domain, dockering
ggcttctgctttaggtttcaactgttgtaagactactaagactgttgtctttgaagatcaagatggtagttggggtgttgaagatgatttctggtgtggtatcgttgaagataa

SEQ ID NO: 17773 - DNA, 120 bp, Neocallimastix californiae
  Cellulose docking domain, dockering
ttgctggtctgttaagttaggttacccatgttgtgaagtttctaatgccatttactctgttgatgacaatggtagttggggttatgaaaatgatcactggtgtggtcttcttaagaagaa

SEQ ID NO: 17774 - DNA, 108 bp, Neocallimastix californiae; identical to SEQ ID NO: 15223
  Cellulose docking domain, dockering

SEQ ID NO: 17775 - DNA, 114 bp, Neocallimastix californiae
  Cellulose docking domain, dockering
ttgtttctctgaaagattaggttatccatgttgttctggtgacgaagttgtttacactgataatgatggtaagtggggtgttgaaaatggtaattggtgtggtattgccgatgc

SEQ ID NO: 17776 - DNA, 123 bp, Neocallimastix californiae
  Cellulose docking domain, dockering
ttgctggtctactagcttaggttatccatgttgttcttcttcaaatgctgaagtttggtacactgatgactctggtaaatggggtgttgaaaatggtgactggtgtggtattccacaaaatga

SEQ ID NO: 17777 - DNA, 114 bp, Neocallimastix californiae
  Cellulose docking domain, dockering
ttgtttctctgaaagattaggttatccatgttgttctggtaacgaagttgtttacactgataatgatggtaaatggggtgttgaaaatggtaattggtgtggtattgccgatgc

SEQ ID NO: 17778 - DNA, 120 bp, Neocallimastix californiae
  Cellulose docking domain, dockering
ttgctggtctactagcttaggctacccatgttgttcttcttcaagtgctgaagtttggtacactgatgactctggtaaatggggtgttgaaaatggtgactggtgtggtattccaactgg

SEQ ID NO: 17779 - DNA, 114 bp, Neocallimastix californiae
  Cellulose docking domain, dockering
ttgtttctctgaaagattaggttatccatgttgttctggtaacgaagttgtttacactgataatgatggtaagtggggtgttgaaaatggtaactggtgtggtattgccgatgc

SEQ ID NO: 17780 - DNA, 120 bp, Neocallimastix californiae
  Cellulose docking domain, dockering
ttgctggtctactagcttaggttacccatgttgttcttcttcaagtgctgaagtttggtacactgatgactctggtaaatggggtgttgaaaatggtgactggtgtggtattccaactgg

SEQ ID NO: 17781 - DNA, 111 bp, Neocallimastix californiae
  Cellulose docking domain, dockering
ttgtttctcagaaagattaggttacccatgctgttctggtgatgaagttgtttacaccgataacgatggaaagtggggtgtagaaaacggtaattggtgtggtattgccga

SEQ ID NO: 17782 - DNA, 120 bp, Neocallimastix californiae
  Cellulose docking domain, dockering
ttgctggtctctttctcaaggttatccatgctgttcttcttcaaatgctgaagtttggtacactgatgcctcaggtaaatggggtgttgaaaatggtgactggtgtggtattccaactgg

SEQ ID NO: 17783 - DNA, 114 bp, Neocallimastix californiae
  Cellulose docking domain, dockering
ttgtttctcagaaagattaggttacccatgctgttctggtgatgaagttgtttacaccgataacgatggaaagtggggtgtagaaaacggtaattggtgtggtattgccgatgc

SEQ ID NO: 17784 - DNA, 76 bp, Neocallimastix californiae; identical to SEQ ID NO: 15233
  Cellulose docking domain, dockering

SEQ ID NO: 17785 - DNA, 120 bp, Neocallimastix californiae
  Cellulose docking domain, dockering
ttgttgggcagaagaattaggttttaaatgctgttcttcaagtgatgccaaggtagaatatacagataatgatggtgaatggtctatagaagatggtagttggtgtggtattttaaaaaa

SEQ ID NO: 17786 - DNA, 123 bp, Neocallimastix californiae
  Cellulose docking domain, dockering
atgttgggctaaggcattaggatttgagtgttgtacttcagaagatattgaagttcaatacactgacaaagatggaaaatggggaattgaaaattatgaatggtgtggtattattgaagataa

SEQ ID NO: 17787 - DNA, 123 bp, Neocallimastix californiae
  Cellulose docking domain, dockering
ttgctggtctcttgcttatggttacgattgctgtaaaggttgtgaagtttctttcattgataatgatggtaaatggggttttgaaaatgaagaatggtgtggtattaaagaagattgtgctac

SEQ ID NO: 17788 - DNA, 120 bp, Neocallimastix californiae
  Cellulose docking domain, dockering
ttgttggtcctccgctttaggatacccatgctgtaaaggatgtgatataacatctaccgatagcgatggagattggggtgttgaaaataatgaatggtgtggtattttatcttcatgcaa

SEQ ID NO: 17789 - DNA, 99 bp, Neocallimastix californiae
  Cellulose docking domain, dockering
tcaatacagtacttgtaaaaacacttgcgaaattgaatatgaagatgataataaatggggtattgaaaataatgaatggtgtattcttccaggttcatg

SEQ ID NO: 17790 - DNA, 99 bp, Neocallimastix californiae
  Cellulose docking domain, dockering
tccatatccatgctgtgaaggaactacagttgaatatgttgatgatcaaggagaatggggtgttgaaaatggtgaatggtgtggtattgttaagagtaa

SEQ ID NO: 17791 - DNA, 93 bp, Neocallimastix californiae
  Cellulose docking domain, dockering
ttatccatgttgtagttcaggtattgaagttgcatatgttgatgatcaaggtgaatggggtgttgaaaacggtgaatggtgtggtattgagcc

SEQ ID NO: 17792 - DNA, 111 bp, Neocallimastix californiae
  Cellulose docking domain, dockering
attaaagggttacaactgttgtagaaatacttgtgatatctcttacgtagatgaggatggtaactggggtgttgaaaatggtaattggtgtggtgtaccattctcttgttt

SEQ ID NO: 17793 - DNA, 102 bp, Neocallimastix californiae
  Cellulose docking domain, dockering
agattatccatgttgtaaaaatactagatattcttactacactgatagtgcaggtaatgaatggggtgttgaaaatggtgattggtgtggtattattccaca

SEQ ID NO: 17794 - DNA, 99 bp, Neocallimastix californiae
  Cellulose docking domain, dockering
ttacccatgttgtaatagttgtgatgtttcttactcagacagtattggtgattggggtattgaaaataatgattggtgcggtatcaagtcgtcttgcaa

SEQ ID NO: 17795 - DNA, 120 bp, Neocallimastix californiae
  Cellulose docking domain, dockering
ttgttgggctaaaaaactcggttataattgttgtactggttgcaattccatttactctgataaagatggaatgtggggatatgaaaatgaagaatggtgtggtattactgataattgtaa

SEQ ID NO: 17796 - DNA, 105 bp, Neocallimastix californiae
  Cellulose docking domain, dockering
accagattatccatgctgtacctcatgtgatgttgttgaatcggatggtgatcaaagatggggtattgaaaataatgaatggtgtggtataccagattcttgtcc

SEQ ID NO: 17797 - DNA, 123 bp, Neocallimastix californiae
  Cellulose docking domain, dockering
ttgctgggctaaggctttaggttatgaatgttgtaagtcttgtcttccagttgttaccactgatggtgatggttcatggagtgttgtaaatgatgactggtgtggtcttccaactagctgtaa

SEQ ID NO: 17798 - DNA, 115 bp, Neocallimastix californiae
  Cellulose docking domain, dockering
tggagctcaaggttatccatgttgtaagagtagttgtgccatttacagtagcgatagtgatggtgactggagtattgaaaatggtgattggtgtttaattgacaagaaggcttgt

SEQ ID NO: 17799 - DNA, 115 bp, Neocallimastix californiae; identical to SEQ ID NO: 17798
  Cellulose docking domain, dockering

SEQ ID NO: 17800 - DNA, 123 bp, Neocallimastix californiae; identical to SEQ ID NO: 17797
  Cellulose docking domain, dockering

SEQ ID NO: 17801 - DNA, 99 bp, Neocallimastix californiae
  Cellulose docking domain, dockering
tcaaggttacccatgttgtgaaaatagtactatagtatattacactgatgacgatggtgactggagtgttgaaaataatgattggtgtatcattagaaa

SEQ ID NO: 17802 - DNA, 123 bp, Neocallimastix californiae
  Cellulose docking domain, dockering
ttcctctaagattacttctcaaggttacagttgctgttctgctagctgtgaaattgtctacactgatgatgatggtacttggggtgtcgaaaatggtgactggtgtggatgtggaggaggagt

SEQ ID NO: 17803 - DNA, 120 bp, Neocallimastix californiae
  Cellulose docking domain, dockering
tccagcttcaattaccaaccaaggatatgcttgctgtgctgttggttgtgaagttgtttacactgataatgatggtgaatggggagttgaaaacaatgaatggtgtggatgtggtaaagc

SEQ ID NO: 17804 - DNA, 123 bp, Neocallimastix californiae
  Cellulose docking domain, dockering
ttctagtgctattcttgctcaaggatattcatgctgttcttcatgtggtaccgtttactacaccgatgctgatggtgactggggtgttgaaaacaatgactggtgtggtatgccaaccaaatg

SEQ ID NO: 17805 - DNA, 82 bp, Neocallimastix californiae; identical to SEQ ID NO: 15255
  Cellulose docking domain, dockering

SEQ ID NO: 17806 - DNA, 123 bp, Neocallimastix californiae
  Cellulose docking domain, dockering
ttgttggtcaaaagcattaggttacacatgttgttctacttgtacatccgttattgacagtgatgccagtggtgattggggaattgagaatggtgaatggtgtggtattccagaaagttgtag

SEQ ID NO: 17807 - DNA, 109 bp, Neocallimastix californiae
  Cellulose docking domain, dockering
tcaaggatatccatgctgtcaaaaaacatgtgaagtatattccacagatagtgatggtagttggaatattgaaaataatgactggtgtttaattgacaaatcaaagtgt

SEQ ID NO: 17808 - DNA, 126 bp, Neocallimastix californiae
  Cellulose docking domain, dockering
ctgttggtctgaaacttacggttacccatgctgtcaatctacttgtgcccgtcttattgaagatgaaagtggtgcctggggtgctgaaaatggtgaatggtgtggtattcaagctgaaaattgtaa

SEQ ID NO: 17809 - DNA, 114 bp, Neocallimastix californiae
  Cellulose docking domain, dockering
atgttgggctagcatcatcggttacccatgttgtcaaaagtcaactatagtctatgatgaagatgaatatggtacctggagttatgaagatgatcactggtgtggtattcttaa

SEQ ID NO: 17810 - DNA, 126 bp, Neocallimastix californiae; identical to SEQ ID NO: 17808
  Cellulose docking domain, dockering

SEQ ID NO: 17811 - DNA, 114 bp, Neocallimastix californiae; identical to SEQ ID NO: 17809
  Cellulose docking domain, dockering

SEQ ID NO: 17812 - DNA, 120 bp, Neocallimastix californiae
  Cellulose docking domain, dockering
ctgctggtcaatagatttaggttatccatgttgtgaaccaggtactgaagttatctatgctgacgaatctggtgaatggggtgttttaaatgatgattggtgtggtattccagaagaaga

SEQ ID NO: 17813 - DNA, 123 bp, Neocallimastix californiae
  Cellulose docking domain, dockering
ctgctggtcgacttcacttggttatccatgttgtaaaactaattgtgaagttcttgatacagatgataatggtaattggggtgttgaaaatgatgaatggtgtggtatttctgaatcttgtgg

SEQ ID NO: 17814 - DNA, 120 bp, Neocallimastix californiae
  Cellulose docking domain, dockering
gtgtaaatttgaagcaattggttatccatgttgttctcattgtgatgtaattttaactgatgatgatggaaactggggtgctgaaaatggtcaatggtgtggtattcctgaaaactgtgg

SEQ ID NO: 17815 - DNA, 102 bp, Neocallimastix californiae
  Cellulose docking domain, dockering
ttacgattgttgtaaaggatgtcaaaccattttaactgatgaagaaggcaattggggttctgaaaatggtcagtggtgttttgttgatgaaaaaaaatgtga

SEQ ID NO: 17816 - DNA, 120 bp, Neocallimastix californiae
  Cellulose docking domain, dockering
ttgtttttctgaagatcttggatacaaatgttgtcaaggatgtactgtagttagtactgatgaatctggtgaatggggtatcgaagacaatgaatggtgtggtattccaagttcttgtaa

SEQ ID NO: 17817 - DNA, 111 bp, Neocallimastix californiae
  Cellulose docking domain, dockering
gtccgagccagattatccatgctgtaaggataatagtaacattgtatactctgatggtcaaggtgattggggttatgaaaatgaaaactggtgtggaattgtaaaagatag

SEQ ID NO: 17818 - DNA, 99 bp, Neocallimastix californiae
  Cellulose docking domain, dockering
aagttatccatgttgtacagaagaacaagaaccagtttatgttgatgatcttggtaaatggggtattgaaaataatgactggtgtggtattaagccaac

SEQ ID NO: 17819 - DNA, 120 bp, Neocallimastix californiae
  Cellulose docking domain, dockering
ttgctggtctgaagctagtggttaccattgctgtaagttgtgcaatatttcttattcagatgacagtggtgattggggtgttgaaaacaatgaatggtgtggtattccagattcatgtaa

SEQ ID NO: 17820 - DNA, 114 bp, Neocallimastix californiae
  Cellulose docking domain, dockering
tacaggttcaaatgatggttactcatgttgtaaaacctgtaatgttgcttacactgatgatcaaggtgattggggttttgaaaatgatgaatggtgtggtatcaaatcttcttg

SEQ ID NO: 17821 - DNA, 93 bp, Neocallimastix californiae
  Cellulose docking domain, dockering
tttatgttgtaaggaaggaacagaagttatttatactgatgaggaaggtgattggggcttagatggaaagaactggtgtaaaataaagaaggc

SEQ ID NO: 17822 - DNA, 96 bp, Neocallimastix californiae
  Cellulose docking domain, dockering
tttcccatgctgtaagggttgcgatgttgcattctctgacactactggtgattggggtgttgaaaataatgaatggtgtggtattaaatccacttg

SEQ ID NO: 17823 - DNA, 120 bp, Neocallimastix californiae
  Cellulose docking domain, dockering
ttgctgggctaagaaattaggttatgactgctgtactggatgtaactctgtttacagtgatgaaagtggagaatggggatttgaaaacgataaatggtgtggtattgttgaaaattgtaa

SEQ ID NO: 17824 - DNA, 108 bp, Neocallimastix californiae
  Cellulose docking domain, dockering
ggaaccagattacccatgttgtacttcatgtaatgttgtagaaactgatggtaatcaaagatggggtattgaaaataatgaatggtgtggtattccagactcttgccc

SEQ ID NO: 17825 - DNA, 96 bp, Neocallimastix californiae
  Cellulose docking domain, dockering
cccatgttgcgcatcttgtgatgttgttcgtgaaacagacgaaggagaatggggtattgaaaatgatgaatggtgtggtattaaagaatcatgtaa

SEQ ID NO: 17826 - DNA, 117 bp, Neocallimastix californiae
  Cellulose docking domain, dockering
ttgctgggctaaggctttaggttatgaatgttgtaaaacttgccaagcttctcaattaaaggatgaaagtggtgattggggtattgaaaatggtgaatggtgtggtattaccggtga

SEQ ID NO: 17827 - DNA, 105 bp, Neocallimastix californiae
  Cellulose docking domain, dockering
tgctcttggttatccatgttgtaaagaaactttcgaagctacttacaccgatgaaaatggtaagtgggctattgaaaacgatgagtggtgtgaagttaaggaaaa

SEQ ID NO: 17828 - DNA, 120 bp, Neocallimastix californiae
  Cellulose docking domain, dockering
ttgttgggctgaaaaattaggatataaatgttgtaaggaatgtactgttacatataatgatgaaaatggtgattggggttttgaaaatggtgattggtgtggtattttaagaacttgtac

SEQ ID NO: 17829 - DNA, 120 bp, Neocallimastix californiae
  Cellulose docking domain, dockering
ttgctggtcagaatctcttggttatccttgttgtacaaaaactactgaagtagtatctgaagatagtgatggtcaatggggcttagaaaatgataattggtgtggaattgtttctagctc

SEQ ID NO: 17830 - DNA, 102 bp, Neocallimastix californiae
  Cellulose docking domain, dockering
tgattatccatgctgttcaagctgtcaaactatatacagtgataatgatggagattggggatacgaagacgataaatggtgtggtattaaggatagttgtaa

SEQ ID NO: 17831 - DNA, 123 bp, Neocallimastix californiae
  Cellulose docking domain, dockering
ttgctggtcagaaagtcaaggctacaattgctgttctggctgtgaagttgtttatgaagacgattctggtaagtggggtgttgaaaatgatgattggtgtggtattgaagactctgtctgtaa

SEQ ID NO: 17832 - DNA, 99 bp, Neocallimastix californiae
  Cellulose docking domain, dockering
ctatccatgttgtgaagaaagtaccgatgtagtatattcagatgaaagtggtgattggagtgttgaaaatgatgattggtgtggtatcattaaatccac

SEQ ID NO: 17833 - DNA, 117 bp, Neocallimastix californiae
  Cellulose docking domain, dockering
ctcttcttctattcaaagacaaggttacaaatgttgtaagcctggatgtgaaattatttatgttgataatgatggaaattggggtgttgaaaatggtcaatggtgtggatgtggtga

SEQ ID NO: 17834 - DNA, 117 bp, Neocallimastix californiae
  Cellulose docking domain, dockering
tattactgaccaaggatacaattgttgctcatcttgttccttcgtgtactacaccgatagtgatggtaactggggtgttgaaaacaacgactggtgtggtatgccatcaaactgcaa

SEQ ID NO: 17835 - DNA, 120 bp, Neocallimastix californiae
  Cellulose docking domain, dockering
ctgctggtcattatctcaaggatatccatgctgtcaatcatgtaatgttacctatgaagatgaatccggtaagtggggtgttgaaaatggtaactggtgtggtattgctaagacctgcag

SEQ ID NO: 17836 - DNA, 111 bp, Neocallimastix californiae
  Cellulose docking domain, dockering
tgctggttacccatgctgtgccagatcctgcattgttgtcactaaagatgatgatggctactggggtattgaaaataataactggtgtctcattgataaggacctctgtat

SEQ ID NO: 17837 - DNA, 112 bp, Neocallimastix californiae; identical to SEQ ID NO: 15287
  Cellulose docking domain, dockering

SEQ ID NO: 17838 - DNA, 111 bp, Neocallimastix californiae
  Cellulose docking domain, dockering
atgctgggcaaagtcattaggttataattgctgttctcattgttcagtatcctatactgatgaaaatggaaaatggggtgttgaaaataatgagtggtgtggtattacatg

SEQ ID NO: 17839 - DNA, 105 bp, Neocallimastix californiae
  Cellulose docking domain, dockering
ctatccaacttatccatgttgtaaaggaaatactgtaatttatactgatgagcaaggtgcatggggtattgaaaatgataactggtgtggaatagaatcatcatc

SEQ ID NO: 17840 - DNA, 114 bp, Neocallimastix californiae
  Cellulose docking domain, dockering
atgttggtcagaaaaattgggctatccatgctgtaaatcaacaaatgatgtttattacgaagatgatgatggtcaatggggtgttgaaaacaatgattggtgcggcatccaaag

SEQ ID NO: 17841 - DNA, 120 bp, Neocallimastix californiae
  Cellulose docking domain, dockering
atgctggtctgaaaaattaggttatccatgttgcaattcaactaatgaagttgtttatgaagataatgatggaccatggggagttgaaaacaataattggtgtggtattatcaacaataa

SEQ ID NO: 17842 - DNA, 123 bp, Neocallimastix californiae
  Cellulose docking domain, dockering
ttgctggtcagctgccatgggatataattgttgtaaaggatgtacagtttatattgaagatcagagtggtcaatggggttatgaaaaccatcagtggtgtggtatagatgataaagtttgtaa

SEQ ID NO: 17843 - DNA, 96 bp, Neocallimastix californiae
  Cellulose docking domain, dockering
atatccatgttgtgaaggtaattctattgttacttcagacagtcaaggagattggggatatgaaaataatcattggtgtggtattatcaagaagga

SEQ ID NO: 17844 - DNA, 96 bp, Neocallimastix californiae
  Cellulose docking domain, dockering
ttatccatgttgtgaaggtaataccatcgttactacagatagtcatggagattggggttatgaaaataaccattggtgtggtatactaaagcaaac

SEQ ID NO: 17845 - DNA, 117 bp, Neocallimastix californiae
  Cellulose docking domain, dockering
atgtggagctgctgctatcggttacccatgttgtgaaaatacctgtactgaagtctacactgatgaatacagatggggtgttgaaaacaatgactggtgtggtcttaaggattcatg

SEQ ID NO: 17846 - DNA, 108 bp, Neocallimastix californiae
  Cellulose docking domain, dockering
tgaaccagattacaaatgctgttctacttgtgatattgtttacactgatgatcataattggggtgttgaagatgatgaatggtgtggtattgatgatgccaaatgtaa

SEQ ID NO: 17847 - DNA, 114 bp, Neocallimastix californiae
  Cellulose docking domain, dockering
tccaggttcaaatcaaggttattcatgctgtaaaacctgtgaagtttatatgacggatgaaactggaccatggaatattgaaaatgatgagtggtgtagtgtaaaaactaattg

SEQ ID NO: 17848 - DNA, 129 bp, Neocallimastix californiae
  Cellulose docking domain, dockering
ttgttggtctgaatcccttggttatccatgctgttccatgggatgtaacgccataaattattatacagatgatgatggcttctggggtgttgaaaatgatgattggtgtggtattccatcacaatgtca

SEQ ID NO: 17849 - DNA, 120 bp, Neocallimastix californiae
  Cellulose docking domain, dockering
ttctgccaagattgttcaacaaggttacaagtgttgtggtaacaactgtattgttgtttaccaagataatgatggttactggggtgttgaaaacaaccaatggtgtggatgtggaactga

SEQ ID NO: 17850 - DNA, 99 bp, Neocallimastix californiae
  Cellulose docking domain, dockering
taaacaaggttatccatgctgtaagaacaccaaagcagttgtcttcagagacaatgatggtaactggggtattgaaaacaacgattggtgttacattaa

SEQ ID NO: 17851 - DNA, 117 bp, Neocallimastix californiae
  Cellulose docking domain, dockering
ttgtaaagcctctttaattggctatgcctgttgttcaccagaaaacactacgattcaatatcatgatgaagatggtgattggggtgttgaaaatggtgaatggtgtggtattacttc

SEQ ID NO: 17852 - DNA, 117 bp, Neocallimastix californiae
  Cellulose docking domain, dockering
ctgtttctcaaaatttttaggatatccatgttgttcttcagttgttgaagtcgcttatattgatgaagatggaaaatggggaatagaaaatgatgcttggtgtggaattagtagtaa

SEQ ID NO: 17853 - DNA, 120 bp, Neocallimastix californiae
  Cellulose docking domain, dockering
atgttggtctgataaattaggttatccatgttgtagcggatgtactgaaaatgtttatgaagataatgatggcaaatggggtgttgaaaatggcgattggtgtggtattccaattaattg

SEQ ID NO: 17854 - DNA, 120 bp, Neocallimastix californiae
  Cellulose docking domain, dockering
gtgtgtcgtcgcttctttgggttatgcctgttgttctccaggtaacactgtagtctactaccaagatgaaaatggtgattggggtgttgaaaatgatgactggtgtggtattactagagc

SEQ ID NO: 17855 - DNA, 120 bp, Neocallimastix californiae
  Cellulose docking domain, dockering
ttgctggtctgaaagattaggttatccatgttgtacttcaactaatggaatctatttttctgataacgatggagattggggtattgaaaatgatgattggtgtggtattccaaagcaaag

SEQ ID NO: 17856 - DNA, 120 bp, Neocallimastix californiae
  Cellulose docking domain, dockering
ctgctggtctaaggctttaggatataactgctgtacctcaacttcagatgtaatcttcgaagacagtgatggtcaatggggtattgaaaacgacgattggtgtggtattgttaaaaacaa

SEQ ID NO: 17857 - DNA, 132 bp, Neocallimastix californiae
  Cellulose docking domain, dockering
ctgttggagtgaaagtctcggttacagatgttgtaaagatgatgaaagcattgttgaatatattgatgaagatggatggtggggtgttaccaatgatgaaaaaccagactggtgtggtattattaagaacga

SEQ ID NO: 17858 - DNA, 96 bp, Neocallimastix californiae; identical to SEQ ID NO: 15309
  Cellulose docking domain, dockering

SEQ ID NO: 17859 - DNA, 129 bp, Neocallimastix californiae
  Cellulose docking domain, dockering
ttcttccaagattcttgctcaaggttacaagtgctgttcttctaactgtagtgttgtttacactgatgctgatggaacttggggtgttgaaaataaccaatggtgtggttgtggtaataaggtttgtgt

SEQ ID NO: 17860 - DNA, 105 bp, Neocallimastix californiae
  Cellulose docking domain, dockering
tcaatatgaatgttgcagtaactgtgaagttatatattcagatgatgaaggtgattggggtgtagaaaattatgattggtgttttattgataaatctaaatgtga

SEQ ID NO: 17861 - DNA, 108 bp, Neocallimastix californiae
  Cellulose docking domain, dockering
taatggatacccaaaatgtagttcttgtgtagtatattacactgatgagaatggcgattggggtgtagaaaacaatgattggtgtcttattcaaaaaagtagatgtgg

SEQ ID NO: 17862 - DNA, 120 bp, Neocallimastix californiae
  Cellulose docking domain, dockering
ttgctggtcaagttcattaggatatgattgttgtgatgattgtaatacattatatactgatgaatctggtgattggggtgttaaaaataatgattggtgtggtattccaacctcatgtaa

SEQ ID NO: 17863 - DNA, 120 bp, Neocallimastix californiae
  Cellulose docking domain, dockering
ttgttggtctaaagcattaggttatgattgttgtgatgattgtaatactttatatactgacgatagtggtgattggggtgttaaaaataatgattggtgtggtattcctcaaaactgtaa

SEQ ID NO: 17864 - DNA, 117 bp, Neocallimastix californiae
  Cellulose docking domain, dockering
ttctacttctattattgctcaaggttacaaatgttgttctgatagatgtgaagttgtctaccaagatggtgatggtgactggggtgtagaaaacggcgaatggtgtggttgtagtgt

SEQ ID NO: 17865 - DNA, 120 bp, Neocallimastix californiae
  Cellulose docking domain, dockering
aaccagcattactgatcaaggttacaaatgttgttcaacttgtggtaccgtttactacactgatgacgatggtgattggggtgttgaaaacaatgaatggtgtggtatgccatgcaattg

SEQ ID NO: 17866 - DNA, 117 bp, Neocallimastix californiae
  Cellulose docking domain, dockering
ttctgcttctattcttgcccaaggttacgaatgttgttctgatagatgtgaagttgtctaccaagatggtgatggtgactggggtgtagaaaacggcgaatggtgtggttgtggtgg

SEQ ID NO: 17867 - DNA, 120 bp, Neocallimastix californiae
  Cellulose docking domain, dockering
aaccagcattactgatcaaggttacagttgttgttcagtttgtggtaccgtttactacactgatggcgatggtgattggggtgttgaaaacaatcaatggtgtggtatgccatatgattg

SEQ ID NO: 17868 - DNA, 126 bp, Neocallimastix californiae
  Cellulose docking domain, dockering
ttgttgggctgaacgtcttggttatccatgttgttctgccaataatcaaaaaatttatgctcatgataatgatggtgattggggttataactggaaaaccaatgaatggtgtggtatttcaaaata

SEQ ID NO: 17869 - DNA, 111 bp, Neocallimastix californiae
  Cellulose docking domain, dockering
ttggtctgaacagttaggttatccatgttgtcaaggatgtaccgtttttgaaactgatgctgatggctcttggggttacgaaagtaatcactggtgtggtattcaatctta

SEQ ID NO: 17870 - DNA, 114 bp, Neocallimastix californiae
  Cellulose docking domain, dockering
ttgtttctcagaaagattaggttatccatgttgttctggtaatgaagttgtttacaccgataacgatggaaagtggggtgtagaaaatggtaattggtgtggtattgctgatgc

SEQ ID NO: 17871 - DNA, 120 bp, Neocallimastix californiae
  Cellulose docking domain, dockering
ttgttggtctctttctcaaggttatccatgctgttcttcttcaaatgctgaagtttggtacaccgatgcctcaggtaaatggggtgttgaaaatggagactggtgtggtattccaactgg

SEQ ID NO: 17872 - DNA, 117 bp, Neocallimastix californiae
  Cellulose docking domain, dockering
ttgggcttctgctttaggtttcaactgttgtaagactactaagactgttgtctttgaagatcaagatggtagttggggtgttgaagatgatttctggtgtggtatcgttgaagataa

SEQ ID NO: 17873 - DNA, 120 bp, Neocallimastix californiae
  Cellulose docking domain, dockering
ttgctggtctactaagttaggttacccatgttgtgaagtttctaatgtcatttactctgttgatgacaatggtagttggggttatgaagatgatcactggtgtggtcttcttaagaagaa

SEQ ID NO: 17874 - DNA, 108 bp, Neocallimastix californiae; identical to SEQ ID NO: 15323
  Cellulose docking domain, dockering

SEQ ID NO: 17875 - DNA, 114 bp, Neocallimastix californiae
  Cellulose docking domain, dockering
ttgtttctctgaaagattaggttatccatgttgttctggtaatgaagttgtttacactgataatgatggtaagtggggtgttgaaaatggtaattggtgtggtattgctgatgc

SEQ ID NO: 17876 - DNA, 120 bp, Neocallimastix californiae
  Cellulose docking domain, dockering
ttgctggtctactagcttaggttatccatgttgttcttcttcaaatgctgaagtttggttcactgatgactctggtaaatggggtgttgaaaatggtgactggtgtggtattccaactgg

SEQ ID NO: 17877 - DNA, 117 bp, Neocallimastix californiae
  Cellulose docking domain, dockering
atgttttgctgaaaaattaggttacccatgttgtagttcatgtgatgttctttacactgataatgatggtgaatggggtgttgaaaatgataattggtgtggtattaaggattcttg

SEQ ID NO: 17878 - DNA, 117 bp, Neocallimastix californiae
  Cellulose docking domain, dockering
ttgtttctcaatttctttaggtttcccatgttgtaaaggaaatacagttgtttactccgataatgatggggactggggtgtagaaaacaatgaatggtgtggtattagtaacaattt

SEQ ID NO: 17879 - DNA, 123 bp, Neocallimastix californiae
  Cellulose docking domain, dockering
ttcctctaagattatcagtcaaggttacaagtgttgttcctctaactgtgaagttgtttatactgatgatgatggaacatggggtgttgaaaatgaagaatggtgtggatgtggaaattctaa

SEQ ID NO: 17880 - DNA, 120 bp, Neocallimastix californiae
  Cellulose docking domain, dockering
ttcatcaaagattactgatctcggttacaagtgttgttcctctggttgtcaagttgtttacactgatgatgatggaacatggggtgttgaaaatgaagaatggtgtggatgtggacaaga

SEQ ID NO: 17881 - DNA, 123 bp, Neocallimastix californiae
  Cellulose docking domain, dockering
ctctgctaaaattcttaagcaaggttacgaatgttgtccaagtggctgtgatgttatttacactgacgatgatggtgattggggtgttaacaatggtgattggtgtggatgtggcactaataa

SEQ ID NO: 17882 - DNA, 99 bp, Neocallimastix californiae
  Cellulose docking domain, dockering
aagttatccatgttgttctagtggaattgaatctgcttatgaagatgatcttggtaagtggggtatagaaaatggtgattggtgtggtattaaacctac

SEQ ID NO: 17883 - DNA, 120 bp, Neocallimastix californiae
  Cellulose docking domain, dockering
atgtgctgctgaggcctttggctacaattgctgtaatggatgtacagtagttactacagatgaaactggtgattggggtgttgaaaatgatgaatggtgtggtattccaagctcatgtaa

SEQ ID NO: 17884 - DNA, 105 bp, Neocallimastix californiae
  Cellulose docking domain, dockering
tgaaccagattacccatgttgttctggtaatactgaaattatttattctgatgcttctggcgattggggttatgaaaataacaattggtgtggtattataagtac

SEQ ID NO: 17885 - DNA, 99 bp, Neocallimastix californiae; identical to SEQ ID NO: 17882
  Cellulose docking domain, dockering

SEQ ID NO: 17886 - DNA, 120 bp, Neocallimastix californiae; identical to SEQ ID NO: 17883
  Cellulose docking domain, dockering

SEQ ID NO: 17887 - DNA, 105 bp, Neocallimastix californiae; identical to SEQ ID NO: 17884
  Cellulose docking domain, dockering

SEQ ID NO: 17888 - DNA, 120 bp, Neocallimastix californiae
  Cellulose docking domain, dockering
atgtttctctaaagatatgggttatccatgctgtagtacttgtgaagttgcctatactgatagtgatggtggatggggtgttgaaaatggtgaatggtgtggtattaaagattcatgcta

SEQ ID NO: 17889 - DNA, 126 bp, Neocallimastix californiae
  Cellulose docking domain, dockering
ctgttgggcaagtactattggattcccatgttgtaagagtagttgtgaagttgcttacactgataatgacggtgattgggctattgaaaatgatgaatggtgtggaattgatccttctaaatgtaa

SEQ ID NO: 17890 - DNA, 117 bp, Neocallimastix californiae
  Cellulose docking domain, dockering
gtgttgggcctataagttaggttatccatgttgtgaaggtaatactataatagaaattaatgaagatggaaaatggggtattgaaaatgatgaatggtgtggtgtcattgaagaaac

SEQ ID NO: 17891 - DNA, 129 bp, Neocallimastix californiae
  Cellulose docking domain, dockering
ttgttggtctgaaccacttggttatccatgttgtaaagaaacaaagaaaatcgaatactatgatgataatggaccatggggaatggaaaatgatgattggtgtggtattgatgatgagaagtgttgggc

SEQ ID NO: 17892 - DNA, 120 bp, Neocallimastix californiae
  Cellulose docking domain, dockering
ttgttggtctctaaaacaaaactacccatgttgtaagattaccaaaaaagttcaatttacagatgaaaatggtaaatggggtgttgaaaaaggaaattggtgtggtattattgaagattc

SEQ ID NO: 17893 - DNA, 120 bp, Neocallimastix californiae
  Cellulose docking domain, dockering
atgttggtccactagtttaggttatccatgttgtgaaactacaaaggatattatatataatagtaataaaggttcttggggttatgaaaatgatagttggtgtggtattaatgaaacaga

SEQ ID NO: 17894 - DNA, 117 bp, Neocallimastix californiae
  Cellulose docking domain, dockering
ttgctggactttagatcaaagttatccatgttgttcaagtttgagcgcaaaggttgatggatacagtgataaatggggttatgaaaacggagattggtgtggtttaactgatgaaca

SEQ ID NO: 17895 - DNA, 123 bp, Neocallimastix californiae
  Cellulose docking domain, dockering
ctgctggtcgacttcacttggttacccatgttgtaaaactaattgtgacgtcgttgttactgatggagatggtgattggggtgttgaaaatgatgaatggtgcggtatttctaactcttgtgg

SEQ ID NO: 17896 - DNA, 120 bp, Neocallimastix californiae
  Cellulose docking domain, dockering
ttgctggtctttagctttaggttatccatgttgtgaaccaggtacaactgcaatttataccgatgattctggtgattggggtgttttaaatgatgattggtgtggtattcaggaggaaga

SEQ ID NO: 17897 - DNA, 123 bp, Neocallimastix californiae
  Cellulose docking domain, dockering
ctgctggtcagaaaaattaggttggccatgttgtagtaagggtaacactgaagtttactatgttgatgatgatggtgattggggtgttgaaaatgacgattggtgtggtatggaaaaagaaca

SEQ ID NO: 17898 - DNA, 111 bp, Neocallimastix californiae
  Cellulose docking domain, dockering
aaagggattaggcttcccttgttgtcaagaatgtacggtagtcaccagtgatgatgatggtgattggggtgttgaaaacaacgaatggtgtggtatccctaacagttgtta

SEQ ID NO: 17899 - DNA, 111 bp, Neocallimastix californiae
  Cellulose docking domain, dockering
gggaatggacttcccttgttgtcaaggttgtgaagtttactacactgatgatgatggtgaatggggattcgaaaataatcaatggtgtggtattaatagtgaaacttgtag

SEQ ID NO: 17900 - DNA, 123 bp, Neocallimastix californiae
  Cellulose docking domain, dockering
atgttgggctaaagatttaggcttctcctgttgtcaagcctgtgaagttacctatacagataatgatggtgattggggtttcgaaaatggcgattggtgtggtattattgaacaaaattgtaa

SEQ ID NO: 17901 - DNA, 123 bp, Neocallimastix californiae
  Cellulose docking domain, dockering
ctgctggtctactgccttaggctatccatgttgtgatacctgcgttagtgtttctttcgaagacggtgatggtaaatggggtattcaaaatgatgactggtgtggtttacaaaagagttgttt

SEQ ID NO: 17902 - DNA, 115 bp, Neocallimastix californiae
  Cellulose docking domain, dockering
tggagctcaaggttatccatgttgtaaatcatcatgcgatgtttattcttctgacaatgatggaaactggagtattgaaaacgacgattggtgtttaattgatgaagccaaatgt

SEQ ID NO: 17903 - DNA, 115 bp, Neocallimastix californiae; identical to SEQ ID NO: 17902
  Cellulose docking domain, dockering

SEQ ID NO: 17904 - DNA, 123 bp, Neocallimastix californiae; identical to SEQ ID NO: 17901
  Cellulose docking domain, dockering

SEQ ID NO: 17905 - DNA, 123 bp, Neocallimastix californiae
  Cellulose docking domain, dockering
ttcttcaaaaatcacagcccaaggttacaaatgctgttcagccaactgtgaagttgtttacactgatgatgatggtaactggggtgtagaaaacaacaactggtgtggatgtggtactgaaaa

SEQ ID NO: 17906 - DNA, 99 bp, Neocallimastix californiae
  Cellulose docking domain, dockering
agcgcaaggttatccatgctgtaagactgaaaccaccgtatacttcactgatgatgatggtaactggagtgttgaaaacggtgactggtgtttaattcc

SEQ ID NO: 17907 - DNA, 123 bp, Neocallimastix californiae
  Cellulose docking domain, dockering
ttgctggtctgaaccattaggttatccatgttgttcttcttgttcctatgtatactatgttgatgatgatggtaactggggtgttgaaaatgatgattggtgtggtttattaacaagctgtga

SEQ ID NO: 17908 - DNA, 123 bp, Neocallimastix californiae
  Cellulose docking domain, dockering
ctcttcctccttcacatctcaaggttatggatgctgctccagatgtggtgaagtttactttaccgatgaatctggtaattggggaattgaaaatggtgactggtgtggattaccaagtaattg

SEQ ID NO: 17909 - DNA, 117 bp, Neocallimastix californiae
  Cellulose docking domain, dockering
taaaaagataactagtcaaggttattcatgctgtccagctaattgtcaaatcgtttatacagattctgatggtacttggggtgttcataatgatcaatggtgtggatgtggtgaagg

SEQ ID NO: 17910 - DNA, 96 bp, Neocallimastix californiae
  Cellulose docking domain, dockering
cccatgttgttcaacttgtacttctgtcttcgaagataaagatggtaagtggggtgttgaaaatgaagaatggtgtttaattaagaaatcttgtga

SEQ ID NO: 17911 - DNA, 117 bp, Neocallimastix californiae
  Cellulose docking domain, dockering
atgctggagtaaagctttaggttatgactgttgtaaggaaggtactgatgttatttacacagatgaaagtggaaagtggggaatggacggcgatgattggtgtggtattattgaaac

SEQ ID NO: 17912 - DNA, 108 bp, Neocallimastix californiae
  Cellulose docking domain, dockering
aaatggttacgaatgttgtaaatcatgtgatgttgtatttactgatgatgatggtgaatggggtgtagaagacggtcaatggtgtggtattgataaagaaaaatgtaa

SEQ ID NO: 17913 - DNA, 106 bp, Neocallimastix californiae; identical to SEQ ID NO: 15363
  Cellulose docking domain, dockering

SEQ ID NO: 17914 - DNA, 120 bp, Neocallimastix californiae
  Cellulose docking domain, dockering
ctgcaagtttgaagctcttggttacaaatgctgttctaattgtattgccgtatttgaagatgatgatggttactggggttctgaaaacaatgaatggtgtggtattaccgaagaatgtgt

SEQ ID NO: 17915 - DNA, 120 bp, Neocallimastix californiae
  Cellulose docking domain, dockering
atgttggtctaataaatctggttacccatgctgtgatagctgtgacatctatttagatgatgaaaccggtaaatggggtgttatgaatggtgattggtgtggtatcccaacttcatgtga

SEQ ID NO: 17916 - DNA, 115 bp, Neocallimastix californiae
  Cellulose docking domain, dockering
cggtgcccaaggatatccatgttgtaagtcaacttgtgatgtttactctactgataatgatggaaaatggggtattgaaaacaatgactggtgtttaattgataaatctaaatgt

SEQ ID NO: 17917 - DNA, 123 bp, Neocallimastix californiae
  Cellulose docking domain, dockering
ttgctggtctgttggtttaggttaccaatgttgtaaatcttgtaatgtcgaatacaaagataatgatggtgaatggggtattgaaaacaataaatggtgtggtatttctaaagactgtgctac

SEQ ID NO: 17918 - DNA, 120 bp, Neocallimastix californiae
  Cellulose docking domain, dockering
ttgctggtctgttggtttaggttaccaatgttgtaaatcctgtgatgttgtcttcaaggataatgatggtgaatggggtgttgaaaatgaaaagtggtgtggtatttcgaaggactgtgc

SEQ ID NO: 17919 - DNA, 115 bp, Neocallimastix californiae
  Cellulose docking domain, dockering
tggtgctcaaggttatccatgttgtaaatcaacttgtgatgtttattctactgataatgatggaaagtggggtattgaaaacaatgactggtgtttaattgacaactctaagtgt

SEQ ID NO: 17920 - DNA, 114 bp, Neocallimastix californiae
  Cellulose docking domain, dockering
ctgtttcagtgaacgtttaggttatccatgttgtaaggataataaagtgctctatactaacgatattggaaattggggtattgaaaatggtaattggtgtggtattaaagatac

SEQ ID NO: 17921 - DNA, 99 bp, Neocallimastix californiae
  Cellulose docking domain, dockering
tggttatccaccatgtcaagaaactactgaagttctctacactgatgatagtgaatggggtgttgaaaatgacggttggtgcgtcatttgtaaaaagga

SEQ ID NO: 17922 - DNA, 114 bp, Neocallimastix californiae
  Cellulose docking domain, dockering
ctgtttcagtgaacgtctaggttatccatgttgtaagggtaatgaagtactctatactgacaatgatggaaaatggggtgttgaaaatgatgaatggtgtggtattaaggatac

SEQ ID NO: 17923 - DNA, 120 bp, Neocallimastix californiae
  Cellulose docking domain, dockering
atgctggtcagaaagattaggttggccttgttgtagtaaggaaaacactgatgtctactatgtggatgacgatggtgaatggggggttgaaaatgatgactggtgtggtatgagcactga

SEQ ID NO: 17924 - DNA, 112 bp, Neocallimastix californiae
  Cellulose docking domain, dockering
agctcaaggttatccatgttgtcaatcctcatgtaatgttatatccactgatagtgatggtaaatggagtgttgaaaatgatgactggtgtttaattgacagttctaaatgt

SEQ ID NO: 17925 - DNA, 120 bp, Neocallimastix californiae
  Cellulose docking domain, dockering
ctgttggtctattggtaaaggttacaactgttgtaaatcttgtaatgttgtctacaaggataatgatggtgaatggggtgttgaaaatgacaaatggtgtggtatctctgctgattgtgc

SEQ ID NO: 17926 - DNA, 123 bp, Neocallimastix californiae
  Cellulose docking domain, dockering
ttgttggtcagaaaaattaggttacccttgctgtacttccgaaaaagctaaagtttcttattctgatgaaaatggtcactggggcattgagaataatcaatggtgtggtattataaataatga

SEQ ID NO: 17927 - DNA, 126 bp, Neocallimastix californiae
  Cellulose docking domain, dockering
atgctgggcaaacaaagtaggatatccatgctgtgattttgataataataatgtaatatataaagataaagatggttcatggggtttaacaaatgaaaatgaatggtgtggtattataaatagtga

SEQ ID NO: 17928 - DNA, 126 bp, Neocallimastix californiae
  Cellulose docking domain, dockering
atgttgggcaaacaaagtaggatatccatgttgtgattttgataataataatgtaatatataaagataaagatggttcatggggtttaacaaatgaaaatgaatggtgtggtattataaatagtga

SEQ ID NO: 17929 - DNA, 102 bp, Neocallimastix californiae
  Cellulose docking domain, dockering
ctgtgctcaaggttacccatgttgtaagggtaaatctgaaatctattttgttgataaagatggtaactggggatatgaaaacggagattggtgtttacttgc

SEQ ID NO: 17930 - DNA, 123 bp, Neocallimastix californiae
  Cellulose docking domain, dockering
ttcagctaaaattcttgctcagggatacagttgctgtccaaaaggatgtagagtttatgtaactgatgatgatggtgattggggttatgtaaacaatgaatggtgtggttgcaaagtagattt

SEQ ID NO: 17931 - DNA, 120 bp, Neocallimastix californiae
  Cellulose docking domain, dockering
tccagcatccattactgatcaaggctacccatgctgttcaacaggatgtactgtttattacactgataatgatggtgattggggtgttgaaaacaaccaatggtgtggttgtggtaatgg

SEQ ID NO: 17932 - DNA, 120 bp, Neocallimastix californiae
  Cellulose docking domain, dockering
tccagcttctattactagtcaaggttatgaatgctgctctgaaaattgtgaaattgtttatactgatgatgatggtaattggggtgttgaaaataaccaatggtgtggttgtggaaatgg

SEQ ID NO: 17933 - DNA, 123 bp, Neocallimastix californiae
  Cellulose docking domain, dockering
ctgttgggctagtttctatggttacagttgctgtaagggttgtaaggttagatatgttgataatttaggttcttggggttatgaaggaaaccaatggtgtggaattgataccgaatcttgtgt

SEQ ID NO: 17934 - DNA, 123 bp, Neocallimastix californiae
  Cellulose docking domain, dockering
ctgttggtcagaatctaagggttatccatgttgtaaatcttgtgatgttgtaaccgtcgatagacatggttcatggggtattgaaaatggtcaatggtgtggtgtaaagtctgaagcttgtca

SEQ ID NO: 17935 - DNA, 123 bp, Neocallimastix californiae
  Cellulose docking domain, dockering
atgttgggctaagtctttaggttactcttgctgtaaatcatgtaaggtttacactgtcgataaacatggttcttggggtgttgaagacggtaaatggtgtggtattgatgctgaaacttgtaa

SEQ ID NO: 17936 - DNA, 123 bp, Neocallimastix californiae
  Cellulose docking domain, dockering
atgttggtctagtggttacggttatccatgttgtaacaattgtaaggtttacttcattgatgaaactggagaatggggtattcaagatggtaactggtgtggtattgtcgacagtaaatgtaa

SEQ ID NO: 17937 - DNA, 123 bp, Neocallimastix californiae
  Cellulose docking domain, dockering
ttgttggtctagtttctacggttatgattgctgtaagggttgtaaggttagatatgttgataatttaggttcttggggttatgaaggtaacaaatggtgtggtattgatgctgatacctgtag

SEQ ID NO: 17938 - DNA, 123 bp, Neocallimastix californiae
  Cellulose docking domain, dockering
ttgttggtctgaatcaaaaggttacaaatgttgtaaatattgtgatgttataagtgttgatagatttggttcttggggtgttgaaaatggtgaatggtgtggaattgattacgaaacatgtca

SEQ ID NO: 17939 - DNA, 123 bp, Neocallimastix californiae
  Cellulose docking domain, dockering
ctcttcttccattaccgctcaaggttacaagtgctgttcttcctgcggtaccgtctactacactgatggtgatggtgattggggtgttgaaaacggtaactggtgtggtatgccaaccaactg

SEQ ID NO: 17940 - DNA, 114 bp, Neocallimastix californiae; identical to SEQ ID NO: 15389
  Cellulose docking domain, dockering

SEQ ID NO: 17941 - DNA, 123 bp, Neocallimastix californiae
  Cellulose docking domain, dockering
ctgttgggctactaagcttggttataagtgttgtaccgctgaatgtccagttgtctactacactgatgatgatggtaagtggagtgttgaaaatgatgactggtgtggtattattaagacttg

SEQ ID NO: 17942 - DNA, 114 bp, Neocallimastix californiae
  Cellulose docking domain, dockering
ttgttgggctactaaaataggttactcatgttgtaagagtaccactcaagttgaatacactgatgatgatggtaagtggggtattgaaaacgatgattggtgtggtattgttga

SEQ ID NO: 17943 - DNA, 102 bp, Neocallimastix californiae
  Cellulose docking domain, dockering
tgctcaaggttatccatgctgtaaatcaaccaagcaagtttactacactgatgatgatggtagttggggtattgaagatggtgactggtgtattattagaaa

SEQ ID NO: 17944 - DNA, 120 bp, Neocallimastix californiae
  Cellulose docking domain, dockering
ttcctctaatattactagacaaggttacaaatgttgttccaagaattgtgtagtcgtttacactgataatgatggtacttggggtgttgaaaatgaagaatggtgtggttgtagtactgg

SEQ ID NO: 17945 - DNA, 120 bp, Neocallimastix californiae
  Cellulose docking domain, dockering
ttgttttgctacaaaattaggttatccatgctgtagtattggttatccatctattttaactgataaagatggtgactggagtgtggaaaatggtcaatggtgtggtataccttctaatga

SEQ ID NO: 17946 - DNA, 120 bp, Neocallimastix californiae
  Cellulose docking domain, dockering
ttgttggtcaattaaatttggttatccttgctgtattacttcatctgaagctttagtcactgatgataatggtcaatggggttctgaaaatggtcaatggtgtggtattgttaatagaga

SEQ ID NO: 17947 - DNA, 99 bp, Neocallimastix californiae
  Cellulose docking domain, dockering
tgcttacagcgaatgcaggggttgcgctgtatattatgttgaggatggtgttaattggggtgttgaaaacgacgactggtgtttaataccatcaagatg

SEQ ID NO: 17948 - DNA, 99 bp, Neocallimastix californiae
  Cellulose docking domain, dockering
atacacttgctgtgaaggctgtaatgttattgaagaagatggatctggtaagtggggtattgaaaataaccaatggtgtggtattaaagattcatgtaa

SEQ ID NO: 17949 - DNA, 105 bp, Neocallimastix californiae
  Cellulose docking domain, dockering
gggtaccggttatggttgctgtgtcttcaaaaataccattgttgaaaccgtggatgaaagtggtaaatggggacatgaaggtaatgaatggtgtcttgtagtcct

SEQ ID NO: 17950 - DNA, 126 bp, Neocallimastix californiae
  Cellulose docking domain, dockering
ctgttggtctcttgccgatggttatccatgttgtagaaaggaaaccactaaaattgaatatgtcagtaagagttccggtaaggaatggggtcttgaaaatggtgactggtgtggtatcaccgatag

SEQ ID NO: 17951 - DNA, 102 bp, Neocallimastix californiae
  Cellulose docking domain, dockering
cgaaagttactcttgctgtaagaaatgtgatgttatctacactgatgaatacaaatggggtgttgaaggtggagattggtgtattattccatactcttgtga

SEQ ID NO: 17952 - DNA, 123 bp, Neocallimastix californiae
  Cellulose docking domain, dockering
ttgttggtcaaaagcattaggttatgaatgctgtaaatcatgctctccagtttactttactgatgaagatggtgaatggggtgttgtaggtaatgattggtgtggtataccagctagttgtaa

SEQ ID NO: 17953 - DNA, 120 bp, Neocallimastix californiae
  Cellulose docking domain, dockering
tagaggtgcccaaggttacccatgctgtaagaagagttgtgctatttacagtactgatggtgatggtgattggagtattgaaaataatgattggtgtttaattgataactctatttgcaa

SEQ ID NO: 17954 - DNA, 120 bp, Neocallimastix californiae; identical to SEQ ID NO: 17690
  Cellulose docking domain, dockering

SEQ ID NO: 17955 - DNA, 120 bp, Neocallimastix californiae
  Cellulose docking domain, dockering
ttgtgtagttgcttctatgggttatgcctgctgttctccaaacaatactgaagtctacttccaagatgaaaatggtgactggggagttgaaaataacgattggtgtggtattactaaggc

SEQ ID NO: 17956 - DNA, 120 bp, Neocallimastix californiae
  Cellulose docking domain, dockering
atgttggtctgataaattaggtttcccatgttgtagcggttgtattgatactgtttacactgataatgatggtaaatggggtgttcaaaatgatgactggtgtggtattccaactaattg

SEQ ID NO: 17957 - DNA, 132 bp, Neocallimastix californiae
  Cellulose docking domain, dockering
ttgctggagtgaaacccttggctacagatgttgtaaggataatgaaaacattgttcaatacatcgatgaagatggatggtggggtgttactaatgatgaacaaccagattggtgtggtatcgttaagaatga

SEQ ID NO: 17958 - DNA, 123 bp, Neocallimastix californiae
  Cellulose docking domain, dockering
atgttggtctacttctttaggatactcctgttgtaaaacttgtactgatgttgtctttgtcgattcaagtggtaaatggggtgttgaaggagatgactggtgtggtattccaactagttgtga

SEQ ID NO: 17959 - DNA, 106 bp, Neocallimastix californiae
  Cellulose docking domain, dockering
aggttattcctgttgtaaatctaattgcaatgtttatgaagaagattcagatggaaaatggagtattgagaatgacgaatggtgcctaattgacgattctaaatgt

SEQ ID NO: 17960 - DNA, 114 bp, Neocallimastix californiae
  Cellulose docking domain, dockering
ttgctttgctgaaagattaggttacccatgttgttctggtaacgaagttgtttacaccgataacgatggaaagtggggtgtagaaaacggtaattggtgtggtattgccgatgc

SEQ ID NO: 17961 - DNA, 126 bp, Neocallimastix californiae
  Cellulose docking domain, dockering
ttcatcagctgttacctcccaaggttacaagtgctgtagtgctaacaattgtaatgtctacttcactgatgatgctggtaagtggggtattgaaaacgacgattggtgtggtatttccaaccaatg

SEQ ID NO: 17962 - DNA, 111 bp, Neocallimastix californiae
  Cellulose docking domain, dockering
tgctatcttaaagcaaggatacaagtgctgtgcctccggttgttctgttatctatactgatgatgatggtacttggggtgttgaaaatggtgaatggtgtggatgttccgc

SEQ ID NO: 17963 - DNA, 126 bp, Neocallimastix californiae
  Cellulose docking domain, dockering
ttgctggtctgaaagtttaggttttccatgttgtccttctagttattgcgaaattgttaaaactgatagtcatggttcatggggtttccgtaacaatgaatggtgtggaattagtactgattgtga

SEQ ID NO: 17964 - DNA, 117 bp, Neocallimastix californiae
  Cellulose docking domain, dockering
ctgtttctcagaaagattaggttacccatgttgtaagggtaacaatgtggtctacactgataatgatggaaagtggggtgttgaaaataataattggtgtggtattggttctaatag

SEQ ID NO: 17965 - DNA, 114 bp, Neocallimastix californiae
  Cellulose docking domain, dockering
ttgctggtctcaagctttaggttacccatgttgtactcacaaaaatgctgtttacactgatggtgatggtgattggggtgttgaaaatggtgattggtgtggtattattaaggg

SEQ ID NO: 17966 - DNA, 120 bp, Neocallimastix californiae
  Cellulose docking domain, dockering
ttcttctaagattattgctcaaggttacaagtgctgttctagtggttgtgaggttgtttacactgatgatgatggtacatggggtgttgaaaatgatgaatggtgtggatgtaatggtaa

SEQ ID NO: 17967 - DNA, 99 bp, Neocallimastix californiae
  Cellulose docking domain, dockering
tgctcaaggatacccatgttgtaaatccaataagactgtttactacactgatgatgatggtgattggagtgttgaaaatgatgattggtgtttaattgc

SEQ ID NO: 17968 - DNA, 105 bp, Neocallimastix californiae
  Cellulose docking domain, dockering
cggatatacatgttgtgaaggttgtaaagtatctgaaatagatggtgatggtattagttggggtatagaaaacggtgaatggtgtattgtacctttatcttgtaa

SEQ ID NO: 17969 - DNA, 99 bp, Neocallimastix californiae
  Cellulose docking domain, dockering
atattcatgttgtaaaagttgtactgtaattgccgaagatgataatggtcaatggggtattgaagatgatgaatggtgtggtattagagatagttgtag

SEQ ID NO: 17970 - DNA, 120 bp, Neocallimastix californiae
  Cellulose docking domain, dockering
atgtaccggttccaaccaaggttaccaatgttgtaacggttgtaaggttgaatacactgatggcgatggtccatggggtgttgaaaacggtcaatggtgtggtattaaaaatacttgtaa

SEQ ID NO: 17971 - DNA, 120 bp, Neocallimastix californiae
  Cellulose docking domain, dockering
ttgtttctctactagacttggcttcccatgctgtagtagctggaacaagaaagtcgaatttagcgatggtgatggtaactggggtattgaaaatggtagttggtgtggtattggtaacca

SEQ ID NO: 17972 - DNA, 123 bp, Neocallimastix californiae
  Cellulose docking domain, dockering
ttgctggtcaacttcattaggatatccatgttgtagttcatgtgttaatgccgcttatcaagataatgatggttactggggtgtagaaaatgatgattggtgtggaattccaaagagttgttc

SEQ ID NO: 17973 - DNA, 121 bp, Neocallimastix californiae
  Cellulose docking domain, dockering
ttgtatgggagctcaaggttatccatgttgtaaatctacttgtttagtttactctgaagatggtgatggtcaatggagtattgaaaacaatgactggtgtttaattgacaaatccaaatgc

SEQ ID NO: 17974 - DNA, 120 bp, Neocallimastix californiae
  Cellulose docking domain, dockering
gtgttggtctttagctgaaggttatccatgttgtgaaaagaagggaactaaagttagacatgtttctaagaatggtaatgaatggggtgttgaacatggtgactggtgtggtattaccga

SEQ ID NO: 17975 - DNA, 123 bp, Neocallimastix californiae
  Cellulose docking domain, dockering
atgttgggctaaggaattaggatttgagtgttgtacttcaaaagatattgaagttcaatacactgacaaagatggaaattggggaattgaaaatgatacatggtgtggtattattgaagaatc

SEQ ID NO: 17976 - DNA, 120 bp, Neocallimastix californiae
  Cellulose docking domain, dockering
ttgttgggcagaagaattaggttttaaatgctgttcttcgagtgatgccaaggtagaatatacagataatgatggtgaatggtctatagaagatggtaattggtgtggtattttaaaaaa

SEQ ID NO: 17977 - DNA, 96 bp, Neocallimastix californiae
  Cellulose docking domain, dockering
ttttccatgctgtaacggaaacactgttgtttatactgatatccaaggtgattggggttatgaaaacgataattggtgtggtattgtcaaaaagtc

SEQ ID NO: 17978 - DNA, 123 bp, Neocallimastix californiae
  Cellulose docking domain, dockering
ttgctggtcaactgctatgggatacaattgttgtagtggttgtaacgttgaaatagaagatgactccggtaaatggggtattgaaaataatcaatggtgtggtattgataacaatatctgtgg

SEQ ID NO: 17979 - DNA, 96 bp, Neocallimastix californiae
  Cellulose docking domain, dockering
atacccatgttgtaatggtgacactgttgtttatactgatggtcaaggagactggggttatgaaaatggagactggtgtggtattaaaaaacaaca

SEQ ID NO: 17980 - DNA, 99 bp, Neocallimastix californiae
  Cellulose docking domain, dockering
atataaatgttgtgaaagttgtaaagtttggtacactgatgaacaaggcgattggggtgttgaaaataatgattggtgttccattaaatattcatgttc

SEQ ID NO: 17981 - DNA, 126 bp, Neocallimastix californiae
  Cellulose docking domain, dockering
ttgttggtctgagaaattaggatatagttgttgtcaaaaaacatgtaagattaagtacactggtacagatggtaaatggggtattgaaaataatcagtggtgtggtattattgatagaatttgtga

SEQ ID NO: 17982 - DNA, 120 bp, Neocallimastix californiae; identical to SEQ ID NO: 17690
  Cellulose docking domain, dockering

SEQ ID NO: 17983 - DNA, 123 bp, Neocallimastix californiae
  Cellulose docking domain, dockering
ttgttgggtggctcaatttggttatccatgttgtagtagtaataacagagtagtttatgcctcagataatgaaggggactggggttacaattttgtaacaaaagaatggtgtggtattactcc

SEQ ID NO: 17984 - DNA, 117 bp, Neocallimastix californiae
  Cellulose docking domain, dockering
ctggtctgaagttcttggctatccatgttgtaaaggttgtactatttttgaggaggatgaagatggtcaatggggttatgatttcaaggaagctacctggtgtggtattcaaacctt

SEQ ID NO: 17985 - DNA, 109 bp, Neocallimastix californiae; identical to SEQ ID NO: 15436
  Cellulose docking domain, dockering

SEQ ID NO: 17986 - DNA, 123 bp, Neocallimastix californiae
  Cellulose docking domain, dockering
atgttggtctcttaagtatgactataaatgttgtacattaagaactacagaaccaaactacttctctaagacagccaataactggtatggtattgaaaatggagaatggtgtggtattacgga

SEQ ID NO: 17987 - DNA, 93 bp, Neocallimastix californiae
  Cellulose docking domain, dockering
atatccatgttgtaaagaatgtaacgtttattacacggataccgaagattggggtattgaaaatggagaatggtgttccattccacatacttg

SEQ ID NO: 17988 - DNA, 105 bp, Neocallimastix californiae
  Cellulose docking domain, dockering
taacaccgggtataattgttgtcttttcacaaccaccgttataacatcagattcggttggtgattggggtgttgaaaatgatgattggtgtctcattgaaagtag

SEQ ID NO: 17989 - DNA, 102 bp, Neocallimastix californiae
  Cellulose docking domain, dockering
gtacagatgttgtcttaagacttgtaaggcctcttatactgattctactggtgattgggctgtcgaaagtaataattggtgtttaattccttacacttgtaa

SEQ ID NO: 17990 - DNA, 117 bp, Neocallimastix californiae
  Cellulose docking domain, dockering
tgccatcttaaagcaaggttacaagtgttgttcaaaggattgtaccatcatttatactgatgatgatggttcatggggtgtagaaaatgatgaatggtgtggatgttctaatactgc

SEQ ID NO: 17991 - DNA, 126 bp, Neocallimastix californiae
  Cellulose docking domain, dockering
cccatcctctattacctctcaaggctataaatgctgtagtagtgataactgtaatgtatatgctactgatgatgatggtaaatggggtattgaagatggtgattggtgtggtatttctaagaattg

SEQ ID NO: 17992 - DNA, 109 bp, Neocallimastix californiae; identical to SEQ ID NO: 15442
  Cellulose docking domain, dockering

SEQ ID NO: 17993 - DNA, 120 bp, Neocallimastix californiae
  Cellulose docking domain, dockering
ttgctggtccctttctcaaggttacccatgctgttcctcttcaaatgctgaagtttggtacactgatgcctcaggtaaatggggtgttgaaaatggagattggtgtggtattccaactgg

SEQ ID NO: 17994 - DNA, 63 bp, Neocallimastix californiae
  Cellulose docking domain, dockering
ttacaccgacaatgatggtaaatggggtgtagaaaatggtaactggtgtggtattgatgatac

SEQ ID NO: 17995 - DNA, 93 bp, Neocallimastix californiae
  Cellulose docking domain, dockering
ttatccatgttgtagtgctggagcggaagtagtttatgaagatgatcaaggccaatggggtgttgaaaatggtgaatggtgtggtattgaacc

SEQ ID NO: 17996 - DNA, 105 bp, Neocallimastix californiae
  Cellulose docking domain, dockering
ggctgctccatatccatgttgtaagggaaatgaagttgtatatactgatgatcaaggtgattggggagttgaagatggtgattggtgtggtattgtaaaggataa

SEQ ID NO: 17997 - DNA, 117 bp, Neocallimastix californiae
  Cellulose docking domain, dockering
atgttggtctaagaagtatggttatccatgctgtgatacctgtaatgtattcatcattgataaatatggtgaatggggtatcaaggacaatgattggtgtggtattccatctacctg

SEQ ID NO: 17998 - DNA, 120 bp, Neocallimastix californiae
  Cellulose docking domain, dockering
ttgtaaatttgaagctcttggttacaagtgctgttctcactgtattagttacattgaagatgaggatggttcatggggtgttgaaaacggtaaatggtgtggtatctctgatgaatgtat

SEQ ID NO: 17999 - DNA, 120 bp, Neocallimastix californiae
  Cellulose docking domain, dockering
ttgttggtctgaaacttatggttatccatgttgtaaaactacaaataaggttgtatacaccgatgaggatggtaaatggggtgttgaagataaaaaatggtgtggtattataaaaaagga

SEQ ID NO: 18000 - DNA, 120 bp, Neocallimastix californiae
  Cellulose docking domain, dockering
ttgctggtctgaaaaacttggttatccatgttgttcatcttcagatgccgaaattatatataccgataaagatggtaattggagtattgagaattatgaatggtgtggtattccaaaagc

SEQ ID NO: 18001 - DNA, 117 bp, Neocallimastix californiae
  Cellulose docking domain, dockering
ctgtttcgcaaagtctgatggttatgactgttgtttcgataatgaagttgtttatgaagatgatagtggtaaatggggtataaatgatgaaggtgaatggtgcggtgttgaacaacc

SEQ ID NO: 18002 - DNA, 126 bp, Neocallimastix californiae
  Cellulose docking domain, dockering
ttgctgggctgaagcattaggatacaagtgttgtagtgctgatgccttcaccccagttattttcactgatagtgatggtgattggagtgctgaaaatggtgaatggtgtggtattttaaagagtga

SEQ ID NO: 18003 - DNA, 117 bp, Neocallimastix californiae
  Cellulose docking domain, dockering
ttgttggtctaagacatatggttatgattgttgtgctgaaggaactgctgtatatctcgaagatgaaagtggtaaatggggtgtcaccgatgattaccaatggtgtggtattaaaaa

SEQ ID NO: 18004 - DNA, 120 bp, Neocallimastix californiae
  Cellulose docking domain, dockering
atgtagagctcaagtgaaaggatttccatgctgtaaaccaaatactgaaattttttcagttgatgctgacggttactggggatataatgaggaaactggtgaatggtgtggtatatcacc

SEQ ID NO: 18005 - DNA, 96 bp, Neocallimastix californiae
  Cellulose docking domain, dockering
caactgttgtgaatcttgtaacatttacactgaagaagaaggtgataaatggggtgttgaaaatgatgaatggtgtagtattaagttcaagtgtta

SEQ ID NO: 18006 - DNA, 111 bp, Neocallimastix californiae
  Cellulose docking domain, dockering
gtcagaaccagattacccatgctgtaagtatagttgtgaagtttacttcactgatgatcataaatggggtattgaaaatggtgaatggtgtggtatttctgattcttgtgg

SEQ ID NO: 18007 - DNA, 106 bp, Neocallimastix californiae; identical to SEQ ID NO: 15457
  Cellulose docking domain, dockering

SEQ ID NO: 18008 - DNA, 120 bp, Neocallimastix californiae
  Cellulose docking domain, dockering
atgctgggctaatgaattaggttacgcatgttgtaagtcagcaaaaactgtttatgcaacagataaggatggcaaatggagtgtagaaaataatgaatggtgtggtatcgtagaaagcaa

SEQ ID NO: 18009 - DNA, 114 bp, Neocallimastix californiae
  Cellulose docking domain, dockering
atgtttttctgaaaagcttggttataaatgttgttatggaacaagagttgttttaactgattctgatggtaaatggggagttgaaaataatcaatggtgtggtatatcagataa

SEQ ID NO: 18010 - DNA, 117 bp, Neocallimastix californiae
  Cellulose docking domain, dockering
ctctattaacaatttaggttatccatgttgtgaaggttgtgaaattctgtatacagatgatgatggtgattggggggttgaaaatgaagattggtgtggcattccatatcattgtac

SEQ ID NO: 18011 - DNA, 120 bp, Neocallimastix californiae
  Cellulose docking domain, dockering
ttgttggtcacacagatacggttatccttgttgtactaaaacaaatgaagtattgtatagtgattcggatggtgattggggtatagaaaatggtgaatggtgtggtgttgctagaagttg

SEQ ID NO: 18012 - DNA, 126 bp, Neocallimastix californiae
  Cellulose docking domain, dockering
ttgttgggctgaagaatatggttattcatgttgtagtggatgcggtattgtcgtcgaagaacctggtaatgttaattggggtattgaatacgataagtggtgtggtatcataaattccaaatgtgg

SEQ ID NO: 18013 - DNA, 102 bp, Neocallimastix californiae
  Cellulose docking domain, dockering
cgctgaatatccatattgtaataattgtgtgactgtttacgaagacgatcaaaaatggggtattttaaataatcaatggtgtagaattttacctaattgtga

SEQ ID NO: 18014 - DNA, 120 bp, Neocallimastix californiae
  Cellulose docking domain, dockering
atgcactggtcaaaaccaaggatatcaatgttgtaatggttgtaaggtagaatataccgataatgatggtaaatggggtattgaaaataatcaatggtgtggtatcaaaaatacctgtag

SEQ ID NO: 18015 - DNA, 123 bp, Neocallimastix californiae
  Cellulose docking domain, dockering
ctgtttttctactagacttggttatccatgttgtagtagttggaataagcaagttgcatacacagataatgacggaaattggggtgttgaaaatggtaattggtgtggtataagtaatcaaca

SEQ ID NO: 18016 - DNA, 117 bp, Neocallimastix californiae
  Cellulose docking domain, dockering
atgtttttcagaaaaacttggatacaagtgttgtgaaggtaatgttgtagaatatatagatgaagatggtaagtggggaatagaaaatgatcaatggtgtggtatttctgatagtgc

SEQ ID NO: 18017 - DNA, 117 bp, Neocallimastix californiae
  Cellulose docking domain, dockering
ctctgctaatataaagaatcaaggatattcatgctgttcaaattgtattgtatattatacagataatgatggtaaatggggtatagaaaatgaatcatggtgtggtattccagattt

SEQ ID NO: 18018 - DNA, 120 bp, Neocallimastix californiae
  Cellulose docking domain, dockering
cccatctaccattaaggatcaaggttatccttgctgtaaatcatgtaacgttattcttactgatgaaagtggtgattggggtgttgaaaataatgattggtgtggcatttcagaaacttg

SEQ ID NO: 18019 - DNA, 120 bp, Neocallimastix californiae
  Cellulose docking domain, dockering
ttgtaaggcagaagctcttggttacaagtgttgctccacctgtgtcagtattcttgaagacgaaaatggcttatggggtgctgaaaatggtgaatggtgtggaattactgataaatgtat

SEQ ID NO: 18020 - DNA, 117 bp, Neocallimastix californiae
  Cellulose docking domain, dockering
atgctggtctactcaatttggttatccatgttgtgacacttgtgatgtattcttatctgatgaatctggtgattggggtgttaaagatttagattggtgtggtattccatccacttg

SEQ ID NO: 18021 - DNA, 102 bp, Neocallimastix californiae
  Cellulose docking domain, dockering
aaattacaaatgttgtaaagattgtcaagttgtatatgaagacgaagatggcaaatggggatatgaaaatgatgaatggtgtggtatgaaaagtagttgctt

SEQ ID NO: 18022 - DNA, 126 bp, Neocallimastix californiae
  Cellulose docking domain, dockering
atgctggtctgaaagtttaggttttccatgttgtccatctgactactgtgaagttgcaaaaaccgatagtagtggttcttggggtatctttgacaataattggtgtggtattagcactgattgtga

SEQ ID NO: 18023 - DNA, 108 bp, Neocallimastix californiae
  Cellulose docking domain, dockering
tgaaccagattacccatgttgtaaatctagctgtgaagtttactatactgatgaacataagtggggtgttgaaaatggagattggtgtggtattactgattcttgtgg

SEQ ID NO: 18024 - DNA, 102 bp, Neocallimastix californiae
  Cellulose docking domain, dockering
tgaatatccttgctgtgaaagttgtaacatttattctgaagaagaaggtgataagtggggtattgaaaacaacgattggtgtagtataaaattcaaatgtta

SEQ ID NO: 18025 - DNA, 114 bp, Neocallimastix californiae
  Cellulose docking domain, dockering
ttggtcaatcgcatttggttatccatgttgtactaacacttacactcaagttgtaatgaatgatgaatctggtgaatggggtgttgaaaatgatgattggtgtggtattgtaag

SEQ ID NO: 18026 - DNA, 123 bp, Neocallimastix californiae
  Cellulose docking domain, dockering
atgttggtcaattgcagttggttatccatgctgtagtaatgctaacgctgaaattataatgaccgatgaaagtggtaactggggtattgaaaatgatgattggtgtggtattttaaataatga

SEQ ID NO: 18027 - DNA, 114 bp, Neocallimastix californiae
  Cellulose docking domain, dockering
ctggtcagaagaatttggatatccatgctgtaaaaataaagatactaaagtttcatcaactgaccaaagtggaacatggggtattgaaaatggtaaatggtgtggtcttgaata

SEQ ID NO: 18028 - DNA, 117 bp, Neocallimastix californiae
  Cellulose docking domain, dockering
atgctggtctaaaaaatacggttacccatgttgtgaaaatactgaacagaaacctattacatatgatgcaacaggttcatggggatatgaaaataatagcttttgtggtcttaatca

SEQ ID NO: 18029 - DNA, 96 bp, Neocallimastix californiae
  Cellulose docking domain, dockering
tccttgctgtaatggttgtgatgttattgaagaaactgaagaaggtaaatggggtgttgaaaatgacgaatggtgtggtttgaaggattcatgctt

SEQ ID NO: 18030 - DNA, 102 bp, Neocallimastix californiae
  Cellulose docking domain, dockering
agcctttgcttacgaagaatgtaaaggttgtggagtagtttatgaagatgatatgaaatggggtgttgaaaatgatgattggtgtattatacctgcaaaatg

SEQ ID NO: 18031 - DNA, 114 bp, Neocallimastix californiae
  Cellulose docking domain, dockering
atgtttttctatagaattaggatatccatgttgtaaagataataaagtcatatataccgatgaaagaggtgattggggtaaagaaaatcatcaatggtgtggtattggtaatgg

SEQ ID NO: 18032 - DNA, 108 bp, Neocallimastix californiae
  Cellulose docking domain, dockering
attaaatccatcttatccatgttgtaaaggaaatgaagtcgtctatactgatgaaagtggtgattggggtgtagaaaataatagctggtgtggtattagtaatgataa

SEQ ID NO: 18033 - DNA, 120 bp, Neocallimastix californiae
  Cellulose docking domain, dockering
ttgtttttctattgttcaaggctatccatgttgtgaaacttgtcatattgactatactgatgaaagtggagattggggtgtagaagatgataaatggtgtggtataagggatgattgtaa

SEQ ID NO: 18034 - DNA, 117 bp, Neocallimastix californiae
  Cellulose docking domain, dockering
ttggtcaaatgaacttggttatccaagttgccaatctactaaagagattaaattttatgctgaacaaggaggctttggttatgaaaatggttcatggtgtggtttagaaaatgattt

SEQ ID NO: 18035 - DNA, 123 bp, Neocallimastix californiae
  Cellulose docking domain, dockering
atgttgggctaaagcattaggttatgaatgttgtaaaagtgaaaatccaaaagtttatactgttgatggtgatggtgaatgggctattgaaaatagtgaatggtgtggaataattaaaaaatg

SEQ ID NO: 18036 - DNA, 123 bp, Neocallimastix californiae
  Cellulose docking domain, dockering
atgttggtcattagatctaggttatccatgttgtaatcctaaaaataccaatgtagtatacacggatggaactggtaaatggggtgttgaaaatggtgattggtgtggtattattaataacat

SEQ ID NO: 18037 - DNA, 105 bp, Neocallimastix californiae
  Cellulose docking domain, dockering
ttgttggtcattagaccaaggctatccatgttgtgaaggtcaataccaaaagtatgatgatgattggggttatcaaaataatgaatggtgtggtattatagaaca

SEQ ID NO: 18038 - DNA, 108 bp, Neocallimastix californiae
  Cellulose docking domain, dockering
taatccattcccttgttgtaaaaatgatgacgtcaaagaaattggaaaggatatggatggagcatggggtgaagaaaatggaacgaaatgcggtattagaaataaacg

SEQ ID NO: 18039 - DNA, 117 bp, Neocallimastix californiae
  Cellulose docking domain, dockering
atgctttgctaaaagattaggatattcttgctgtactactactaaagaggtagtttccattgatcctaacggtaaatggggaatagaaaatggacacatttgcggaattgaagaaaa

SEQ ID NO: 18040 - DNA, 123 bp, Neocallimastix californiae
  Cellulose docking domain, dockering
atgtttatctgaatttattggatatccatgttgttcacctgaatttactaccatttatgcacaagatgaatatggagattggagctatgatttcgttaagaatgaatggtgtggtttaactgt

SEQ ID NO: 18041 - DNA, 120 bp, Neocallimastix californiae
  Cellulose docking domain, dockering
atgttggtcagaagaattaggatatccatgttgtaaaggatgcagagtctatgaaacggattctgatggatcctggggatatgagtttaatcaatggtgtggtattatttcagctcaatg

SEQ ID NO: 18042 - DNA, 121 bp, Neocallimastix californiae
  Cellulose docking domain, dockering
atgttggtcagaagaattaggatatccatgttgtaaaggatgcagagtctatgaaacggattctgatggatcctggggatatgaatttaatcaatggtgtggtattatttcagctaaatgc

SEQ ID NO: 18043 - DNA, 100 bp, Neocallimastix californiae; identical to SEQ ID NO: 15493
  Cellulose docking domain, dockering

SEQ ID NO: 18044 - DNA, 114 bp, Neocallimastix californiae
  Cellulose docking domain, dockering
ttgtttttctatagaattaggatatccatgttgtacagataataaagttatctataccgatgaaagaggtgattggggtaaagaaaatcatcaatggtgtggtattggtaatgg

SEQ ID NO: 18045 - DNA, 105 bp, Neocallimastix californiae
  Cellulose docking domain, dockering
attaaatccatcttatccatgttgtacaggaaatgaagtcgtctatactgatgaaaatggagattggggtgtagaaaataatagctggtgtggtattagtaatgg

SEQ ID NO: 18046 - DNA, 120 bp, Neocallimastix californiae
  Cellulose docking domain, dockering
ttgtttttctattgttcaaggctatccatgttgtaaaacttgtcatattgactatactgatgaaagtggagattggggtgtagaagatgataaatggtgtggtataaaggatagttgtaa

SEQ ID NO: 18047 - DNA, 114 bp, Neocallimastix californiae; identical to SEQ ID NO: 18044
  Cellulose docking domain, dockering

SEQ ID NO: 18048 - DNA, 105 bp, Neocallimastix californiae
  Cellulose docking domain, dockering
attaaatccatcttatccatgttgtacaggaaatgaagtcgtctatactgatgaaagtggagattggggtgtagaaaataatagctggtgtggtattagtaatgg

SEQ ID NO: 18049 - DNA, 114 bp, Neocallimastix californiae; identical to SEQ ID NO: 18044
  Cellulose docking domain, dockering

SEQ ID NO: 18050 - DNA, 120 bp, Neocallimastix californiae; identical to SEQ ID NO: 18046
  Cellulose docking domain, dockering

SEQ ID NO: 18051 - DNA, 105 bp, Neocallimastix californiae; identical to SEQ ID NO: 18045
  Cellulose docking domain, dockering

SEQ ID NO: 18052 - DNA, 114 bp, Neocallimastix californiae
  Cellulose docking domain, dockering
ttggtctgctccagattatccatgttgttcaaataatgctaatattatttattccgatggacaaggagattggggatatgaaaatgataattggtgtggaattgtaaattctgg

SEQ ID NO: 18053 - DNA, 120 bp, Neocallimastix californiae
  Cellulose docking domain, dockering
atgctctgctgaagcgtatggatacaagtgttgtaaaggatgtacagtagttacttctgatgaaacaggtgattggggtgttgaaaataatgaatggtgtggtattccaagttcttgtag

SEQ ID NO: 18054 - DNA, 99 bp, Neocallimastix californiae
  Cellulose docking domain, dockering
aagttatccatgttgttctactagtaccagtgtggtttatgaagatgaacttggtaagtggggtattgaaaatgatgattggtgtggtattaagccaac

SEQ ID NO: 18055 - DNA, 123 bp, Neocallimastix californiae
  Cellulose docking domain, dockering
atgctggtccactaagcttggttatggatgttgtgaaggatgtcatacttatgaagttgatgacaatggaaaatggggttatgaaaacggaaagtggtgtggtattgttgaagataaatgcca

SEQ ID NO: 18056 - DNA, 123 bp, Neocallimastix californiae
  Cellulose docking domain, dockering
ttgctggtctgaaaagttagattacccatgctgtacttctacctgttatgtttactcaactgatgtagatggtgaatggggttacgaagacaatcattggtgtggtgttccagcttcttgctc

SEQ ID NO: 18057 - DNA, 120 bp, Neocallimastix californiae
  Cellulose docking domain, dockering
ttgtaaatttgaagaaattggatattcatgttgctctcattgtgatgtagtatatactgatgaagatggtgactggggtactgaagatggtaaatggtgtggtattccagaaaactgtag

SEQ ID NO: 18058 - DNA, 126 bp, Neocallimastix californiae
  Cellulose docking domain, dockering
ctgttgggcagaagaacaaggttacccatgttgctctgatacgaatagaaaagttgaacaaattgatgataatggtaatgcttgggctatagaaaataatgattggtgtggtttacctaagaatac

SEQ ID NO: 18059 - DNA, 102 bp, Neocallimastix californiae
  Cellulose docking domain, dockering
ttatccatgttgtagtaatgagaataccgctgttataacaactgatgaacaaggtgattggggtgttgagaatggtgattggtgcggtattattaataaaaa

SEQ ID NO: 18060 - DNA, 111 bp, Neocallimastix californiae
  Cellulose docking domain, dockering
agctatcttaagtcaaggatataaatgctgttcaagcgattgtgttgtcatctttacggatgatgatggaacatggggtatagaaaacgatgaatggtgtggatgtaacac

SEQ ID NO: 18061 - DNA, 120 bp, Neocallimastix californiae
  Cellulose docking domain, dockering
ctccattacttctcaaggctacaaatgttgtaaggataacaactgttctgttattgaaacagatgatgctggtaaatggggtattgaagatgacgattggtgtggtatttctaacaaatg

SEQ ID NO: 18062 - DNA, 117 bp, Neocallimastix californiae; identical to SEQ ID NO: 17729
  Cellulose docking domain, dockering

SEQ ID NO: 18063 - DNA, 117 bp, Neocallimastix californiae
  Cellulose docking domain, dockering
ttgttggtcacttccatttggatacccatgttgtccacattgtaaggttcttactgaggatgagaatggtaaatggggagaattaaatggagaatggtgtggtattgttgctgataa

SEQ ID NO: 18064 - DNA, 117 bp, Neocallimastix californiae
  Cellulose docking domain, dockering
ttgttgggcaaatatacttggttatcaatgctgtgaaaatactaaagaagtatttttaaaggatgaaagtggtagttggggtattgaaaatgacgattggtgtggtatagttcaaga

SEQ ID NO: 18065 - DNA, 117 bp, Neocallimastix californiae
  Cellulose docking domain, dockering
ttgctgggcagatgctctcggatacaactgttgtatttatacaaaagaagtaatttacacagatgaaagtggagattggggtgtagaaaataatgaatggtgtggtattattgaaac

SEQ ID NO: 18066 - DNA, 120 bp, Neocallimastix californiae
  Cellulose docking domain, dockering
ttgtttctctgaagaaatgggttacccatgctgtagtgactgttccgtagtctacaccgatagtgatggtggttggggtgttgaaggtgatgactggtgtggtattaaggataaatgtta

SEQ ID NO: 18067 - DNA, 126 bp, Neocallimastix californiae
  Cellulose docking domain, dockering
ctgctggtctaaggctcttggttacccatgttgtaagagtagttgtgaagttatttactctgatgatgatggtgaatggggtgttgaagatgctgattggtgtggtattgaagcttcaaaatgtaa

SEQ ID NO: 18068 - DNA, 120 bp, Neocallimastix californiae
  Cellulose docking domain, dockering
ctggtctaagaagtttggttacgactgttgtaacggatgtacttcttatgaagaagattctaatggtaaatggggttatgaagaaaataaatggtgtggtattgtttcagaaaactgtaa

SEQ ID NO: 18069 - DNA, 123 bp, Neocallimastix californiae
  Cellulose docking domain, dockering
ttgctggtcagaaaaattaggttatccatgctgtgtttcttcttgttatgtttacgaatctgataatgaaggtgaatggggttatgaagacaatcactggtgtggtatttcatcatcatgtag

SEQ ID NO: 18070 - DNA, 114 bp, Neocallimastix californiae
  Cellulose docking domain, dockering
ctctgcttccattttagctcaaggatatgaatgctgttctgataactgtgaagttgtttatactgatgctgatggtgattggggtgttgaaaatgaacaatggtgtggttgtgg

SEQ ID NO: 18071 - DNA, 123 bp, Neocallimastix californiae
  Cellulose docking domain, dockering
ctcagttcgtattacttctcaaggttacgaatgctgctcatcttgtggtaccgtttactacaccgatgatgatggtgaatggggtgttgaaaacaacaattggtgtggtatgccaactaactg

SEQ ID NO: 18072 - DNA, 123 bp, Neocallimastix californiae
  Cellulose docking domain, dockering
atcaaacattgctgctcaaggatatcaatgttgtagtcctggtaactgtagtatctatcttgaagatgatactggtagatggggtattgaaaatgatgaatggtgtggtactccaagtaactg

SEQ ID NO: 18073 - DNA, 123 bp, Neocallimastix californiae
  Cellulose docking domain, dockering
ctctgctaagatcttaagtcaaggttacaagtgttgtaagaagggatgtgctatcatttatactgatgatgatggtacttggggtgttgaaaatggagaatggtgtggatgcacttcttctaa

SEQ ID NO: 18074 - DNA, 123 bp, Neocallimastix californiae
  Cellulose docking domain, dockering
atgtatggctgaaattattggttacccatgttgtgataaaaatgttaagactgtctatgaaaaagatgtctatggggattggggttatgacttcaagaagggtgaatggtgtggtcttactcc

SEQ ID NO: 18075 - DNA, 117 bp, Neocallimastix californiae
  Cellulose docking domain, dockering
atgttggtctgaagtatttggttatccatgttgtaagggatgttacgtctatgaaactgatgacgatggtaaatggggttatgaaaatcaacattggtgcggtattcaatcctactg

SEQ ID NO: 18076 - DNA, 120 bp, Neocallimastix californiae
  Cellulose docking domain, dockering
atgtgcttttgaaaaaattggttacaaatgttgtgaaagtactactgaagtcgtatttgaagatggaagtggtacttggggtgtagaaaacaatgaatggtgtggtattacgaataaggc

SEQ ID NO: 18077 - DNA, 105 bp, Neocallimastix californiae
  Cellulose docking domain, dockering
agcagatggatatgaatgttgtaatggttgtagtgttgttgaacaatcagatggttataagtggggtgttgaaaataataaatggtgtattatcaaaaacacttg

SEQ ID NO: 18078 - DNA, 108 bp, Neocallimastix californiae
  Cellulose docking domain, dockering
tacttctggctacaaatgttgtgatgattgtaatgttacttatgaagatagcactggtaaatggggtattaaggacaatgattggtgcgctatttctgataaatgtag

SEQ ID NO: 18079 - DNA, 117 bp, Neocallimastix californiae
  Cellulose docking domain, dockering
atgttggtcaacaaaattaggttatggatgttgtactggatgtgatgtatcatacactgataatgatggtgattggggatatgaaaacgattggtgtggtataccaactacatgtaa

SEQ ID NO: 18080 - DNA, 105 bp, Neocallimastix californiae
  Cellulose docking domain, dockering
aaaccaaggctattcatattgtaatttatgtgatgttatttacaatgacaatgatggccgatggggtattgaaaatggggaatggtgtggtattaaaagtacttg

SEQ ID NO: 18081 - DNA, 117 bp, Neocallimastix californiae
  Cellulose docking domain, dockering
ttgtttttccattaatcttggatatccatgttgtaatggtaatacagtctactatactgataatgatggtcaatggggttacgaaaacaacaactggtgtggtattaaggaatctaa

SEQ ID NO: 18082 - DNA, 123 bp, Neocallimastix californiae
  Cellulose docking domain, dockering
atgttggtctgagaaatacggttatccatgttgtgattcatgtattgatgttaatttcgaggattctaatggttattggggtattcaaaatggtgaaatttgtggtataccaaaggaatgttc

SEQ ID NO: 18083 - DNA, 117 bp, Neocallimastix californiae
  Cellulose docking domain, dockering
ctgtttctcagaggagcttggttatccctgctgttccagtggcgttttagtctatgaaaaggatgaacatggatcatggggtattgaaaataatgactggtgtggtattattggtag

SEQ ID NO: 18084 - DNA, 109 bp, Neocallimastix californiae
  Cellulose docking domain, dockering
ttgtttctccataccccttggctatccctgctgttctgagggcactccagaatactataccgatgagaatggttcatggggtgtagaaaatgatgactggtgtggactt

SEQ ID NO: 18085 - DNA, 120 bp, Neocallimastix californiae
  Cellulose docking domain, dockering
ttgctggtcttctaatttgggctattcatgttgtccttcaggtactcctgtttactttacagatgaaaatggtgactggggtatcattaatgatgactggtgtggtattgttgataattc

SEQ ID NO: 18086 - DNA, 120 bp, Neocallimastix californiae; identical to SEQ ID NO: 18085
  Cellulose docking domain, dockering

SEQ ID NO: 18087 - DNA, 109 bp, Neocallimastix californiae; identical to SEQ ID NO: 18084
  Cellulose docking domain, dockering

SEQ ID NO: 18088 - DNA, 120 bp, Neocallimastix californiae
  Cellulose docking domain, dockering
ctgtttctcagaggagcttggttatccctgctgttccagtggcgttttagtctatgaaaaggatgaacatggatcatggggtattgaaaataatgactggtgtggtattattggtagtga

SEQ ID NO: 18089 - DNA, 120 bp, Neocallimastix californiae
  Cellulose docking domain, dockering
tagtagtagaattacctctcaaggttataaatgctgtagtaactgtatcgtttactacactgataatgatggtgaatggggtgttgaagatggtaactggtgtggaacaccagacaaatg

SEQ ID NO: 18090 - DNA, 108 bp, Neocallimastix californiae
  Cellulose docking domain, dockering
ctggcaatacccatgttgtgataactgtgaagtttattatactgataatgaaggtaaatggggtattttaaacaatgactggtgtaaaatcaatgataaccgctgtaa

SEQ ID NO: 18091 - DNA, 111 bp, Neocallimastix californiae; identical to SEQ ID NO: 15541
  Cellulose docking domain, dockering

SEQ ID NO: 18092 - DNA, 117 bp, Neocallimastix californiae
  Cellulose docking domain, dockering
ttgctggtcggaaaaattaggttatccctgttgtaagccaacgaataccgaaattttagaagtagataaatacggtgaatggggtatggaaaatggtgaaagatgtggaattcatat

SEQ ID NO: 18093 - DNA, 114 bp, Neocallimastix californiae
  Cellulose docking domain, dockering
atgttggagtgctttattaggttacaaatgctgtaagaagagctttagtcctttatacaaagacaagaacggaatctggagtgttgaaaatgataaatggtgtggtgtagagct

SEQ ID NO: 18094 - DNA, 117 bp, Neocallimastix californiae; identical to SEQ ID NO: 18092
  Cellulose docking domain, dockering

SEQ ID NO: 18095 - DNA, 117 bp, Neocallimastix californiae
  Cellulose docking domain, dockering
tccatcctctatcactcgtcaaggttacaaatgttgtagagttggatgtactgttgaatacactgataatgatggtgaatggggtgttgaagatggtgactggtgtggttgtggtaa

SEQ ID NO: 18096 - DNA, 117 bp, Neocallimastix californiae
  Cellulose docking domain, dockering
taatgccaatattattgctcaaggttacaaatgttgtagagttggatgtactgttgaatacactgataatgatggtgaatggggtgttgaagatggtgactggtgtggttgtggtaa

SEQ ID NO: 18097 - DNA, 120 bp, Neocallimastix californiae
  Cellulose docking domain, dockering
atgtttctcggaatctcttggatataattgttgtaaaggatgtgatataattttaactgatgattatggttcatggggtgttgaaaataatgattggtgtggtattaacgattcttgtaa

SEQ ID NO: 18098 - DNA, 96 bp, Neocallimastix californiae
  Cellulose docking domain, dockering
agattatccatgctgtactggaaatgaagttgtttacacagatagtgatggcgattggggttacgaaaataatcaatggtgtggtattgctaaaaa

SEQ ID NO: 18099 - DNA, 99 bp, Neocallimastix californiae
  Cellulose docking domain, dockering
atataaatgttgttcagaaggtatagaatctatttttgaagattccattggtaagtggggtatagaagataatgaatggtgtggtattaaagctaataa

SEQ ID NO: 18100 - DNA, 126 bp, Neocallimastix californiae
  Cellulose docking domain, dockering
gtgttgggcacttgctgaaggttatccatgttgtaagaataaggatgccaaagtgtattctactgataagcatggtaaaaaatggggtattgaagataataattggtgtggtattattgaggaaga

SEQ ID NO: 18101 - DNA, 105 bp, Neocallimastix californiae
  Cellulose docking domain, dockering
taattctggttatagctgttgtgtattaactaagaaggttgaattaactgataacgttggtcagtggggtgttgaaaatggtgaatggtgtctttttgaagagga

SEQ ID NO: 18102 - DNA, 126 bp, Neocallimastix californiae
  Cellulose docking domain, dockering
ctgttgggctaaggctcttggttcaaactgttgtagtactagtagctgtagaaatgttgtttactttgactacgatggtcaatgggatgttgaaaatggtgaatggtgtggtatctctaccgaaaa

SEQ ID NO: 18103 - DNA, 120 bp, Neocallimastix californiae
  Cellulose docking domain, dockering
ctgttggtctaaaagtttaggttacccatgttgttcaggaaaatcagctgtactttatactgatgccagtggtcaatggggtgttgaaaatggtgactggtgtggtattgctaagaagtc

SEQ ID NO: 18104 - DNA, 120 bp, Neocallimastix californiae
  Cellulose docking domain, dockering
atgttttgcagaaaaattaggatactcatgttgtaatgaatgtaatattatttatactgataatgatggtgaatggggtatagaaaatgatgaatggtgtggtttaaaagatagatgcta

SEQ ID NO: 18105 - DNA, 117 bp, Neocallimastix californiae
  Cellulose docking domain, dockering
atgtacatttgaatctattggttacaaatgctgttcaaattcatgtactgtagtttatacagatgaaagtggtgattggggtgtagaaaatggtgaatggtgtggtattataccatt

SEQ ID NO: 18106 - DNA, 123 bp, Neocallimastix californiae
  Cellulose docking domain, dockering
ctgttggtctcaatccttaggttatggttgttgtagcggttgtattgatgtcattatgaccgataatgatggtgaatggggagtagaaaataatgattggtgtggtattccaaagacttgtaa

SEQ ID NO: 18107 - DNA, 118 bp, Neocallimastix californiae
  Cellulose docking domain, dockering
cagcggtgcccaaggttatccttgctgtaaatccacttgttcatcatatttccaagataacgatggtgaatggggtgttgaaaatgatgattggtgtttaattaataaatctatttgt

SEQ ID NO: 18108 - DNA, 109 bp, Neocallimastix californiae
  Cellulose docking domain, dockering
atgtttctctgttgacattggttatccatgttgtactaacaactccccagtttattacaccgatgatgatggtaaatggggtgttcaaaatggtgactggtgtggtctt

SEQ ID NO: 18109 - DNA, 117 bp, Neocallimastix californiae
  Cellulose docking domain, dockering
ctgttggtcaaagaagcttggttatccatgctgttcaaagaacgcttctaccgtatatactgatgctgatggtaagtggggtgttgaaaacaatgaatggtgtggtataaacagaaa

SEQ ID NO: 18110 - DNA, 120 bp, Neocallimastix californiae
  Cellulose docking domain, dockering
ttgtttttctattgttcaaggctatccatgttgtgaaacttgtcatattgactatactgatgaaagtggagattggggtgtagaagatgataaatggtgtggtataaaggatagttgtaa

SEQ ID NO: 18111 - DNA, 126 bp, Neocallimastix californiae
  Cellulose docking domain, dockering
ttgttggtccattgaacttggttatccatgctgtagtactagtgaatgtaaagttgtttatgaagaagatgatgacggcaaatggggtgctgaaaacaatgattggtgtggtatcacctctgaaaa

SEQ ID NO: 18112 - DNA, 123 bp, Neocallimastix californiae
  Cellulose docking domain, dockering
atgttggtcagaaaaattaggttattcatgctgttcagaaaacaacactagggttgtcttaactgatgatgatggtaaatggggagctgaaaacggtgaatggtgtggtattagagctaatcc

SEQ ID NO: 18113 - DNA, 120 bp, Neocallimastix californiae
  Cellulose docking domain, dockering
ttgttggtcagctgcagaaggtttcccatgttgttctacaactactgctgttgtccttactgatagtaagggtaagtggggtattgaaaataataattggtgtggtattgttgaatctgc

SEQ ID NO: 18114 - DNA, 123 bp, Neocallimastix californiae
  Cellulose docking domain, dockering
atgttgggctacatcacaaggttatccatgctgtactggatgtgatgcaatttacactgacggtagtggaaagtggggttttgaaaataataactggtgtggtattgtcgattctcaatgtaa

SEQ ID NO: 18115 - DNA, 111 bp, Neocallimastix californiae
  Cellulose docking domain, dockering
taaaaaagatggttttaattgttgtaatggttgtaccgttacctatactgatgcctctggtaaatggggtgttgagaataaccaatggtgtggtattgactcttcttgtga

SEQ ID NO: 18116 - DNA, 111 bp, Neocallimastix californiae
  Cellulose docking domain, dockering
taataccggctatcattgttgttctgatccaaataccacagtatatacttccgattcctcaggtgattggggtgttgaaggtgattactggtgtttaattgttaaggaaga

SEQ ID NO: 18117 - DNA, 114 bp, Neocallimastix californiae; identical to SEQ ID NO: 15568
  Cellulose docking domain, dockering

SEQ ID NO: 18118 - DNA, 120 bp, Neocallimastix californiae
  Cellulose docking domain, dockering
tcctaattcttctgatggttatccatgttgtccagattgtaatgtagtttacactgatgaaaataatcaagtttggggaaatttaaatgatgaatggtgttctattccatatcgttgtag

SEQ ID NO: 18119 - DNA, 117 bp, Neocallimastix californiae
  Cellulose docking domain, dockering
atgtccaggtgaaaatttaggttataattgttgtagttcttgtatagaaccatatgaagaagatgaaaatggaaaatgggctgttgtagatgaaagctggtgttctcttccatatta

SEQ ID NO: 18120 - DNA, 96 bp, Neocallimastix californiae
  Cellulose docking domain, dockering
agatttcccatgttgtacttccactacagaagttgttgaagtcgatgaaaatggagaatggggaattgaaaatggaaactggtgtggtattagatc

SEQ ID NO: 18121 - DNA, 117 bp, Neocallimastix californiae
  Cellulose docking domain, dockering
atgtttttctaatggtttaggttatccatgttgtaactcttgtgatattatttacattgatgaaagtggtaactggggtgttgaaaatggagattggtgtggtattaaggatacttg

SEQ ID NO: 18122 - DNA, 117 bp, Neocallimastix californiae
  Cellulose docking domain, dockering
ttgctttgctatatcattaggctattcatgttgtgagggaagtgaaattgtatataccgatgatgatggtgattggggttacgaaaatgacaattggtgtggaattgagaataataa

SEQ ID NO: 18123 - DNA, 117 bp, Neocallimastix californiae
  Cellulose docking domain, dockering
atgcccaggaaaatctgaaggatatcaatgctgttcatcatgtaacgttgtttttacagatgaaaacggttcatggggtgttgaaaataatgaatggtgtggtatcagaaatacatg

SEQ ID NO: 18124 - DNA, 123 bp, Neocallimastix californiae
  Cellulose docking domain, dockering
atgctttgctacaatattaggatttaattgttgtgcatcatgtattaactcaatatatgatgatgatgacggtcattggggattagaaaataatgattggtgtggaataccagaaaattgttt

SEQ ID NO: 18125 - DNA, 120 bp, Neocallimastix californiae
  Cellulose docking domain, dockering
ctgttgggctaaggctttaggttatgaatgttgtaagacttgtcaaactactgtatcaaaagatgaaaatggtgaatggggtattgaaaatgatgaatggtgtggtattacaaccgatat

SEQ ID NO: 18126 - DNA, 105 bp, Neocallimastix californiae
  Cellulose docking domain, dockering
tgctcttggatacccatgttgtgaaaacacatttgaagctacttatactgatgaaaatggtaaatgggccattgaaaatggtgattggtgtgaagttaaggaaaa

SEQ ID NO: 18127 - DNA, 99 bp, Neocallimastix californiae
  Cellulose docking domain, dockering
ctacccatgctgttctgaatgtaattctgtctactctgatgaatctggtgaatggggtgttgaaaacaatgattggtgtttattaaagaaatcttgtgg

SEQ ID NO: 18128 - DNA, 111 bp, Neocallimastix californiae
  Cellulose docking domain, dockering
ttgtttcgcaaaggcacaaggttttgaatgttgtaatgacagtgaagtagtatattctgatgattctggtgactggggtgttgttaatggacaatggtgtggtattggtgg

SEQ ID NO: 18129 - DNA, 105 bp, Neocallimastix californiae
  Cellulose docking domain, dockering
gaatgaaggatacagtaaatgtgataactgtgaagttgtttacagtgatgattctggtaactggggtgtccaaaacaatgattggtgtggtattagcaacaaatg

SEQ ID NO: 18130 - DNA, 102 bp, Neocallimastix californiae
  Cellulose docking domain, dockering
aggtcaagaatataattgttgtaaaggatgtgatgttatttataccgatacttcagattggggagttgaagatgatgattggtgttctattccatatacttg

SEQ ID NO: 18131 - DNA, 123 bp, Neocallimastix californiae
  Cellulose docking domain, dockering
atgttgggcaacagaacttggttatccatgttgtgaattaaaaactacaaaaatcgaatttacagatagtggttctggtaaacaatttggtgttgaaaataatcatatttgtggtattaatag

SEQ ID NO: 18132 - DNA, 105 bp, Neocallimastix californiae
  Cellulose docking domain, dockering
tggtgtccaaggttatccttgttgtaaaaatacatctactgtcttctatactgatgatgatggtgactggggtgttgaaaacaataactggtgtgtaatcaaaaa

SEQ ID NO: 18133 - DNA, 117 bp, Neocallimastix californiae
  Cellulose docking domain, dockering
aaagattcttgctcaaggatataaatgctgttctgacaagaattgtattgtatactatgaagatagcgatggttactggggaattgaaaatgatgattggtgtggttgtggaacaga

SEQ ID NO: 18134 - DNA, 123 bp, Neocallimastix californiae
  Cellulose docking domain, dockering
atgtacatcagaaaaattaggttacccatgttgttcctctaataataataaagtttattatactgataatgatggagattggggctttgatgaaaataccaataactggtgtggtttaactct

SEQ ID NO: 18135 - DNA, 121 bp, Neocallimastix californiae
  Cellulose docking domain, dockering
ttgttggtctgaacgtttaggttattcctgttgtcaaggatgtcaagtggtagaagtcgataacgacggtaactggggtatcgaaaatgatcaatggtgtggtatacccttagatagatgt

SEQ ID NO: 18136 - DNA, 117 bp, Neocallimastix californiae
  Cellulose docking domain, dockering
atgttggtctaagaagttcggtattgaatgttgtaaacaaacaaaggaagtcgtcagagaaacttatgatggtctctggggtaaggaaaatggtgaatggtgtggtcttggtgacaa

SEQ ID NO: 18137 - DNA, 105 bp, Neocallimastix californiae
  Cellulose docking domain, dockering
tccagcttacccatgttgctctaagtgtaacgttgtatatactgatgaagagggcgaatggggatacgaaaaaggatcatggtgtggtattaaagatacttgtaa

SEQ ID NO: 18138 - DNA, 123 bp, Neocallimastix californiae
  Cellulose docking domain, dockering
ttgttggtctgaaaaattaggatatgattgttgtaaacattgtaccgtatcctatactgacgaaagtggtgaatggggtgttgaagaagatgatgtttggtgtggtattttaaaaacttgtaa

SEQ ID NO: 18139 - DNA, 123 bp, Neocallimastix californiae
  Cellulose docking domain, dockering
atgctggtcagaaaaacttggctacaaatgttgtaaatattgtaatgttgaatatgaagatgaagaaggaaaatggggtctagaaaatgatgaatggtgtggtataaaaaagtcttcttgtga

SEQ ID NO: 18140 - DNA, 114 bp, Neocallimastix californiae
  Cellulose docking domain, dockering
ttgttggtctaaaaaatttaatattccatgttgtaaatcaactgatgctgttgtaagatcaacttatgatggtgaatggggtttagaaaatggtgaatggtgtggtcttggttt

SEQ ID NO: 18141 - DNA, 123 bp, Neocallimastix californiae
  Cellulose docking domain, dockering
ttgctggtctgaagttttaggttatccatgttgtaccagttcctgtcatgtctacagtactgacagtgatggtcaatggggttatgaagacgaccattggtgtggtattgctgattcctgtgc

SEQ ID NO: 18142 - DNA, 123 bp, Neocallimastix californiae
  Cellulose docking domain, dockering
atgctggtcaaagaaatttggctatggctgttgtgaaggatgccgtgcctatgaagaagatgctgatggtaaatggggttatgaaaacaatgaatggtgtggtattgttgaacaaaattgtca

SEQ ID NO: 18143 - DNA, 123 bp, Neocallimastix californiae
  Cellulose docking domain, dockering
ctgttggtctaaggcattaggctataattgttgtactaccacttccgtcgtccagtacgaagatcaagatggtccttggggtattgaaaataatgattggtgtggtatcataaaaaataataa

SEQ ID NO: 18144 - DNA, 117 bp, Neocallimastix californiae
  Cellulose docking domain, dockering
ttgttggtcttcccgattaggttacccatgctgtacttccaccaatagtatctacttttcggacggtgatggagattggggtatcgaaaataatcagtggtgtggccttccaaaaca

SEQ ID NO: 18145 - DNA, 117 bp, Neocallimastix californiae
  Cellulose docking domain, dockering
ttgcttttcagaaaaacttggttacaagtgttgtgaaggaagtgatgttgaattaattgatgaagatggtatgtggggtattgaaaatggtcaatggtgtggtatttctaatgatag

SEQ ID NO: 18146 - DNA, 96 bp, Neocallimastix californiae
  Cellulose docking domain, dockering
gtacaattgttgtcaaggttgtaaggtaaaatatgttgattctgaaaaatggggttatgaaaatggtgaatggtgttccattccatatagctgtga

SEQ ID NO: 18147 - DNA, 120 bp, Neocallimastix californiae
  Cellulose docking domain, dockering
atgttggtctatagaagaaggatatccatgttgccaaaagaaaacaaccaaagttaaacatgtttctaaaaatggaaatgaatggggtgttgaaaacaataattggtgtggtattactga

SEQ ID NO: 18148 - DNA, 120 bp, Neocallimastix californiae
  Cellulose docking domain, dockering
atgttgggcagaagcccttggttacaaatgttgtactaatactaaatccgtaaatttcacggatgaaaatggaagttggggttttgaaaacaatgttagatgtggtataattgaagagac

SEQ ID NO: 18149 - DNA, 120 bp, Neocallimastix californiae
  Cellulose docking domain, dockering
ttggtctcgttccattggttttgtttgttgtgataaatgtaatgttctttacgttgatgaacaaggtcaatggggtgttgaagatggctactggtgtggtatcaacccaagcaaatgtaa

SEQ ID NO: 18150 - DNA, 105 bp, Neocallimastix californiae
  Cellulose docking domain, dockering
aaagaatactttaccatgttgtactacctgtgatatttatttaattgatgctactggtagatatggttatgaaaatggtgaatggtgtaatactccatttaactg

SEQ ID NO: 18151 - DNA, 117 bp, Neocallimastix californiae
  Cellulose docking domain, dockering
atgctttgctactaaattaggatattcttgctgtactactactaaaaatgtaatttctgtaaattcctatggtaagtggggtatagaaaatggaaaattatgtggtattgaaaaagc

SEQ ID NO: 18152 - DNA, 120 bp, Neocallimastix californiae
  Cellulose docking domain, dockering
tttaagtgaggacaaaagattcccatgttgtagcagtaatgatgtagaagttgctggaaaagaaatggatggatcatggggttatgaaaatggtaaaaaatgtggtattagaaataagcg

SEQ ID NO: 18153 - DNA, 117 bp, Neocallimastix californiae
  Cellulose docking domain, dockering
ttgttgggctgttaaatatggttattcctgctgtaaggaaactactgttattgaagaagttgatgaaaatggcagatggggttttgaaaatggtggaagatgtggttttattgaagg

SEQ ID NO: 18154 - DNA, 108 bp, Neocallimastix californiae
  Cellulose docking domain, dockering
tgaaccagaatatagatgttgtaatccagaaactcaagtcttttattctgatgatcaaggaaagtggggtattgaaaatggtgaatggtgtggtattattgaaaatat

SEQ ID NO: 18155 - DNA, 117 bp, Neocallimastix californiae
  Cellulose docking domain, dockering
atgttggtcagaacgtttaggttacccatgctgtgtcggatatactgatactatatttgctgatgctgatggtgaatggggcttacaaaatgatgattggtgtggtattactgatgc

SEQ ID NO: 18156 - DNA, 114 bp, Neocallimastix californiae
  Cellulose docking domain, dockering
atgttttactttggatttaggttatccatgttgtaagaaaaacaaagatttagtacttgaagatgaagatggtaaatggggtaatgaagatggtgaatggtgtggtcttgaagg

SEQ ID NO: 18157 - DNA, 117 bp, Neocallimastix californiae
  Cellulose docking domain, dockering
atgctggtctgaaagttatggttacaaatgttgtactgatccagatgctaaaatagaatatgatggtgatggtaatttatggggtgttgaaaatggtgaatggtgtggtattaaaaa

SEQ ID NO: 18158 - DNA, 111 bp, Neocallimastix californiae
  Cellulose docking domain, dockering
tttcgctaataactatggttacccaggttgtaaaaatgctactaaaattagatattctggtgtcgaaggttcttggggttatgaaaatggatcctggtgtggtattgatac

SEQ ID NO: 18159 - DNA, 120 bp, Neocallimastix californiae
  Cellulose docking domain, dockering
accaaaaattctcgcacaaggatatagttgttgtccaaaaggatgtagagtttacgaaactgatgaagatggtgattggggttatgtagacaatgaatggtgtggttgtaaagtagacta

SEQ ID NO: 18160 - DNA, 102 bp, Neocallimastix californiae
  Cellulose docking domain, dockering
ctgtgcaaaaggttatccatgttgtaaaggagattctgaaatctacttagtagatgaagatggtaactggggttacgaagatgatgaatggtgtttacttgc

SEQ ID NO: 18161 - DNA, 123 bp, Neocallimastix californiae
  Cellulose docking domain, dockering
atgttggtctagtggttacggttatccatgctgtaataattgtaaggtttacttcgttgatgacaatggagaatggggtattgaaaacggtaactggtgtggtattgtcgatagtaaatgtag

SEQ ID NO: 18162 - DNA, 123 bp, Neocallimastix californiae
  Cellulose docking domain, dockering
ctgttggtcagaatctaaaggttatccatgttgtaaatattgtgatgttgtttctgttgatagatatggttcatggggtattgaaaacggtaaatggtgtggtgtaaaatccgatgtttgtaa

SEQ ID NO: 18163 - DNA, 123 bp, Neocallimastix californiae
  Cellulose docking domain, dockering
ttgttggtcagaaacaaaaggatataaatgctgtaaaagttgtgatgtagtaacagttgatagattcggttcttggggtgttgaaaatggtgaatggtgtggtattgactatgatatttgtca

SEQ ID NO: 18164 - DNA, 123 bp, Neocallimastix californiae
  Cellulose docking domain, dockering
ttgttgggcaagtttctatggttatgactgttgtaatggttgtaaagttaaatctgttgatagtttgggatcttggggtttcgaaggtggtaaatggtgtggtattgatactgaaacatgtgt

SEQ ID NO: 18165 - DNA, 123 bp, Neocallimastix californiae
  Cellulose docking domain, dockering
atgttggtctagtttctatggttattcttgctgtaagggatgtaaagtcagatatgtagatgatttaggttcatggggttatgaaggtggaaaatggtgtggtattgattcagaaatttgcga

SEQ ID NO: 18166 - DNA, 123 bp, Neocallimastix californiae
  Cellulose docking domain, dockering
atgttggtctaaatctttaggttactcttgctgtaagacttgtaatgtttacactgtagataaatctggttcctggggttacgaagatggtaaatggtgtggtattgatgccgaaacttgcaa

SEQ ID NO: 18167 - DNA, 117 bp, Neocallimastix californiae
  Cellulose docking domain, dockering
atgttttgccacaaaattaggatatccttgttgtagtgttggttatccaactgttttaaaagatgaaagtggtagttggagtgttgaaaatggggaatggtgtggtgtttctgatga

SEQ ID NO: 18168 - DNA, 117 bp, Neocallimastix californiae
  Cellulose docking domain, dockering
atgctggtcctcatcgttaggttatccatgttgtacttcaactaaggatgctattttagttgatgataacggtaaatggggttctgaaaatggaaattggtgtggtattgttgaagc

SEQ ID NO: 18169 - DNA, 117 bp, Neocallimastix californiae
  Cellulose docking domain, dockering
atgttggtctaaaaagtatggttatgaatgttgttcttcggaaaacacaagagttgtagttactgatgaaactggaaaatggggtgttgaaaatggtcaatggtgtggtgttcttga

SEQ ID NO: 18170 - DNA, 121 bp, Neocallimastix californiae
  Cellulose docking domain, dockering
ttgctggtcacttccatttggttataaatgctgtacacattgtaaggtacttacaaaagatgaaaatggtaaatggggtgaagaaaaaggagaatggtgtggtattattgaagaaaaatgt

SEQ ID NO: 18171 - DNA, 117 bp, Neocallimastix californiae
  Cellulose docking domain, dockering
atgttggtcacttaagctgaattacccttgttgtgaccgtaataataccatttctttttataggaatgattatggtgcatggggtaatgtagataataaatggtgtgggttatatcc

SEQ ID NO: 18172 - DNA, 114 bp, Neocallimastix californiae
  Cellulose docking domain, dockering
atgtttctcagaaagacttggttatagatgttgttatggaaataaagttgttttaaccgatgctgatggtaaatggggtgttgaaaacaatcaatggtgtggtatttcggatac

SEQ ID NO: 18173 - DNA, 123 bp, Neocallimastix californiae
  Cellulose docking domain, dockering
atgttgggctaatgcattaggttatccttgttgtaagacagcctatgccatctattacacagataatgatggtaattggagtattgaaaataatgaatggtgtggtattgatgaaagtaaaaa

SEQ ID NO: 18174 - DNA, 117 bp, Neocallimastix californiae
  Cellulose docking domain, dockering
atgtacttttgaatcaattggatataattgctgttcatctacaactgatgttatataccaagatgaaaatggtgattggggtgtagaaaataacgactggtgcggtatcatcccatc

SEQ ID NO: 18175 - DNA, 120 bp, Neocallimastix californiae
  Cellulose docking domain, dockering
ttgcttttctgagaaattaggatatccctgttgtataggttgtaatgtgatttacacagatgacgatggggattggggtattgaacagggatcatggtgtggtattaacgataaatgtac

SEQ ID NO: 18176 - DNA, 126 bp, Neocallimastix californiae
  Cellulose docking domain, dockering
ttgttgggctgaaagtcttggttatccatgttgtactggtaaaaatccaattgtctatgaacatgacagtaatggtgattggggatacaattggaaaaccaatgaatggtgtggtatttcaactta

SEQ ID NO: 18177 - DNA, 111 bp, Neocallimastix californiae
  Cellulose docking domain, dockering
ttggtctgatgctttaggatacccatgttgtcatggttgtactgtttatgaaacagatgctgatggttcttggggttatgaaagtaatcaatggtgtggtattcaatctta

SEQ ID NO: 18178 - DNA, 117 bp, Neocallimastix californiae
  Cellulose docking domain, dockering
ttgctggagtactggcttaggctatccatgttgtagtttaaccaacaccgatgtatactacatcgatgaaagtggtaattggggtatagaaaatgatgattggtgtggtatttctaa

SEQ ID NO: 18179 - DNA, 120 bp, Neocallimastix californiae
  Cellulose docking domain, dockering
atgtttctctaccaaattaggttatccatgttgtcaacaaacaaaagatgtcgtttatgaagataatgatggtcaatggggtgttgaaaacaatgattggtgtggtattacaaaagaatc

SEQ ID NO: 18180 - DNA, 132 bp, Neocallimastix californiae
  Cellulose docking domain, dockering
ctgttggtccgaggcctacggttatcactgctgtaagaatccagataccgtattaattgaacctcgtagtaaatccaatccaggacgtgaatggtatggcgtcgaagataataaatggtgtggtattgcaga

SEQ ID NO: 18181 - DNA, 108 bp, Neocallimastix californiae
  Cellulose docking domain, dockering
acaaaccgaatataattgttgtgtcttctcaactacggaaaatgttcaaaccaccgaagaaggtaaatggggagtagaatttaataaatggtgtcttatcgacgatga

SEQ ID NO: 18182 - DNA, 99 bp, Neocallimastix californiae
  Cellulose docking domain, dockering
tgataaatataagtgttgtagtcactgtaacgtatcctacacagattcaacaaaatggggaattgaaaataaccattggtgtcatattccatccacttg

SEQ ID NO: 18183 - DNA, 102 bp, Neocallimastix californiae
  Cellulose docking domain, dockering
atatgaatgttgtagcggttgtgatgtattttattctgataatgaagccttatggggtgttgaaaatggtaattggtgtgtaattcaaaattctgtatgtgg

SEQ ID NO: 18184 - DNA, 108 bp, Neocallimastix californiae
  Cellulose docking domain, dockering
tactgattatccaaattgtaattcatgtgatgtttattatacagatgccactggtaagtggggtgttgagaacagaaattggtgtattattcaagaaagtagatgtgg

SEQ ID NO: 18185 - DNA, 108 bp, Neocallimastix californiae
  Cellulose docking domain, dockering
tcatgcctatgaagattgtgaaggttgttatgttgtaactgaagaagatggtatcaaatggggtgttgagaacaatgattggtgtaaaattgtttcctccaagtgtaa

SEQ ID NO: 18186 - DNA, 102 bp, Neocallimastix californiae
  Cellulose docking domain, dockering
aacttatatgtgttgtgaaggttgtgatgtttacgatcaaactgaagaaggaatgtggggtattgaaaatgacaactggtgtggtattaaggattcttgttt

SEQ ID NO: 18187 - DNA, 102 bp, Neocallimastix californiae
  Cellulose docking domain, dockering
aagttataaatgttgtcaaggttgtaacgtcattgaagaagatgcttccggaaaatggggtattgaaaacaatgaatggtgtggtattaaagattcctgctt

SEQ ID NO: 18188 - DNA, 126 bp, Neocallimastix californiae
  Cellulose docking domain, dockering
ttgctgggctactaaattaggttactcttgctgtaagagtactaaggaagttgtctacactgatgccgatggtcgttggggtgttgaaaacaacaactggtgtggtattattgattctggatgttg

SEQ ID NO: 18189 - DNA, 123 bp, Neocallimastix californiae
  Cellulose docking domain, dockering
atgttgggctactaagcttggttacaagtgttgtaccgctaagtgtccagttgaagaatacgtcgataatgatggtagctggggtattgaaaacaataattggtgtggtattactaagtcatg

SEQ ID NO: 18190 - DNA, 129 bp, Neocallimastix californiae
  Cellulose docking domain, dockering
gtgttggtccgaaaatttaggttataaatgttgtaccaagaaatgtgatgcaatatttgttcttaccgatgaattaggaaattggggaatggaaaataaagaatggtgtggtattccaaagaattgtaa

SEQ ID NO: 18191 - DNA, 120 bp, Neocallimastix californiae
  Cellulose docking domain, dockering
atgctctgcatcaaaattcggttatccatgttgtaaaggttgtactgtttatgaaaaagatgaagttggcgaatggggttatgaaaatgatgaatggtgtagtataaaagctacatgttc

SEQ ID NO: 18192 - DNA, 120 bp, Neocallimastix californiae
  Cellulose docking domain, dockering
ttgttgggctgctaaattaggtttcaactgttgtaagactactaagactgttgtctatgaagatgctgatggtaattggggtgttgaagatgattactggtgtggtattattgaagataa

SEQ ID NO: 18193 - DNA, 117 bp, Neocallimastix californiae
  Cellulose docking domain, dockering
atgctggtctaccaagttaggttatccatgttgtgaagatgctaacgttatctatactgttgatgaaaatggaagttggggttatgaagatgatcactggtgtggtattgttaaagc

SEQ ID NO: 18194 - DNA, 105 bp, Neocallimastix californiae; identical to SEQ ID NO: 15645
  Cellulose docking domain, dockering

SEQ ID NO: 18195 - DNA, 117 bp, Neocallimastix californiae; identical to SEQ ID NO: 15646
  Cellulose docking domain, dockering

SEQ ID NO: 18196 - DNA, 108 bp, Neocallimastix californiae
  Cellulose docking domain, dockering
tgaaaaaggatataatagttgtacattgggaactaaagtttcatttactgatgtaaatggtatttggggtatagaaaatgataaatggtgtgctatacttagtaaaaa

SEQ ID NO: 18197 - DNA, 123 bp, Neocallimastix californiae
  Cellulose docking domain, dockering
ttgttgggcttccagtgaaggttacagttgttgtaaaggatgtgaatctattttcactgatggtgtaagaagatggggtgttgaaaatgatcaatggtgtggtattattgaagctaattgtaa

SEQ ID NO: 18198 - DNA, 111 bp, Neocallimastix californiae
  Cellulose docking domain, dockering
ttcaaaggatggttattcatgctgtaagagttgtacaattgtattggatgatgaatctggtaaatggggtgttgaaaatggtgattggtgtggtattgacacatcatgtga

SEQ ID NO: 18199 - DNA, 117 bp, Neocallimastix californiae
  Cellulose docking domain, dockering
gtgttggtctttatctgaaggatataaatgttgtagtgcaggtactactgtcgcattagttgatagtaaaggtaagtggggtattgaaaacggagattggtgtggtattattgatgc

SEQ ID NO: 18200 - DNA, 120 bp, Neocallimastix californiae
  Cellulose docking domain, dockering
ttgttgggcaacaaaattagattatccatgctgttcctattctactcaagtttttgaaacggatgaaaatggtcaatggagtatagaaaatggagaatggtgtggtattgtaagtagcca

SEQ ID NO: 18201 - DNA, 120 bp, Neocallimastix californiae
  Cellulose docking domain, dockering
ttgttggtcaaatgccttaggttatccatgttgtaagacgacgaccactgttatctctactgatagtgatggtcaatggggtgttgaaaataatgaatggtgtggtattccaaaggctca

SEQ ID NO: 18202 - DNA, 120 bp, Neocallimastix californiae
  Cellulose docking domain, dockering
ttgtttttctgagaaattggggtacccatgttgtaaaaaaacaaaagatattgtttactcagatgaagatggtccatggggtgtagaagataatagttggtgtggtattcaaagagaaaa

SEQ ID NO: 18203 - DNA, 115 bp, Neocallimastix californiae
  Cellulose docking domain, dockering
tggagccgatggttatccatgctgttctcaagaatgtacctcctacttcagagatgaaagtggtgactggagtgttgaaaatggcgactggtgtttaattgacacctctatctgt

SEQ ID NO: 18204 - DNA, 117 bp, Neocallimastix californiae
  Cellulose docking domain, dockering
ctgctggtctgaagccttaggctatccatgttgtcaaggtgaagtagaatatgtagaaagtaatgaaaatggtgattggggtttagaaaacaatgaatggtgtggtcttccaaagac

SEQ ID NO: 18205 - DNA, 120 bp, Neocallimastix californiae
  Cellulose docking domain, dockering
ttgttggtctgaagccttaggctatccatgttgtcaaggtgaagtagaattagttgaaagtaatgaagatggtgattggggtttagaaaacaatgaatggtgtggtattccaaaacaaag

SEQ ID NO: 18206 - DNA, 117 bp, Neocallimastix californiae
  Cellulose docking domain, dockering
ctgttggtctgaagcctacggttttccatgttgtcaaggtgaaattggatatatagaaagtgatgaatatggtgattggagtgtagaaaacaataaatggtgtggtgtaccaaaggc

SEQ ID NO: 18207 - DNA, 120 bp, Neocallimastix californiae
  Cellulose docking domain, dockering
atgtccaaatcaaaagaacggatacccatgctgtcaaacctgtgatgtatacttaactgatgctgacggtaaatggggtgttgaaaatggaaattggtgtagtattaaggatagctgctt

SEQ ID NO: 18208 - DNA, 123 bp, Neocallimastix californiae
  Cellulose docking domain, dockering
atgctggtcatcaaaattaggttacaaatgttgttctagaggttgtaatactgctgttgttgttactgataatgatggtgcttggggtgttgaaaacggtgaatggtgtggtgttcaatgtga

SEQ ID NO: 18209 - DNA, 102 bp, Neocallimastix californiae
  Cellulose docking domain, dockering
agactatccatgttgtagtacttgtgacgtttatttaactgaagataatggtagtcgctggggtgttgaaaataacgactggtgtagtatcaaaaattcttg

SEQ ID NO: 18210 - DNA, 102 bp, Neocallimastix californiae
  Cellulose docking domain, dockering
tgaaccagattatccatgctgtaagaatacctgtagagttgtctataccgatagttctgaatggggtgttgaaaatggtaactggtgtggtattccaagttt

SEQ ID NO: 18211 - DNA, 73 bp, Neocallimastix californiae; identical to SEQ ID NO: 15663
  Cellulose docking domain, dockering

SEQ ID NO: 18212 - DNA, 120 bp, Neocallimastix californiae
  Cellulose docking domain, dockering
ttggtctgaaaaacttggatatccatgctgtcaaaatacctcttctgttgcttacactgattctgatggtaaatggggtgttgaaaatggtaattggtgtggaataaagtcatcatgtaa

SEQ ID NO: 18213 - DNA, 111 bp, Neocallimastix californiae
  Cellulose docking domain, dockering
gtctgaaccagattacaagtgttgtactacctgtgatattgtttatactgatgatcataactggggtgttgaaaatggcgaatggtgtggtattgatgatagtaaatgtgg

SEQ ID NO: 18214 - DNA, 117 bp, Neocallimastix californiae
  Cellulose docking domain, dockering
atgtggtgctgctgctctcggttatccatgttgtcaatcaacttgtactgaagtttatactgatgaatacagatggggtgttgaaaatggtgactggtgtggacttaaggattcctg

SEQ ID NO: 18215 - DNA, 123 bp, Neocallimastix californiae
  Cellulose docking domain, dockering
atgttggtcagaaatattaggatatccatgttgtaaaggatgtaaaatctatgaaactgactcagatggatcttggggatatgaatttaatcaatggtgtggtattatttcatcccgctgtca

SEQ ID NO: 18216 - DNA, 123 bp, Neocallimastix californiae
  Cellulose docking domain, dockering
atgtttatcagaattcttgggatatccatgctgttcatctgaacttacgaccgtctatgctgaggatgagtatggtgaatggagttatgatttcaccaagaatgaatggtgtggtttaaccaa

SEQ ID NO: 18217 - DNA, 114 bp, Neocallimastix californiae
  Cellulose docking domain, dockering
ttgtttctctattgctttaggtttcccatgttgtaagggtaatacagtaatttatactgatgatgatggtgattggggtgttgaaaatgaagaatggtgtggtattagtggtag

SEQ ID NO: 18218 - DNA, 117 bp, Neocallimastix californiae
  Cellulose docking domain, dockering
atgctttgctaaagctttaggttatgaatgttgtagtacttgtgatgttgtttatacagatgatgatggtgattggggtgttgataatggtgaatggtgtggtattaaagataattg

SEQ ID NO: 18219 - DNA, 123 bp, Neocallimastix californiae
  Cellulose docking domain, dockering
atgttgggcctacgccagaaattacaaatgttgtagtaatccaaatactaaagtagaaactgaagataaatatggaaaatggggtattgaaaataatgaatggtgtggtattgatacaaataa

SEQ ID NO: 18220 - DNA, 117 bp, Neocallimastix californiae
  Cellulose docking domain, dockering
atgttggtcgaatttcttaggttatccatgttgtaagaaaactgacgatattatttataatgcagttaaaggatcatggggttatgaaaataattcatggtgtggtttagattttac

SEQ ID NO: 18221 - DNA, 108 bp, Neocallimastix californiae
  Cellulose docking domain, dockering
attagatgatggctacccatgttgtaaaactactaatgtagttatagaaactgatggcaatggggaatggggtattgaaaatgatcaatggtgtggtattagaaagtg

SEQ ID NO: 18222 - DNA, 108 bp, Neocallimastix californiae
  Cellulose docking domain, dockering
agatgaaccatatccatgttgtgtttatgctaccgaaatcatatacactaatgaaaatggtaaatggagtatggaaaatggtgactggtgtggtataatagaaaatgc

SEQ ID NO: 18223 - DNA, 114 bp, Neocallimastix californiae
  Cellulose docking domain, dockering
ttgtaaaggtctaagtgaaggttatccatgttgttcaagtcttagtatgaagacttcaggatatgatgatcaatggggctatgaagataatgattggtgtcgtttaactgatga

SEQ ID NO: 18224 - DNA, 120 bp, Neocallimastix californiae
  Cellulose docking domain, dockering
atgttggtctgtcagtaaaggttatccatgttgtgtaggagataatccttccatagaatttgttgattctgatggtcaatggggtttggaaaatggaaattggtgtggtattgcagtaga

SEQ ID NO: 18225 - DNA, 123 bp, Neocallimastix californiae
  Cellulose docking domain, dockering
gtgttggtcattaagccaaggatatccatgttgttcaattcaaccatatcatatagaattaagtgatgaatctggtgattggggtatagaaaatggagattggtgtggtattcctaaatctaa

SEQ ID NO: 18226 - DNA, 117 bp, Neocallimastix californiae
  Cellulose docking domain, dockering
ctgctgggcaaccaagaaaggttttccatgttgttcaaacaaagatacttcaattgttagtgttgattcggaaggacaatggggaatggaaaacggtcaatggtgtggaattgaaaa

SEQ ID NO: 18227 - DNA, 120 bp, Neocallimastix californiae
  Cellulose docking domain, dockering
atgtccagccgctaaaaatggatataaatgttgtaatgcctgtaaggtcaagaccacagataaaaatggtgactggggtgttgaaaatggagaatggtgttccattccatacacttgtag

SEQ ID NO: 18228 - DNA, 132 bp, Neocallimastix californiae
  Cellulose docking domain, dockering
atgttggtctaaaagtcaaggttattcctgttgtaaggatgccaccactaccgttcgtacgacggatagtaaaggttatttatggggtattgaaaataatgaatggtgtggtattaccggaaatcaatgtcc

SEQ ID NO: 18229 - DNA, 108 bp, Neocallimastix californiae
  Cellulose docking domain, dockering
aagtactggttattcctgctgtatgtttaatactaccgccatagccactaaggatagtgatggttattggggtgttgaaaatggtcaatggtgtctctttgaaaacaa

SEQ ID NO: 18230 - DNA, 108 bp, Neocallimastix californiae
  Cellulose docking domain, dockering
ttctggttatatatgctgtagaaccactgactgtgaagttgtttccagcgatgaagctggtgattggtgtatggaaggaaatttatggtgtttaatttcaaagaaccg

SEQ ID NO: 18231 - DNA, 123 bp, Neocallimastix californiae
  Cellulose docking domain, dockering
atgctggtctttagctgaaggttacccatgttgtcaacacgctactaaagttgaaaacattgatgaacaaggtagaaaatggtctgttgaaaatgatgattggtgtggtattattgaacaaga

SEQ ID NO: 18232 - DNA, 117 bp, Neocallimastix californiae
  Cellulose docking domain, dockering
tggtgctatcttaagtcaaggttacaaatgttgtagtagtggatgttctgtagtttacactgatggtgatggtacttggggatttgaaaatgatcaatggtgtggatgtaatctctc

SEQ ID NO: 18233 - DNA, 126 bp, Neocallimastix californiae
  Cellulose docking domain, dockering
tccagcttctattgcttcccaaggttataaatgttgtagtagtaataactgtgatgtttatcttaccgatgaatctggtaaatggggtgttgaaaacaatgactggtgtggtatttccaacagttg

SEQ ID NO: 18234 - DNA, 126 bp, Neocallimastix californiae
  Cellulose docking domain, dockering
tccagctactattacttcccaaggttataaatgttgtagcagtaataactgtgatgtctatcttaccgatgaatctggaagatggggtgttgaaaacaatgattggtgtggtatttccaacagttg

SEQ ID NO: 18235 - DNA, 120 bp, Neocallimastix californiae
  Cellulose docking domain, dockering
ttctgctgctatcttaagtcaaggttacaaatgttgtagtggtggatgttctgtagtttacactgacggcgatggtacttggggagttgagaatggtcaatggtgtggatgtgctctctc

SEQ ID NO: 18236 - DNA, 105 bp, Neocallimastix californiae
  Cellulose docking domain, dockering
tgaaaatggctatccttactgtaaaaataccaaaatcgttgtatacactgacgatgttgaatggggtgtagaaaataatgaatggtgtgtcattaaggatgatga

SEQ ID NO: 18237 - DNA, 114 bp, Neocallimastix californiae
  Cellulose docking domain, dockering
agataaaaatcttggctatccctgctgtcaaaattgttacgttattgaaagtgatgaaaatggtgattatggtatagaaaacggtgaatggtgtagtattccatattcatgttc

SEQ ID NO: 18238 - DNA, 114 bp, Neocallimastix californiae
  Cellulose docking domain, dockering
taaatgttggtcagaaaagctaggttatccatgctgtgttggtaacactgtttatactactgatgaaagtggttcatggggtttagaaaatgatgattggtgtggtattaaaac

SEQ ID NO: 18239 - DNA, 117 bp, Neocallimastix californiae
  Cellulose docking domain, dockering
atgtttctctcttgtattaggtttcccatgttgttcttcatgtgattcaatttatgaagatgatgatggaaaatggggtgttgaaaataacaattggtgtggtattaaaaattcatg

SEQ ID NO: 18240 - DNA, 120 bp, Neocallimastix californiae
  Cellulose docking domain, dockering
atgctggtcagaggagcaaggttatcaatgttgttcaggatgtgatattgtttatgaagacaatactggtttctggggagttgaaaataatgaatggtgtggaattaatagttcttgtac

SEQ ID NO: 18241 - DNA, 117 bp, Neocallimastix californiae
  Cellulose docking domain, dockering
taaatttgaagcgattggttatccatgttgtagtcactgtaacattgtttacactgatgatagtggcaactggggtattgaaaatgatgattggtgtggtataagagataactgtgg

SEQ ID NO: 18242 - DNA, 108 bp, Neocallimastix californiae
  Cellulose docking domain, dockering
tccaaattacgattgttgtaatggttgtgatgtttattacaccgatgacgaaggtgagtggggtattcaaaacaataattggtgcttcattaatgatgctaattgcca

SEQ ID NO: 18243 - DNA, 120 bp, Neocallimastix californiae
  Cellulose docking domain, dockering
atgctgggctaaagctttaggttatgaatgttgttcatcttgccaaccatctgccttcaaagatgaaagtggtgaatggggtatagaaaataaccagtggtgtggtattatcagtaatgg

SEQ ID NO: 18244 - DNA, 105 bp, Neocallimastix californiae
  Cellulose docking domain, dockering
tgctcttggttatgagtgttgtaaaactactactactgttatctatacggatgaatctggtaaatggggtattgaaaataacgaatggtgtgaaattaaagataa

SEQ ID NO: 18245 - DNA, 120 bp, Neocallimastix californiae
  Cellulose docking domain, dockering
ttgttggtctcttgctaatggttatgattgttgtgaaggttgtgaagttgcttacactgacgctgatggcaaatggggttatgaaaatgatgaatggtgtggtattaaggaagattgcga

SEQ ID NO: 18246 - DNA, 102 bp, Neocallimastix californiae
  Cellulose docking domain, dockering
tcaatatagtaattgtaaaaacacttgtgaaattgcctatgaagatgaaaataaatggggtattgaaaatgaagattggtgtattcttccagattcttgttt

SEQ ID NO: 18247 - DNA, 117 bp, Neocallimastix californiae
  Cellulose docking domain, dockering
atgttgggcttcatcattaggttattcatgttgtaaaggatgtgatataataattactgattccaatggcgattggggtgttgaagataatgaatggtgtggtattttatcaacatg

SEQ ID NO: 18248 - DNA, 111 bp, Neocallimastix californiae
  Cellulose docking domain, dockering
ccaaggttatccatgctgtgcctactcatgtactgcctatgaaaaggatagagatggtgaatggagtgttgaaaacaatgattggtgtttaattaacaaggctatttgtaa

SEQ ID NO: 18249 - DNA, 123 bp, Neocallimastix californiae
  Cellulose docking domain, dockering
ctgtttctcaaaggctttaggttataactgttgtaagtcatgtagtggtgtttactacgttgataaggatggtgaatggggtattgaaaatggtcaatggtgtggtatggcaagtagttgtgt

SEQ ID NO: 18250 - DNA, 114 bp, Neocallimastix californiae
  Cellulose docking domain, dockering
tccaggagaaggaactgaatataaatgttgttccagctgtttagatgtctatgaagaagatgagaatggaccatgggcaattgaggatgaacaatggtgttcacttccatatta

SEQ ID NO: 18251 - DNA, 99 bp, Neocallimastix californiae
  Cellulose docking domain, dockering
ctactatccatgctgtaagaccaccactgagattgtgtcaaccgataactccggagattggggtatagaaaatgatgagtggtgtggtattggtaatgg

SEQ ID NO: 18252 - DNA, 93 bp, Neocallimastix californiae
  Cellulose docking domain, dockering
cggatatccatgctgtagcaactgtgaacttacctaccaagatgaaacaggaaagtggggagtagaaggagaggaatggtgtggacttcgtga

SEQ ID NO: 18253 - DNA, 120 bp, Neocallimastix californiae
  Cellulose docking domain, dockering
atgttggtcattaaaatatggttatctttgctgtaattctgattctacttcagttgttaaaaccaataaatatggtaattggggtaaggaaaatggtaaatggtgtggtattaaagatca

SEQ ID NO: 18254 - DNA, 129 bp, Neocallimastix californiae
  Cellulose docking domain, dockering
atgtccattcaaagctataggctatggatgttgtaaaaattctaagactgaaattgtttttactgatagttttggtaactatggtgttgaaaagggtaagcgttgtggtattattgatgattcatgttg

SEQ ID NO: 18255 - DNA, 93 bp, Neocallimastix californiae
  Cellulose docking domain, dockering
atacaggtgttgtaaggaatgtaatgtcatcttcaccgactctgaagattggggtatagaagatggtgactggtgttctattccatacacttg

SEQ ID NO: 18256 - DNA, 123 bp, Neocallimastix californiae
  Cellulose docking domain, dockering
ctgttggtcgcttagccttggctacaaatgctgtactctcagaactacagagccgaactattattctaaatcagcaggtaaatggtacggtattgaaaatgatgaatggtgtggtatcaccga

SEQ ID NO: 18257 - DNA, 105 bp, Neocallimastix californiae
  Cellulose docking domain, dockering
taataccggttatcactgttgtctttacaccactgaggtggaaaccacagatgccgtgggtcagtggggtattgaagccggagaatggtgtctctttgaacatga

SEQ ID NO: 18258 - DNA, 114 bp, Neocallimastix californiae
  Cellulose docking domain, dockering
atgtttctcagaaaaattaggttttccatgttgtgttgaaactaaagaagttgttaatgttgatgaaaatggacaatggggtattgaaaataacaattggtgtggtattgaaac

SEQ ID NO: 18259 - DNA, 132 bp, Neocallimastix californiae
  Cellulose docking domain, dockering
ttgctggtcattacctttaggttacaattgttgttcctctgacaacactgaagtatactatactgatgatgatggtcaatggggtgttgaaaatggtgactggtgtggtatcatgagtgataaatgttggtc

SEQ ID NO: 18260 - DNA, 123 bp, Neocallimastix californiae
  Cellulose docking domain, dockering
atgttggtccgaacctttaggttatgaatgttgtgatccaaaggataatacttactattatgaggatgatgatggttactggggattagttgatggtgaatggtgtggtatcattgctgaaaa

SEQ ID NO: 18261 - DNA, 117 bp, Neocallimastix californiae
  Cellulose docking domain, dockering
aaaaccagattatccatgttgttcaaggtgtgatataaaagtaattcttgatgatggtgataataaacaatggggtattgaaaattcaaattggtgtggtctcccagacaattgttt

SEQ ID NO: 18262 - DNA, 114 bp, Neocallimastix californiae
  Cellulose docking domain, dockering
atgttggtcattaaaattaggatatccctgttgtaaagaatccattgaagtttatactaccgacgaaaatggttcatggggtgttgaaaatgaacaatggtgtggaatatctaa

SEQ ID NO: 18263 - DNA, 114 bp, Neocallimastix californiae
  Cellulose docking domain, dockering
atgttttgctaataaattaggatatccatgttgtacacaaactaatgaaatcgtttctattgatgaaaacggtaaatggggtttagaaaatggtcaaatttgtggtattgaaga

SEQ ID NO: 18264 - DNA, 123 bp, Neocallimastix californiae
  Cellulose docking domain, dockering
ttgttggtctactgctttaggttatccatgttgttcttctgctaatgctgaagtttatttcactgatgaaagtggtgattggggtattgaaaataatacatggtgtggtattccaaataatgt

SEQ ID NO: 18265 - DNA, 123 bp, Neocallimastix californiae
  Cellulose docking domain, dockering
atgttgggctaaagaattaggatatgaatgttgtagtactaattcttgtagaaatgctatttataccgatgatgacggtgaatgggatgtcgaaaatggcaactggtgtggtataacctctgc

SEQ ID NO: 18266 - DNA, 129 bp, Neocallimastix californiae
  Cellulose docking domain, dockering
aagctctatgttaagacaaggttataaatgttgtgaaatcaacaattgtaatatttaccataaggatggtgatggtgattggggtcttgacagaaacttaaaatggtgtggtatccgttttgaatgtaa

SEQ ID NO: 18267 - DNA, 117 bp, Neocallimastix californiae
  Cellulose docking domain, dockering
gaaatttaatcaaatgggttataaatgttgtaattcatgtaatgctgtttataccgattccaccggtagatggggagtcgaaaacagacaatggtgtggtattcgtaatgactgtaa

SEQ ID NO: 18268 - DNA, 123 bp, Neocallimastix californiae
  Cellulose docking domain, dockering
ctgttggtcctctccatttggttatgattgttgtaaattgaaaaagacacaaccatattcctattctaattcagccggtcattggtatggtattgaaaatggagaatggtgtggtattaccga

SEQ ID NO: 18269 - DNA, 96 bp, Neocallimastix californiae
  Cellulose docking domain, dockering
taccggctttaactgttgtctcttcacaaccatagtggcgacgaccgattctgttggtcaatggggcgttgaaaacggagaatggtgtctctttga

SEQ ID NO: 18270 - DNA, 96 bp, Neocallimastix californiae
  Cellulose docking domain, dockering
atatccatgctgtaaggaatgtaacatttattatacggatagtgaagattggggtattgaagatggaaaatggtgttccattccacattcttgtaa

SEQ ID NO: 18271 - DNA, 123 bp, Neocallimastix californiae
  Cellulose docking domain, dockering
aacttatcttgataaaaattatacttgttgttcaaatgataatattgaaattaaatccattaatatggatggagaatggggtcttgagaataataattggtgtggtttaagaaatagtaaagt

SEQ ID NO: 18272 - DNA, 99 bp, Neocallimastix californiae
  Cellulose docking domain, dockering
ttatccatgttgtaataataataatattgctgtagtaataactgatgataagggtaattggggtattgaaaatggagaatggtgtggtattctaaaaga

SEQ ID NO: 18273 - DNA, 105 bp, Neocallimastix californiae
  Cellulose docking domain, dockering
tgattatccatgttgtcgtaataaaaagacagatgtagtttatacagatgataatggtaattggggtattgaaaatgaaaattggtgtgggattattagagaatc

SEQ ID NO: 18274 - DNA, 123 bp, Neocallimastix californiae
  Cellulose docking domain, dockering
atgttggtcagagaaatttggtgtttcatgttgtcctgaatacacaaaaattaattattctgatggtgatggtgactggcattataattatgctactggtgaatggtgtggtattagagaacc

SEQ ID NO: 18275 - DNA, 120 bp, Neocallimastix californiae
  Cellulose docking domain, dockering
atgttgggctgaaaaacatggttatgaatgttgtttagaaaatcatttagattatgttactgataaatatggaaaaagatggtctgaagaaaatggaaagaaatgtggaattgcaaccac

SEQ ID NO: 18276 - DNA, 114 bp, Neocallimastix californiae
  Cellulose docking domain, dockering
ttgggcagagaaatttggttttaaatgttgtaaagagaatcatattgataacgtatcagattcagatggtgattgggcacaagaaaatggagattggtgtggtttaaaagatta

SEQ ID NO: 18277 - DNA, 102 bp, Neocallimastix californiae
  Cellulose docking domain, dockering
ttattcatgttgtaaagataagaatatagatgtaatctatacagataatatgggcaattggggtattgaaaatggagaatggtgtggtattataagagaatc

SEQ ID NO: 18278 - DNA, 85 bp, Neocallimastix californiae; identical to SEQ ID NO: 15727
  Cellulose docking domain, dockering

SEQ ID NO: 18279 - DNA, 117 bp, Neocallimastix californiae
  Cellulose docking domain, dockering
atgttggtctgcttcattaggttatccttgttgtgaaaataccacaagtgtagctgttagtgatgctagtggtgattggggtgttgaacaagatcaatggtgtggtataattgaacc

SEQ ID NO: 18280 - DNA, 117 bp, Neocallimastix californiae
  Cellulose docking domain, dockering
ttgcttttctgaaaaattaggatacccttgttgtagtatcggctatgcaactgtcattactgataatgatggtttatggagtgttgaaaatgatgattggtgtggtgtaacagacca

SEQ ID NO: 18281 - DNA, 120 bp, Neocallimastix californiae
  Cellulose docking domain, dockering
ttgtttttcatcaagattaggtttcccttgctgttcctcttcttccgctgaagtttggtataccgattctgatggtaaatggggtgttgaaaatgatggatggtgtggtattccagaggc

SEQ ID NO: 18282 - DNA, 123 bp, Neocallimastix californiae
  Cellulose docking domain, dockering
atgttggtctgaagctcaaggttatccctgctgtaaattcacttctgatgtcgttttcaccgacaatgacggaaactggggtgttgaaaatggaaattggtgtggtatccaaaagaagaatgg

SEQ ID NO: 18283 - DNA, 120 bp, Neocallimastix californiae
  Cellulose docking domain, dockering
ttgttggtcaaattctttaggatacaattgttgtagtgattcaaatactcaagtgtactatgaagatcaagatggtcaatggggtattgaaaataataattggtgtggtatttccagagg

SEQ ID NO: 18284 - DNA, 120 bp, Neocallimastix californiae
  Cellulose docking domain, dockering
atgttggtctgaaagtcttggatataaatgttgttcatcatgtggacaagtatacttcaccgatgaaaatggaagatggagtgttgaaaatgatgactggtgtggtttactagccaactg

SEQ ID NO: 18285 - DNA, 114 bp, Neocallimastix californiae
  Cellulose docking domain, dockering
aaagatccttaagcaaggttacaaatgttgtccagctaactgtcaaattgtttatgctgataatgatggtacttggggtgttgacaataatcaatggtgtggatgtggtaatgc

SEQ ID NO: 18286 - DNA, 123 bp, Neocallimastix californiae
  Cellulose docking domain, dockering
ttcatcctcatttacttctcaaggctataagtgttgttcctattgtagtacagtttattatactgatgattcaggaaaatggggtattgaaaatggcaattggtgtggattaccaagtaattg

SEQ ID NO: 18287 - DNA, 114 bp, Neocallimastix californiae
  Cellulose docking domain, dockering
ctgtttttctgttaatcttggttatccatgttgtaatggtaacactgtttattatactgatgatgatggaaaatggggttacgaaaatgataattggtgtggtattaaagaaac

SEQ ID NO: 18288 - DNA, 117 bp, Neocallimastix californiae
  Cellulose docking domain, dockering
atgtacaggtagaaatcagggctatcaatgctgtaattcatgtgatgtttactatacagataatgatggcagatggggtgttgaaaataatgcttggtgcggtatcaagaatacttg

SEQ ID NO: 18289 - DNA, 126 bp, Neocallimastix californiae
  Cellulose docking domain, dockering
ctctactaaattcactcaacaaggttacaaatgctgttcatcttgtttaccagttatgtacactgatgaatctggtaagtggggtgttgaaaacaacaactggtgtggattaccatctaactgtaa

SEQ ID NO: 18290 - DNA, 123 bp, Neocallimastix californiae
  Cellulose docking domain, dockering
tccagctgctattactaaccaaggttacaagtgttgtagtgctaagtgtaacccagttgtttacaaggatgaatctggtgactggggtgttgaaaacaaccaatggtgtggttgtccaactga

SEQ ID NO: 18291 - DNA, 120 bp, Neocallimastix californiae
  Cellulose docking domain, dockering
aactgctattactagccaaggttacaagtgttgtagaaacaagtgtaacccagttgtttaccaagatgaagctggtgactggggtgttgaaaacaaccaatggtgtggatgtccaactgc

SEQ ID NO: 18292 - DNA, 120 bp, Neocallimastix californiae; identical to SEQ ID NO: 18291
  Cellulose docking domain, dockering

SEQ ID NO: 18293 - DNA, 123 bp, Neocallimastix californiae
  Cellulose docking domain, dockering
taattctaaggttactcaacaaggttacaagtgttgctcaacttgtactgctactgtttacgttgatgatgccggtaaatggggtgttgaaaacaatgactggtgtggtattccaaccaattg

SEQ ID NO: 18294 - DNA, 120 bp, Neocallimastix californiae
  Cellulose docking domain, dockering
taattctaaggttactcaacaaggttacaagtgttgctcaacttgtactgaaactttctacgttgatgatgccggtaaatggggtattgaaaacaatgactggtgtggtattccaaccac

SEQ ID NO: 18295 - DNA, 120 bp, Neocallimastix californiae
  Cellulose docking domain, dockering
aactgctattactagccaaggttacaagtgttgtagtgctaagtgtaacccagttgtttaccaagatgaagctggtgactggggtgttgaaaacaaccaatggtgtggatgtccaactgc

SEQ ID NO: 18296 - DNA, 120 bp, Neocallimastix californiae
  Cellulose docking domain, dockering
ttggtctgaagccttaggttacaattgttgttatggttgtatttcttactacgaagatgatgatggtaaatggggtgttgaaaacaatcaatggtgtggtattcttgaaagtacttgtgg

SEQ ID NO: 18297 - DNA, 96 bp, Neocallimastix californiae
  Cellulose docking domain, dockering
atatccatgttgtgaatcttgtgatgttgttaccactgatcaaaatggtaaatggggtattgaaaatggccattggtgttctattaaatattcttg

SEQ ID NO: 18298 - DNA, 120 bp, Neocallimastix californiae
  Cellulose docking domain, dockering
atgttggtctaagaagtttggtattgaatgttgtaaacacactaaaaccgtagttaggaaaacttatgatggtccctggggtaaagaaaatggaaaatggtgtggtattggcaaaaagag

SEQ ID NO: 18299 - DNA, 129 bp, Neocallimastix californiae
  Cellulose docking domain, dockering
atgtgaagccaaagaatatggctatccttgctgtccagctgaattcaatactgtcaaatatcataatgaacttggtgactggggatttgatcttgaacatagtgaatggtgtagtattactactagttt

SEQ ID NO: 18300 - DNA, 114 bp, Neocallimastix californiae
  Cellulose docking domain, dockering
atgctggtcattaaaattaggatattcatgttgtaaagaatccactaaagtttatactacagatgaaagtggatcatggggtgttgaaaatggacaatggtgtggtatatcaaa

SEQ ID NO: 18301 - DNA, 114 bp, Neocallimastix californiae
  Cellulose docking domain, dockering
accagattatccatgttgctccaaatgtgatatagaagtagctttcaacgaaggtgaacataaactttggggtatagaaaattcaaattggtgtggtattccagaaagctgttc

SEQ ID NO: 18302 - DNA, 93 bp, Neocallimastix californiae
  Cellulose docking domain, dockering
atatgaatgttgttcaccaggtactaaggttgaatacacggatgaagaagcattatggggtgttgaaaatggtaattggtgttacattactag

SEQ ID NO: 18303 - DNA, 93 bp, Neocallimastix californiae; identical to SEQ ID NO: 18302
  Cellulose docking domain, dockering

SEQ ID NO: 18304 - DNA, 88 bp, Neocallimastix californiae
  Cellulose docking domain, dockering
atatgaatgttgttcaccaggtactaaggttgaatacacggatgaagaagcattatggggtgttgaaaatggtaattggtgttacatt

SEQ ID NO: 18305 - DNA, 96 bp, Neocallimastix californiae
  Cellulose docking domain, dockering
taaatttaaatgttgttcaccaggtactaaggttgaatacacagatgaagaagcattatggggtgttgaaaatggtaattggtgttacattactag

SEQ ID NO: 18306 - DNA, 120 bp, Neocallimastix californiae
  Cellulose docking domain, dockering
atgttgggctgaagaatttggatatgaatgttgtcttttcagttcaatggtttcctacgttgacgataaaggacgttattgggatttccaaaatggaaattggtgtggcgtaactaataa

SEQ ID NO: 18307 - DNA, 123 bp, Neocallimastix californiae
  Cellulose docking domain, dockering
atgtagatctgaagtgaaaggttatccttgttgtccaccagaaattacagaaatttatatggtcgatactgatggagactggggatttgatgaaaaaactaataattggtgtggttttactcc

SEQ ID NO: 18308 - DNA, 135 bp, Neocallimastix californiae
  Cellulose docking domain, dockering
atgttggtcagagaaatatggttatccatgctgtaaagatccaaatactttattagtttcaccacaaagtaaatctaatccggatcatgaatggtatggtgttgaaaataatgaatggtgtggtattgccaacta

SEQ ID NO: 18309 - DNA, 102 bp, Neocallimastix californiae
  Cellulose docking domain, dockering
tgatcaatacaagtgttgtcaacattgtaaggtggtctacactgattcacaaaaatggggtattgaagataatgaatggtgtcatattccatatacctgtga

SEQ ID NO: 18310 - DNA, 111 bp, Neocallimastix californiae
  Cellulose docking domain, dockering
aaatactggttatccttgctgtagtaatccagacgctcaggtatatactacggattcctctggtgattggagtattgaaggtgatttttggtgtttagttgagaaagaaaa

SEQ ID NO: 18311 - DNA, 114 bp, Neocallimastix californiae; identical to SEQ ID NO: 15763
  Cellulose docking domain, dockering

SEQ ID NO: 18312 - DNA, 96 bp, Neocallimastix californiae
  Cellulose docking domain, dockering
tccatgttgtgctgattgtaacgtcgttgctgaaaccgaggatggtgaatggggtgttgaaaatggtcaatggtgtggaataaaagaaacttgtaa

SEQ ID NO: 18313 - DNA, 99 bp, Neocallimastix californiae
  Cellulose docking domain, dockering
ataccatgtctgtaaaaactgtagtgttgctgcttaccaaaatgatatctactggggttttgaaaataatcaatggtgtgaaatttcatcagaatgttt

SEQ ID NO: 18314 - DNA, 117 bp, Neocallimastix californiae
  Cellulose docking domain, dockering
ttgccttgacaaatatggatatcgctgctgttcaacttgtactatttcatacaccgatgatactggcaattggggtgttgaaaatgatgaatggtgtattgttgaagacagctgtaa

SEQ ID NO: 18315 - DNA, 120 bp, Neocallimastix californiae
  Cellulose docking domain, dockering
atgttgggctacctctttaggatattcttgttgttctgaaggtgctgatattattttagaagatgaaaatggaaaatggggtttagaaaacgacgactggtgtggcatcattgaaaaaaa

SEQ ID NO: 18316 - DNA, 123 bp, Neocallimastix californiae
  Cellulose docking domain, dockering
ttgctggagtaaatccttgggctattcttgttgtacctcatgtgaaatttcttatgaagatactgatggaaaatggggttatgaaaatgatgactggtgtggtattgttgaaaataaatgtac

SEQ ID NO: 18317 - DNA, 123 bp, Neocallimastix californiae
  Cellulose docking domain, dockering
ttgctggtctgaagcttatggttacccatgttgttcctctgccagtactaaggttatttacaccgatagcgatggtgaatggggtgttgaaaacggtaactggtgtggtatttcaaaggatga

SEQ ID NO: 18318 - DNA, 120 bp, Neocallimastix californiae
  Cellulose docking domain, dockering
ctgtttctctgatactttaggttacccatgttgtactagtaccactaatgttatctacactgatagctacggtcgctggggtattgaaaacagtaattggtgtattcttgatgattcatc

SEQ ID NO: 18319 - DNA, 120 bp, Neocallimastix californiae
  Cellulose docking domain, dockering
ttgtttctctcttgctcttggttataattgttgtaagcatacaaccgaagttatttctgttgataatgatggttcatggggtattgaaaataatgaatggtgtggaataggaaatagtac

SEQ ID NO: 18320 - DNA, 117 bp, Neocallimastix californiae
  Cellulose docking domain, dockering
ctgtttttctgaagcattaggttatccttgttgtagtgatggagtagctgtcgtctacacagataatgatggaccatggggtgtagaaaacaatgattggtgtggtatctctaatac

SEQ ID NO: 18321 - DNA, 123 bp, Neocallimastix californiae
  Cellulose docking domain, dockering
atgctggtcttctgctttgggttatccatgctgttctagtagtaatgtaccaattattgaaactgatggtgatggccaatggggtattgaaaatgatgaatggtgtggagtaccaaaaagcac

SEQ ID NO: 18322 - DNA, 123 bp, Neocallimastix californiae
  Cellulose docking domain, dockering
tagtagtttagcacaaaatactaattatccatattgtaaatatagtacagctgtatattatgttgatgaagatggtcaatggagtgttgaaaataatgaatggtgtttaattcaatcatcact

SEQ ID NO: 18323 - DNA, 96 bp, Neocallimastix californiae
  Cellulose docking domain, dockering
gtataaatgttgcaaatcatgtaatattgttcttgatgatggagataaatggggtgtagaaaatggtgaatggtgtagtataaccaatgaatgtgt

SEQ ID NO: 18324 - DNA, 120 bp, Neocallimastix californiae
  Cellulose docking domain, dockering
atgttgggctgaagcttatggatatccatgttgtagtaaatgtttacctgttattgatacaacaaatgataaagaatgggcattagaaaatggaaattggtgtggtcttccatctaaatg

SEQ ID NO: 18325 - DNA, 126 bp, Neocallimastix californiae
  Cellulose docking domain, dockering
ttgttggtctgaagcattaggatatccatgctgtccatcaggaataacgacagtttatgagcatgatgaagatggagactggagttataatttttctaaagaagaatggtgtggaataataaagca

SEQ ID NO: 18326 - DNA, 126 bp, Neocallimastix californiae
  Cellulose docking domain, dockering
ctgtctatcagaattttatggctatccatgttgttccccggaattaaccgaggtttacgctcaagatgactatggtgactggggttatgacttttcaaagagtgaatggtgtggtctaacaaagta

SEQ ID NO: 18327 - DNA, 123 bp, Neocallimastix californiae
  Cellulose docking domain, dockering
ttgctggagtaaatctttaggttatgactgttgtaaggaaggcacatctgttgcatatactgatgatagtggtaaatggggtgtcgttggagatcaatggtgtggtattattgaatcctctgc

SEQ ID NO: 18328 - DNA, 96 bp, Neocallimastix californiae
  Cellulose docking domain, dockering
tccatgttgtaagacatgtacttctgtttacgaagatgatgatggtaaatggggtgttgaaaatgatgactggtgtttaattaagagttcttgtgg

SEQ ID NO: 18329 - DNA, 108 bp, Neocallimastix californiae
  Cellulose docking domain, dockering
atctggttacccatgttgtaaatcttgtgacgtcgttgatactgatgatgatggtcaatggggtgttgaaaataatgattggtgtagtattgataccgaaaagtgtgg

SEQ ID NO: 18330 - DNA, 126 bp, Neocallimastix californiae
  Cellulose docking domain, dockering
ctgttgggtttccgtttacggatatccatgttgtgaaggtaaaattaaagaacatgtctatgccacggataatgatggaaaatggggatatgatttctccaaaaagatatggtgtggtatttcctc

SEQ ID NO: 18331 - DNA, 117 bp, Neocallimastix californiae
  Cellulose docking domain, dockering
ctgttggtcccttgaacaaggttacaattgttgtgttggctgtaccaccttcttaaccaccgatgaaggaaattggggtattgaaaatgctgaatggtgtggtataccatcctactg

SEQ ID NO: 18332 - DNA, 114 bp, Neocallimastix californiae
  Cellulose docking domain, dockering
tcgttgttgggcagaaaaattaggttataactgctgtaccagtaaagaagtatactttgaagatgaagatggtaaatggggtgttgaaaatgatgattggtgtggtattttgca

SEQ ID NO: 18333 - DNA, 99 bp, Neocallimastix californiae
  Cellulose docking domain, dockering
atataattatccatattgtaagacaacttcttctgttgtctatactgatgattttgaatggggtattgagaatgatgattggtgtattattaaggcaaa

SEQ ID NO: 18334 - DNA, 123 bp, Neocallimastix californiae
  Cellulose docking domain, dockering
atgttggtcaaaaaaattaggttggccatgttgtagtgaaggtaatgttgatatctattatactgatgaagatggtgattggggtgttgaaaataatgattggtgtggtatggaaaaagaatc

SEQ ID NO: 18335 - DNA, 120 bp, Neocallimastix californiae
  Cellulose docking domain, dockering
ctgctggtctgaaaagttcaatattccatgttgtaagtctactacttcagtcgaaagatcaacttataatggtgattttggtaaggaaaatggacaatggtgtggtcttggtgaaagtaa

SEQ ID NO: 18336 - DNA, 123 bp, Neocallimastix californiae
  Cellulose docking domain, dockering
atgttggtctgaaattttaggttattcatgctgtcatactacttgtacttcagttgaagatgatgctgacggtagttggggtatagaaggcaatgaatggtgtggtattccaaagaactgtga

SEQ ID NO: 18337 - DNA, 109 bp, Neocallimastix californiae
  Cellulose docking domain, dockering
tttaggttatccatgttgtacttaccaatgctcaattttatatactgatgaagatggtgattggagtgttgaaaacgacgactggtgtttaatcgataaatctatttgt

SEQ ID NO: 18338 - DNA, 123 bp, Neocallimastix californiae
  Cellulose docking domain, dockering
atgttgggctgaaagtcttggttatccatgttgttctggtaaaaatccaaaagtatatgcccatgataatgatggtgattggggttacaactttgccactggagaatggtgtggtatttctac

SEQ ID NO: 18339 - DNA, 114 bp, Neocallimastix californiae
  Cellulose docking domain, dockering
ttgttggtctgaatcattaggttattcatgttgtcatggctgtaccatttatgaaactgatgatgatggttcttggggttatgaaaatgatagttggtgtggtattcaatcata

SEQ ID NO: 18340 - DNA, 117 bp, Neocallimastix californiae
  Cellulose docking domain, dockering
ctgttgggcctctaagattggttatccatgttgtaagaaaaagaatggaaagatctataaagtgaattcctatggaagttggggaatagagaaatctaattggtgtggtatggtcag

SEQ ID NO: 18341 - DNA, 120 bp, Neocallimastix californiae
  Cellulose docking domain, dockering
atgttggtcagaagaattaggatttctatgttgtaaggaaagcaagacgaaggtcaaactagaagatattaatggaaaatggggaaaagagaaaggcaggtggtgtggtattatagaaga

SEQ ID NO: 18342 - DNA, 114 bp, Neocallimastix californiae
  Cellulose docking domain, dockering
tcatcatgacgtttacgattgttgtactggttgcaaaccaattgtagctgatgatgaaggcttatggggtgcagaaaatggtgattggtgtttgattgatagtgaaaaatgtca

SEQ ID NO: 18343 - DNA, 96 bp, Neocallimastix californiae
  Cellulose docking domain, dockering
aaattacaaagtatgtaaaggttgcgaagtagttgtcactgatatagaaggtgcatggggtgcagaaaatggtgaatggtgttacattgatgaaat

SEQ ID NO: 18344 - DNA, 123 bp, Neocallimastix californiae
  Cellulose docking domain, dockering
atgtttatcagaattcttgggatatccatgttgttcatctgaacttacgaccgtctatgctgaggatgagtatggtgaatggagttatgatttcaccaagaatgaatggtgtggtttaaccaa

SEQ ID NO: 18345 - DNA, 123 bp, Neocallimastix californiae
  Cellulose docking domain, dockering
atgttggtcagaaatattaggatatccatgttgtaaaggatgtaaaatctatgaaactgactcagatggatcctggggatatgaatttaatcaatggtgtggtattatttcatcccgctgtca

SEQ ID NO: 18346 - DNA, 102 bp, Neocallimastix californiae
  Cellulose docking domain, dockering
aaccgcctatccatgctgtagccattgtaacgtctcaatttcagaagaatatatccgttggggtattgaaaatggtgactggtgtatgattaatttttcatg

SEQ ID NO: 18347 - DNA, 126 bp, Neocallimastix californiae
  Cellulose docking domain, dockering
atgttggagtaaagctttaggttatgaatgttgtgatagttgtaacgtagtcttcattgatgataaaaaacaaaaatggggatcaatgaataagcaatggtgtggtattgataaagtcaaatgtgc

SEQ ID NO: 18348 - DNA, 120 bp, Neocallimastix californiae
  Cellulose docking domain, dockering
atgttggtcaagtagtttaggttattcatgttgtaaaagtacaaacgaagttaaatatactgctatcaatggttcttttggatatgaaaacgactcatggtgtggaataaataaaaaaaa

SEQ ID NO: 18349 - DNA, 123 bp, Neocallimastix californiae
  Cellulose docking domain, dockering
ttgttggtcggtatcattaggttatccatgctgcagtgaagataatcaaggtatttacttaattgatgaaaatggatcatggggtttggaaaacaatgactggtgtggtattatagataaaca

SEQ ID NO: 18350 - DNA, 117 bp, Neocallimastix californiae
  Cellulose docking domain, dockering
aaaggaatcaaaaaaattcccatgttgtagtagtaataatgtaaaagttgctggaaaagatatggatggttcatggggatatgagaatggtgtaaaatgtggtattagaagtcaacg

SEQ ID NO: 18351 - DNA, 117 bp, Neocallimastix californiae
  Cellulose docking domain, dockering
gtgttggacattgtctgatggatatccatgctgtgaatctcttgcaagtaaagttgagggtgaaaatgatgaatggggttatgaaaatggtggttggtgtggattaacaaaagatca

SEQ ID NO: 18352 - DNA, 109 bp, Neocallimastix californiae
  Cellulose docking domain, dockering
gtgtttctctgaagctcttggctacccatgttgtactaataactcaccaatttactacgttgataatgacggaaattggggtgttcaaaataacaactggtgtggtctt

SEQ ID NO: 18353 - DNA, 117 bp, Neocallimastix californiae
  Cellulose docking domain, dockering
ttgttggtctactgccttaggttatccatgttgttcatctggtaccgttgttacttacactgataatgatggtgactggggaataaacaataacaattggtgtggaattattaaggg

SEQ ID NO: 18354 - DNA, 123 bp, Neocallimastix californiae
  Cellulose docking domain, dockering
ttgtatggcagaattattaggttatatttgttgtcctactactattactatcgtctatgatcatgatgaatacggtgattggggttatgattttgcaaaaaaggaatggtgtggattaacccc

SEQ ID NO: 18355 - DNA, 114 bp, Neocallimastix californiae
  Cellulose docking domain, dockering
ttgttggtccaaaaaattaggttacccttgttgtaatggatgtaaaatttatgaaagtgatttggatggtttatggggatatgaaaaacatcaatggtgtggtattcaacctta

SEQ ID NO: 18356 - DNA, 123 bp, Neocallimastix californiae; identical to SEQ ID NO: 18354
  Cellulose docking domain, dockering

SEQ ID NO: 18357 - DNA, 114 bp, Neocallimastix californiae; identical to SEQ ID NO: 18355
  Cellulose docking domain, dockering

SEQ ID NO: 18358 - DNA, 114 bp, Neocallimastix californiae
  Cellulose docking domain, dockering
ctggtcagaatccgtcggttacccttgttgtacaggatgtgaagtggtagaagttgaagatgataaaaaatggggagtagaatctaatgaatggtgtggtattccaacctcttg

SEQ ID NO: 18359 - DNA, 126 bp, Neocallimastix californiae
  Cellulose docking domain, dockering
atgtatggcagaattagctggttatacttgctgtcctccagaaatagatactgtctatttccaagatgaatatggtgattggggtgttaatcctgaaaataataattggtgtggtatcacaaaata

SEQ ID NO: 18360 - DNA, 123 bp, Neocallimastix californiae
  Cellulose docking domain, dockering
ttgttgggcaaataaattaagttatagatgttgctcaacaagtgatgctgatgttgtatttaaagacggtagtggtgaatgggctattgaaaacggtgactggtgtggaattataaaagaaga

SEQ ID NO: 18361 - DNA, 120 bp, Neocallimastix californiae
  Cellulose docking domain, dockering
ttgttgggccaatgatataaagtatgaatgttgtgaatcaaatgatggtgaagtatatttcattgatgatgatggtaaatggggtattgaaaatggttcatggtgtggtatcattgaagc

SEQ ID NO: 18362 - DNA, 106 bp, Neocallimastix californiae
  Cellulose docking domain, dockering
aggttattcctgttgtaaatctagctgtaatgtttatgaagaagattctgatggtaaatggagtattgaaaatgacgaatggtgcttaattgacgattctaaatgt

SEQ ID NO: 18363 - DNA, 106 bp, Neocallimastix californiae; identical to SEQ ID NO: 18362
  Cellulose docking domain, dockering

SEQ ID NO: 18364 - DNA, 111 bp, Neocallimastix californiae
  Cellulose docking domain, dockering
taaagaaaatggttatggtagttgttctcttcaaaccaaaataattgcagtagataatgatggaatttggggtatagaaaataataaatggtgtgctatcctttcagatga

SEQ ID NO: 18365 - DNA, 114 bp, Neocallimastix californiae; identical to SEQ ID NO: 15819
  Cellulose docking domain, dockering

SEQ ID NO: 18366 - DNA, 102 bp, Neocallimastix californiae
  Cellulose docking domain, dockering
ggaatatccatgttgtgaaggttgtaaaaccgcatatagagataacaatggtaaatggggatatgaaaataataattggtgttccataaaatattcctgtaa

SEQ ID NO: 18367 - DNA, 126 bp, Neocallimastix californiae
  Cellulose docking domain, dockering
atgctggtctgatgttttaggatatagctgttgtaagaaaaattgttatgtttattatactgataaagatggaaaatggggtgttgaagataatcaatggtgtggtattatagaaagcgtttgtga

SEQ ID NO: 18368 - DNA, 126 bp, Neocallimastix californiae
  Cellulose docking domain, dockering
ctgttggtctgttaaatatggatattcatgctgtgaaacctcttgcaatgtttatgaaactgatgctgctggtgattggggatatgaagatcaccattggtgtggtattaataaagaaaaatgtac

SEQ ID NO: 18369 - DNA, 123 bp, Neocallimastix californiae
  Cellulose docking domain, dockering
ttgctggtcagaaaaattaggatattcttgttgtcaaacttcatgtcatgtctatgaaactgatgaagacggagaatggggatacgaagaaggtcactggtgtggtattccatcaacctgttc

SEQ ID NO: 18370 - DNA, 117 bp, Neocallimastix californiae
  Cellulose docking domain, dockering
ttgctggtctactgctcaaggatatccatgttgttctgaatgtcaagacccaatttatgaagatgatgatggtaaatggggtgttgaagataatgactggtgtggtatttccactaa

SEQ ID NO: 18371 - DNA, 123 bp, Neocallimastix californiae
  Cellulose docking domain, dockering
atgtatagctgaaacattaggatatcattgttgctcttcagataatactactgtttatgctcatgatagtaatggcgattggggatttgactttgaaaaaaaagaatggtgtggtattactcc

SEQ ID NO: 18372 - DNA, 117 bp, Neocallimastix californiae
  Cellulose docking domain, dockering
ctgctggtcagaaattttaggctatttatgttgttcagaatgtattaaagtagttgaagttgattctaatggtaaatggggtatagaaaataatcattggtgtggtattccaacatt

SEQ ID NO: 18373 - DNA, 120 bp, Neocallimastix californiae
  Cellulose docking domain, dockering
ctgttgggctgcctctgaaggttataagtgttgtaaagctggtaccgcagttgttcttacagatagtaagggtaaatggggtattgaaaacaatcaatggtgtggtattgttcaatcaaa

SEQ ID NO: 18374 - DNA, 123 bp, Neocallimastix californiae
  Cellulose docking domain, dockering
atgttgggccgcttcacaaggttataaatgttgtaatagttgtcaacctgtttatactgatggttcaagaagatggggtgttgaaaataatcaatggtgtggtatcatcgaaagtaaatgtaa

SEQ ID NO: 18375 - DNA, 114 bp, Neocallimastix californiae
  Cellulose docking domain, dockering
tgctactaaattaggatataaatgttgtaaaagttgtacgatctatttaaatgatagcaccggtaaatggggtgtagaaaataatcaatggtgtggtattgatacttcttgcag

SEQ ID NO: 18376 - DNA, 120 bp, Neocallimastix californiae
  Cellulose docking domain, dockering
ctgtttctccttaaagttaggttatccatgttgttctaatgctagcactccatctgtctatgaagattctgatggtaaatggggtgttgaaaatggtaactggtgtggtattccagaaca

SEQ ID NO: 18377 - DNA, 114 bp, Neocallimastix californiae
  Cellulose docking domain, dockering
ttggtctgaaaaattaggatatccatgttgtacttctactagtgtttctgtctttgaagataatgatggtaaatggggtattgaaaacggtaactggtgtggtattattaatgg

SEQ ID NO: 18378 - DNA, 123 bp, Neocallimastix californiae
  Cellulose docking domain, dockering
atgttatgctgaattactgaactatccttgctgttcatccagtataactgaagtctttgcacatgataatttgggggattggggttatgattttgaaaaaaagacatggtgtggacttacctc

SEQ ID NO: 18379 - DNA, 111 bp, Neocallimastix californiae
  Cellulose docking domain, dockering
ttggtccgaaaagtttggatattcttgctgtaaaaaatgtgttgtatatgaaacagataataatggtaaatggggttatgagaataatcattggtgtggtattccatccta

SEQ ID NO: 18380 - DNA, 109 bp, Neocallimastix californiae
  Cellulose docking domain, dockering
ttgcttttccgaatcacttggttacccctgttgcactaataactcaaaagtctactacactgacaaacatggttcctggggacttcaagacaatgaatggtgtggtctt

SEQ ID NO: 18381 - DNA, 117 bp, Neocallimastix californiae
  Cellulose docking domain, dockering
ttgtttctcagaagctcttggttacccctgttgtaccaataattcacgagtatattttataggtgaaagcggttcctggggaattcaagatgatcaatggtgtggtattatcggaac

SEQ ID NO: 18382 - DNA, 120 bp, Neocallimastix californiae
  Cellulose docking domain, dockering
atgctggtctttaaaactaggatactcatgttgtcctaccggtactaaagtttattccacagatagtgatggagattggggggttcacaatcataaatggtgtggtattattaagcattc

SEQ ID NO: 18383 - DNA, 117 bp, Neocallimastix californiae
  Cellulose docking domain, dockering
taaagctgctataaagggttattcctgttgtagtcaatgtaaagtgaaatataccgacaatgatggcgattggggagtagaaaataatcaatggtgttccattccatatacctgtaa

SEQ ID NO: 18384 - DNA, 117 bp, Neocallimastix californiae
  Cellulose docking domain, dockering
ttgtttctctcaggctttaggatatccatgttgttctaatccgaatacatcggtgaaagcaactgataaggatggagaatggggtatagaaaataatgcatggtgtggtatcaatga

SEQ ID NO: 18385 - DNA, 117 bp, Neocallimastix californiae
  Cellulose docking domain, dockering
ttgctggtctgaaaatttaggttataaatgttgttcaagtgccaacgctccaattgtttacactgatagtgatggtaactggggtgttgaaaacggtaactggtgtggtattccagt

SEQ ID NO: 18386 - DNA, 117 bp, Neocallimastix californiae
  Cellulose docking domain, dockering
ttgctgggctgaaaaattaggttactcttgctgtacttctacttctcaagttgtttacactgatggtgatggtaactggggtgttgaaaacggtaactggtgtggtattattactgg

SEQ ID NO: 18387 - DNA, 117 bp, Neocallimastix californiae
  Cellulose docking domain, dockering
ttgctgggctgaaaaattaggttactcttgctgtacttctacttctcaagttgtttacactgatggtgatggtaactggggtgttgaaaacggtaactggtgtggtattactactgg

SEQ ID NO: 18388 - DNA, 117 bp, Neocallimastix californiae
  Cellulose docking domain, dockering
ttgctggtctcaaagtttaggttactcatgttgtacaaatgctagcactccagttgtttactctgataatgacggtgactggggtgttgaaaacggtaactggtgtggtattccagt

SEQ ID NO: 18389 - DNA, 114 bp, Neocallimastix californiae
  Cellulose docking domain, dockering
atgctggtctaaaaaattaggttatccatgttgtaagggatgtaaattatattctactgatgatgatggttcatggggttatgaatctaatcaatggtgtggtattcaatcttt

SEQ ID NO: 18390 - DNA, 126 bp, Neocallimastix californiae
  Cellulose docking domain, dockering
ttgttggtctgaattaataggctatccatgttgttcttcagaaaatacaacagtttatcaacaagatgaatacggtgattggggttacgattttactaaacaagaatggtgtggtatttcgtacta

SEQ ID NO: 18391 - DNA, 129 bp, Neocallimastix californiae
  Cellulose docking domain, dockering
ttgttgggctgaaaatcttggttactcatgctgttctccagagaacacctacatttacagtagtgatgaaaatggtgattggggttttgattttgaaaatcaacaatggtgtggtattatttccaacaa

SEQ ID NO: 18392 - DNA, 120 bp, Neocallimastix californiae
  Cellulose docking domain, dockering
ctgttgggctaaaaagttaggttataaatgttgtaccgctaaatgtccaggcgaatattacatagatgaatatggtagttggggtgtagaaaacaatgattggtgtggtattaacaaatt

SEQ ID NO: 18393 - DNA, 120 bp, Neocallimastix californiae
  Cellulose docking domain, dockering
ctgttggtctgaaaaacttggttataaatgttgtaagactagttatccagtttacttcactgattcagatggtcaatggggtgttgaaaacggtaactggtgtggtattgttcacagttc

SEQ ID NO: 18394 - DNA, 99 bp, Neocallimastix californiae
  Cellulose docking domain, dockering
atatccttgttgtaaaggttgtaatgtagtagaagaagatgcttctggtaaatggggtattgaaaataattattggtgtgctattaaagactcatgtgg

SEQ ID NO: 18395 - DNA, 102 bp, Neocallimastix californiae
  Cellulose docking domain, dockering
tgcctattcaaattgttatggttgccaagtagttactgaagaagatggttataaatggggtgttgaaaacaatgattggtgtataattaatggaaattgtga

SEQ ID NO: 18396 - DNA, 120 bp, Neocallimastix californiae
  Cellulose docking domain, dockering
atgtttttcagttcatttaggtttcccttgttgtcaaaatacacaggaaattatttattctgataacgatggtgattggggtgttgaaaataatagttggtgtggaataaagaatgaaca

SEQ ID NO: 18397 - DNA, 105 bp, Neocallimastix californiae
  Cellulose docking domain, dockering
tcttgattatccatgctgttcatcttgtaacgtcatcttagttgaagacgacggtagccgttggggtgttcaagataataactggtgcagtattaaaaataattg

SEQ ID NO: 18398 - DNA, 111 bp, Neocallimastix californiae
  Cellulose docking domain, dockering
gtctgaacctgattatccatgctgtaaaaacacttgcaatgttattcttaatgatggttcagaatggggttccgaaaatggtgaatggtgtggtattccatcttcttgtag

SEQ ID NO: 18399 - DNA, 120 bp, Neocallimastix californiae
  Cellulose docking domain, dockering
atgttggtctgaaccattaggttacccatgttgttccgaatgtggttattcttactacagtgactccgatggtgaatggggtgttgaaaacgacgactggtgtggtcttttaccaagttg

SEQ ID NO: 18400 - DNA, 120 bp, Neocallimastix californiae
  Cellulose docking domain, dockering
ttgttggactgaagaattaggttatccatgttgtcaaacttgccaaatcagtcaattcaaagatgaaagtggtgattggggttacgaaaatgatgattggtgtggtattattgataatcc

SEQ ID NO: 18401 - DNA, 105 bp, Neocallimastix californiae
  Cellulose docking domain, dockering
tgctcaaggttatccatgttgtcaatcaactactagtgtcatttataccgaaaataatgttaaatggggtattgaaaatgataactggtgtgaaattaaggataa

SEQ ID NO: 18402 - DNA, 129 bp, Neocallimastix californiae
  Cellulose docking domain, dockering
ctgttggtctgaaaagttaggttatccatgttgtccaagtgaccgctgtcatgtccttgttactgatgaatcaggttcttggggtgtctaccaaaatgaatggtgtggtattgatacaaacgtttgcaa

SEQ ID NO: 18403 - DNA, 126 bp, Neocallimastix californiae
  Cellulose docking domain, dockering
ttgctggtctactcctcttggttaccaatgttgtccaagtggctgtaaagctgaagtctatgaaaccgatgacaatggcaaatggggttatgaaaatggcaaatggtgtggtgttccaaaagactg

SEQ ID NO: 18404 - DNA, 102 bp, Neocallimastix californiae
  Cellulose docking domain, dockering
taacagtggctataactgttgtctcttcagtacctccgttataacgaccgataatgtgggaaaatggggtattgaaaatgatgaatggtgtctcttcgaaag

SEQ ID NO: 18405 - DNA, 123 bp, Neocallimastix californiae
  Cellulose docking domain, dockering
ctgttggtccactaaacttggttacaagtgctgtaccctaagaacaacaaagccaatctactactctaaatctgctgataagtggtatggtgttgaaaatgatgaatggtgtggtatcattga

SEQ ID NO: 18406 - DNA, 96 bp, Neocallimastix californiae
  Cellulose docking domain, dockering
atataattgttgtgaggaatgtaacgtcgtttacaccgactctgaggattggggtattgaaaatggtaagtggtgttctataccttattcttgtaa

SEQ ID NO: 18407 - DNA, 102 bp, Neocallimastix californiae
  Cellulose docking domain, dockering
taacagtggctataactgttgtctcttcagtacctccgttataacgaccgataaagtgggtcagtggggtattgaaaatgatgaatggtgtctcttcgaaag

SEQ ID NO: 18408 - DNA, 96 bp, Neocallimastix californiae
  Cellulose docking domain, dockering
atataattgttgtaaggaatgtaacgtcgtttacaccgactcagaagattggggtattgaagatggtaagtggtgttctatccctcattcctgtaa

SEQ ID NO: 18409 - DNA, 123 bp, Neocallimastix californiae
  Cellulose docking domain, dockering
ctgttggtccactaaactcggttacaagtgctgtaccctaagaacaacaaaaccaacctactactctaaatctgctgataagtggtatggtgttgaaaatgatgaatggtgtggtatcattga

SEQ ID NO: 18410 - DNA, 93 bp, Neocallimastix californiae
  Cellulose docking domain, dockering
cccttgctgtgaatcttgtgaaatattttataccgatactgaggattggggtattgaaaatggtaactggtgttccattcctcattcttgtaa

SEQ ID NO: 18411 - DNA, 123 bp, Neocallimastix californiae
  Cellulose docking domain, dockering
ctgctggtccactaagtttggttataagtgttgtaccttaagaaccacagaaccatccaccttttctgaatctgatggtaaatggtatggtatcgaaaatggtaaaaagtgtggaattgttga

SEQ ID NO: 18412 - DNA, 102 bp, Neocallimastix californiae
  Cellulose docking domain, dockering
taacagtggttataattgttgcctcttcacaactacagttgaaacaacagattctgtgggtgactggggtattgaaaatggtgattggtgtctcttcgaaag

SEQ ID NO: 18413 - DNA, 117 bp, Neocallimastix californiae
  Cellulose docking domain, dockering
atgttggtctgaaaaattaggttacccatgttgtacaagtggtgctcaagtttattacactgatgctgatggtcaatggggtgttgaaaacaataactggtgtggtattattgctgg

SEQ ID NO: 18414 - DNA, 123 bp, Neocallimastix californiae
  Cellulose docking domain, dockering
ttgtttcgccaccaaattaggttacccatgttgtactactactactgaagttgtttttactgataatgatggtaaatggggtgttgaaaacaataactggtgtggtatggctgatgaatgttg

SEQ ID NO: 18415 - DNA, 120 bp, Neocallimastix californiae
  Cellulose docking domain, dockering
atgttggtcagaaagattaggatacccatgttgtaaatcaagtacggaagttttctttgaagatagtgatggtcaatggagtgttgaaaatgatgattggtgtggtattcaaaaagataa

SEQ ID NO: 18416 - DNA, 120 bp, Neocallimastix californiae
  Cellulose docking domain, dockering
ttgttggtctaaagctttaggatatccatgttgtacttcgactaatgatgttatttataaagataatgatggtgaatggggtattgaaaatgatgattggtgtggtattaccaaaagcaa

SEQ ID NO: 18417 - DNA, 114 bp, Neocallimastix californiae
  Cellulose docking domain, dockering
ttgtttctctactagattaggttatccttgttgttcaggaaataccgtcgcttatacagataatgatggtgattggggtgttgaaaatggtaattggtgtggtattggaaatac

SEQ ID NO: 18418 - DNA, 120 bp, Neocallimastix californiae
  Cellulose docking domain, dockering
ttgttggtctaccgctttaggttatccttgttgttcttcttcaagtgccgaagtttggtataccgataatgacggagcatggggtgttgaaaatggtgactggtgtggtattccaactgg

SEQ ID NO: 18419 - DNA, 66 bp, Neocallimastix californiae
  Cellulose docking domain, dockering
ttggtataccgataatgacggagcatggggtgttgaaaatggtgactggtgtggtattccaactgg

SEQ ID NO: 18420 - DNA, 123 bp, Neocallimastix californiae
  Cellulose docking domain, dockering
atgtatttctgaagttttaggttacccatgctgtcctccagaaattactgaagtctacgtcactgatattaatggtgattgggcttacgattatgaaaaacaagtttggtgtggtcttactcc

SEQ ID NO: 18421 - DNA, 114 bp, Neocallimastix californiae
  Cellulose docking domain, dockering
atgttggtctgaaagtttgaattatccatgttgtgataattgtgttgtctatgaagtcgatgataatggcaaatggggttatgatttccaaactcaaacctggtgtggtagtcc

SEQ ID NO: 18422 - DNA, 114 bp, Neocallimastix californiae
  Cellulose docking domain, dockering
ttgctttgctgaaagattaggttatccatgttgttctggtaatgaagttgtttacaccgataacgatggaaagtggggtgtagaaaacggtaattggtgtggtattgctgatgc

SEQ ID NO: 18423 - DNA, 120 bp, Neocallimastix californiae
  Cellulose docking domain, dockering
ttgttggtccctttctcaaggttatccatgctgttcttcttcaaatgctgaagtttggtacaccgatgcctcaggtaagtggggtgttgaaaatggagactggtgtggaattccaactgg

SEQ ID NO: 18424 - DNA, 120 bp, Neocallimastix californiae
  Cellulose docking domain, dockering
atgttggtctgaagctttaggttacccatgttgttctgaatgcataaatgcctacgctgaagatgctgatggcaaatggggtattgaaaatgataactggtgtggtcttttatcacattg

SEQ ID NO: 18425 - DNA, 108 bp, Neocallimastix californiae
  Cellulose docking domain, dockering
gaaattaggctatagatgttgtagttcttgtgaaataaaatatatagataataatattaaatatggttatgaagacggtgaatggtgtggtattcctgatgaatgcta

SEQ ID NO: 18426 - DNA, 114 bp, Neocallimastix californiae
  Cellulose docking domain, dockering
caccagatttggatttccatgttgtgaaaaatgtatacttcaatatgttgatgattttggaaattggggatttgaaaatgacaattggtgtggtatttcaccaaatatatgtga

SEQ ID NO: 18427 - DNA, 105 bp, Neocallimastix californiae
  Cellulose docking domain, dockering
agttaaaggttatgaatgttgcgaaggttgtacagttgaatatgaagaaaacaatataaaatggggttacgaaaatagaaattggtgtgttataccctattcatg

SEQ ID NO: 18428 - DNA, 99 bp, Neocallimastix californiae
  Cellulose docking domain, dockering
atattcatgttgtgaaaaatgtaaggttcgttactctgacaagcatggtgattggggtatcgaaaataaagagtggtgttccataaaatatacttgtaa

SEQ ID NO: 18429 - DNA, 126 bp, Neocallimastix californiae
  Cellulose docking domain, dockering
ttgttggtcagaaattttaggttacagttgttgcaaaaaaacctgtaaaacaaaatattcagataaacatggtaattggggtgttgaaaataaacagtggtgtggtattattgatgagaaatgcaa

SEQ ID NO: 18430 - DNA, 126 bp, Neocallimastix californiae
  Cellulose docking domain, dockering
ttgttggtcagaaattttaggttatagttgttgcaaagaaacctgtaagacaaaatatactgataagcatggtaattggggtgttgaaaataaacaatggtgtggtattattgatgagaaatgtaa

SEQ ID NO: 18431 - DNA, 90 bp, Neocallimastix californiae; identical to SEQ ID NO: 15887
  Cellulose docking domain, dockering

SEQ ID NO: 18432 - DNA, 123 bp, Neocallimastix californiae
  Cellulose docking domain, dockering
ttgttgggttgaacaatttggttatccatgttgttcatcaagaaataagattgtttatgctcatgatggtgaaggagattggggttatgactttagtaagatggaatggtgtggtattacacc

SEQ ID NO: 18433 - DNA, 120 bp, Neocallimastix californiae
  Cellulose docking domain, dockering
ttgttggtcactttctcagggttatccatgttgctcttcatcaaatgctgaagtttggtacaccgatgcctccggtaaatggggtgttgaaaatggtgactggtgtggtattccaactgg

SEQ ID NO: 18434 - DNA, 114 bp, Neocallimastix californiae
  Cellulose docking domain, dockering
ttgtttctctaccagattaggttatccatgttgttctggaaatgatgttgtttacattgataatgacggtaaatggggtgttgaaaatggtaactggtgtggtattgccgatac

SEQ ID NO: 18435 - DNA, 123 bp, Neocallimastix californiae
  Cellulose docking domain, dockering
atgttggtctcaaagattaggttataattgttgtaccacttcctgttatatctatgaaaaggaccaagatggtaattggggctatgaaaacaacgaatggtgtggaattccatcctcatgcat

SEQ ID NO: 18436 - DNA, 112 bp, Neocallimastix californiae; identical to SEQ ID NO: 15891
  Cellulose docking domain, dockering

SEQ ID NO: 18437 - DNA, 108 bp, Neocallimastix californiae
  Cellulose docking domain, dockering
tggtatatacaaatgttgcagtagtagtgatgctgaagtatggtatgttgatgatgatggaaattggggtgttgaaaatggagaatggtgcttcatagacactgaaaa

SEQ ID NO: 18438 - DNA, 117 bp, Neocallimastix californiae
  Cellulose docking domain, dockering
ttggtctagaaaactcggttacagatgttgttctgctgataataccgaagttatagtaatagataaagatggaaaatggggtgttgaagaccaagaatggtgtggtatcattgaaaa

SEQ ID NO: 18439 - DNA, 117 bp, Neocallimastix californiae
  Cellulose docking domain, dockering
atgttggtctgagccattaggttatccttgttgtcagaaatgttcaattattgaaaccaatgaaagtggttcatggggatttgaattaaatcaatggtgtggtattcctacttattg

SEQ ID NO: 18440 - DNA, 120 bp, Neocallimastix californiae
  Cellulose docking domain, dockering
atgtttatctgaaataattggttattcatgctgtccattaggttatgaaaatatttatcatgataattatggtgactggggttatgattttgaaaatgatacatggtgtggtcttacacc

SEQ ID NO: 18441 - DNA, 93 bp, Neocallimastix californiae
  Cellulose docking domain, dockering
cccctgttgtaagacctgtgaagttgtctataccgatacggaagattggggtattgaagacgctaactggtgttccattcctcactcttgtaa

SEQ ID NO: 18442 - DNA, 105 bp, Neocallimastix californiae
  Cellulose docking domain, dockering
taacagtggctacaactgttgtctcttcaccaccaaagtagaaacgagtgatacggtgggggactggggtatcgaaaacaatgaatggtgtctcttcgaaagtag

SEQ ID NO: 18443 - DNA, 123 bp, Neocallimastix californiae
  Cellulose docking domain, dockering
ctgttggtccaccaaactgggttataaatgttgtaccttaagaacgaccgagccaatccactactctaaatctgcggataaatggtacggtgtggaaaatgacgaatggtgtggtattgtcga

SEQ ID NO: 18444 - DNA, 117 bp, Neocallimastix californiae
  Cellulose docking domain, dockering
ctgttggtctacttccttaggtttcccatgttgtagtggtaattctattgtttatttcactgattccaatggtcaatggggtattgaaaatgaccaatggtgtggtaagccaaattc

SEQ ID NO: 18445 - DNA, 123 bp, Neocallimastix californiae
  Cellulose docking domain, dockering
ttgttggagtagtaaatatggttacaaatgctgtagtacatcaacctgtagaaatagtgtattcgctgatactgatggtcaatgggatgttgaaaacggtcaatggtgtggtatttctacagc

SEQ ID NO: 18446 - DNA, 118 bp, Neocallimastix californiae
  Cellulose docking domain, dockering
tattggtgcacaaggttacccatgttgtaagactacctgttccgtcttctctactgatagtgatggtaaatggggtattgaaaacgacaattggtgtttaattgatagttctaaatgc

SEQ ID NO: 18447 - DNA, 126 bp, Neocallimastix californiae
  Cellulose docking domain, dockering
ttgttggtctacctcattaggctatccatgttgtaaatcatgtaatacttcagccgttttcgaagataatgatggtaaatggggtattgaaaacgatgactggtgtggtattccaaagagttgttc

SEQ ID NO: 18448 - DNA, 114 bp, Neocallimastix californiae
  Cellulose docking domain, dockering
atgttggtctgaaagatttaatattccttgttgtaaatcaactaatactgtcgtaagatcaacttatgatggtgaatggggaatggaaaatggtgaatggtgtggtcttggttt

SEQ ID NO: 18449 - DNA, 123 bp, Neocallimastix californiae
  Cellulose docking domain, dockering
ttcttcaaagattactgctcaaggttataagtgctgttctgatccaaactgtgttgtttactacactgatgctgatggtacttggggtgttgaaaacggccaatggtgtggttgtggcagtag

SEQ ID NO: 18450 - DNA, 114 bp, Neocallimastix californiae
  Cellulose docking domain, dockering
tcaaaagattattgcccaaggttacaaatgttgcgctgattcaaattgtactgtttactacactgatgccgatggtacctggggtgttgaaaatggtgaatggtgtggttgtgg

SEQ ID NO: 18451 - DNA, 120 bp, Neocallimastix californiae
  Cellulose docking domain, dockering
atgtgcttttgaaaagattggttataaatgttgtgaaagtactactgatgtcgtatttgaagatggaagtggtacttggggtgtagaaaataatgaatggtgtggtattacaaataaggc

SEQ ID NO: 18452 - DNA, 102 bp, Neocallimastix californiae
  Cellulose docking domain, dockering
tagtggctatccatattgtaagagtactactgaagtcatttatactgatgatgtaaactggggtgttgaaaatggtgactggtgtgttattaagacctctgg

SEQ ID NO: 18453 - DNA, 117 bp, Neocallimastix californiae
  Cellulose docking domain, dockering
tacttgctgggcccaagctcaaggatatcaatgttgtacttctacctccgaagttgttttcactgatgaaagtggtgattggggtgtagaaaacggtgaatggtgtggaattaaaaa

SEQ ID NO: 18454 - DNA, 108 bp, Neocallimastix californiae
  Cellulose docking domain, dockering
atgttatggttacaagtgttgtgaacgttgtgaagttgaatactctgatgatactggttcttggggtgttgaaaatggtgactggtgtggtattccagattcttgtaa

SEQ ID NO: 18455 - DNA, 102 bp, Neocallimastix californiae; identical to SEQ ID NO: 18452
  Cellulose docking domain, dockering

SEQ ID NO: 18456 - DNA, 117 bp, Neocallimastix californiae; identical to SEQ ID NO: 18453
  Cellulose docking domain, dockering

SEQ ID NO: 18457 - DNA, 108 bp, Neocallimastix californiae; identical to SEQ ID NO: 18454
  Cellulose docking domain, dockering

SEQ ID NO: 18458 - DNA, 120 bp, Neocallimastix californiae
  Cellulose docking domain, dockering
ttgctggtctgttaagttaggttacccatgttgtgaagtttctaatgccatttactctgttgatgacaatggtagttggggtgttgaagatgatttctggtgtggtatcgttgaagataa

SEQ ID NO: 18459 - DNA, 108 bp, Neocallimastix californiae
  Cellulose docking domain, dockering
accagattacccatgttgtaaattatcttctactagagtagaatacactgatgcaagtggtagttggggtattgaaaatggtaactggtgtggtattgtaaagtcttc

SEQ ID NO: 18460 - DNA, 117 bp, Neocallimastix californiae
  Cellulose docking domain, dockering
ttgttgggctgaagcacttggatattcatgttgtccaagtggtactccagttagttacactgatgcttcaggtgattggggttacgttaatgattggtgtggtattgttaaatccac

SEQ ID NO: 18461 - DNA, 129 bp, Neocallimastix californiae
  Cellulose docking domain, dockering
atgctggtctgattcattaggatacccatgttgtagttccgctgatattcaagttgtatctgaagattcttctggaaaatggggtattgaaaataacaactggtgtggtattccaaaggaaacttgttg

SEQ ID NO: 18462 - DNA, 96 bp, Neocallimastix californiae
  Cellulose docking domain, dockering
caactgttgtaaaggatgtgatgttattgaagaatctgatgaaggtaaatggggtattgaaaatggttactggtgtggtattaaagattcttgctt

SEQ ID NO: 18463 - DNA, 102 bp, Neocallimastix californiae
  Cellulose docking domain, dockering
tgcttatgatgaatgtaaagcatgtaatgttgtttatgttgaaggtgatgaaaaatggggtgttgaaaacaatgactggtgtataattccatccaagtgtga

SEQ ID NO: 18464 - DNA, 102 bp, Neocallimastix californiae
  Cellulose docking domain, dockering
ttcaaaatataaatgttgtgattcctgtaaagtttctgtggatgatggtaataaatggggtatacttaatggtgaatggtgtagtataacctatgattgtct

SEQ ID NO: 18465 - DNA, 117 bp, Neocallimastix californiae
  Cellulose docking domain, dockering
atgctgggctgaggcttatggttattcatgttgtactaaatgtgtatccgtagtagatatatctaataatagaaaatggggtatagaaaataatagatggtgtggtattccatcata

SEQ ID NO: 18466 - DNA, 123 bp, Neocallimastix californiae
  Cellulose docking domain, dockering
tccatctgctattaccgctcaaggttacaagtgctgctcttcctgtggtaccgtttactacaccgatggtgatggtgaatggggtgttgaaaacggtgactggtgtggaatgccaaccaactg

SEQ ID NO: 18467 - DNA, 114 bp, Neocallimastix californiae
  Cellulose docking domain, dockering
ttctgcttctatcattgctcaaggttacaagtgctgttccgctaactgtgaagttgtttatactgataatgatggtgattggggtgttgaaaacaacgaatggtgtggttgtgg

SEQ ID NO: 18468 - DNA, 114 bp, Neocallimastix californiae
  Cellulose docking domain, dockering
ttgttggtcaacccaattgggctataaatgttgtaccaaaactaattttattgtatataccgacaaggatggctactggggtgttgaaaataagcaatggtgtggtattagagg

SEQ ID NO: 18469 - DNA, 117 bp, Neocallimastix californiae
  Cellulose docking domain, dockering
ttgttggtctagttccttaagctatggatgctgttctggatgtaaagttctctataccgataaagatggtaaatggggaatagaaaatggtgattggtgtggtattccaaaaaattg

SEQ ID NO: 18470 - DNA, 117 bp, Neocallimastix californiae
  Cellulose docking domain, dockering
atgtccaggtaagaaatatggatatccatgttgtgaaagctgtgatgtcttcttagaagatgaaagtggtatttggggagctgaaaatggtcaatggtgcagtattaagaccagctg

SEQ ID NO: 18471 - DNA, 120 bp, Neocallimastix californiae
  Cellulose docking domain, dockering
atgttggtctgaagctttcggatataaatgctgttctgctggatgtaattcagtagttgttgttattgatgaaagtggttactggagtgctgaaaacggtgaatggtgtggtattccaga

SEQ ID NO: 18472 - DNA, 126 bp, Neocallimastix californiae
  Cellulose docking domain, dockering
cccagctttccaaagccaaggttaccaatgttgtagcaacaacaattgtaatattgtttaccaagatggtactggtaactggggtgttgaaaacaaccaatggtgtggtctttcctacaactgtgg

SEQ ID NO: 18473 - DNA, 105 bp, Neocallimastix californiae
  Cellulose docking domain, dockering
acaatacccatgttgtagtggatgtgatgttatttacactgatactgatggtgaatggggtgttgaaaactatgactggtgtttcattgacagcaatcgttgtca

SEQ ID NO: 18474 - DNA, 123 bp, Neocallimastix californiae
  Cellulose docking domain, dockering
ctcatctactattaaaagtcaaggttatgcatgctgtagatcatgcgatattatttattctgatgagagtggtgattggggaattgaaaatagttattggtgtggaatttctaattcatgtaa

SEQ ID NO: 18475 - DNA, 120 bp, Neocallimastix californiae
  Cellulose docking domain, dockering
ctcagctaatattaaaaaacaaggttattcatgctgttcaagctgtattatatattttactgataatgatggcaaatggggtgttgaaaatggaaaatggtgtggtattcaagaatattg

SEQ ID NO: 18476 - DNA, 123 bp, Neocallimastix californiae; identical to SEQ ID NO: 18474
  Cellulose docking domain, dockering

SEQ ID NO: 18477 - DNA, 120 bp, Neocallimastix californiae; identical to SEQ ID NO: 18475
  Cellulose docking domain, dockering

SEQ ID NO: 18478 - DNA, 123 bp, Neocallimastix californiae
  Cellulose docking domain, dockering
ttgtaaatttactcaacttggttatccatgttgtgataatccaaagactgtttccgtttataccgatgaatctggtgattggggtattgaaaatggtgattggtgtggtattgaccttaacta

SEQ ID NO: 18479 - DNA, 117 bp, Neocallimastix californiae
  Cellulose docking domain, dockering
ttgtactggaatgaatttaggttacccatgttgtgatgattgtaatgtcgtttacacggatcatgatggtaaatggggtgttcaaaatgatgattggtgtggtatcaagagtacttg

SEQ ID NO: 18480 - DNA, 114 bp, Neocallimastix californiae
  Cellulose docking domain, dockering
ttggtctgcaaaatttggttatccttgctgtaaggaaactactgttgtagaagctgttgatgaaaatggcagatggggattagaaaatggtggaagatgtggttttatcgaagg

SEQ ID NO: 18481 - DNA, 123 bp, Neocallimastix californiae
  Cellulose docking domain, dockering
atgtcattttttagatataaattataaatgttgtactacaaccatgacatcttcatatgaagatattgatggtttatggggaaatgaaactaatggtgaatggtgtggtattgaagaagaaga

SEQ ID NO: 18482 - DNA, 120 bp, Neocallimastix californiae
  Cellulose docking domain, dockering
ttgttggtcagaaccattaggatacccatgttgtactggtattatcgaaactgaatatactgataaagatggggaatggggattacaaaatggcgattggtgtggtatcactgatgaaaa

SEQ ID NO: 18483 - DNA, 111 bp, Neocallimastix californiae
  Cellulose docking domain, dockering
ttttgcaaatgcctatggatatcctggatgtaaaagtactaccgaaattaaatattacgatgaagaaggttcttggggttatgaaaatggaacctggtgtggtattgatgt

SEQ ID NO: 18484 - DNA, 105 bp, Neocallimastix californiae
  Cellulose docking domain, dockering
aggttataaatggtgttctgatccaaatactaaaagatatccatataatgatgaagatttttggggtgttgaaaatggtaattggtgtgttattaaaaataatac

SEQ ID NO: 18485 - DNA, 120 bp, Neocallimastix californiae
  Cellulose docking domain, dockering
gtgttggtcagaaccattaggttacccatgttgtactggtattatcaagactgaatatactgataaagatggggaatggggattacaaaatggcgattggtgtggtatcactgatgaaaa

SEQ ID NO: 18486 - DNA, 120 bp, Neocallimastix californiae
  Cellulose docking domain, dockering
gtgttggtcagaaccattaggttacccatgttgtactggtaataccaaaactgaatatactgataaagatggggaatggggattacaaaatggtgattggtgtggtatcaatgaagataa

SEQ ID NO: 18487 - DNA, 99 bp, Neocallimastix californiae
  Cellulose docking domain, dockering
aaaatataaatgttgcgaatcttgcaatgtttcctacgatgatggaaataaatggggtgtattaaatggagaatggtgtagtttaacctatgaatgtct

SEQ ID NO: 18488 - DNA, 117 bp, Neocallimastix californiae
  Cellulose docking domain, dockering
ttgtttctctactagacttggttacccatgctgttccccaaataataccaatgttgtttatgctgataatgatggtgattggggtattgaaaatggaaattggtgtggtatgagtag

SEQ ID NO: 18489 - DNA, 105 bp, Neocallimastix californiae
  Cellulose docking domain, dockering
agcttcttacccatgctgtgaaaatacttgtgctgttcaatatactgacgctgatggtcaatggggtattgaaaatggtgaatggtgtagtatttctaagagtga

SEQ ID NO: 18490 - DNA, 123 bp, Neocallimastix californiae
  Cellulose docking domain, dockering
atgttggtctagtgctatgggttattcatgttgtaaatcatgtgatagtttcaattacaaagataatgatggtgaatggggtatagaaaatgatgcctggtgtggtattccaaaagaatgttc

SEQ ID NO: 18491 - DNA, 99 bp, Neocallimastix californiae
  Cellulose docking domain, dockering
tgctttaggttatccatgttgtaaatctacatgtaatgtttactcatctgatgaaagtggtcaatggggtattgaagataacaactggtgtttaattga

SEQ ID NO: 18492 - DNA, 93 bp, Neocallimastix californiae
  Cellulose docking domain, dockering
atatgaatattgccaaggctgtagagtattttatgaagatgaccaacaatggggtgttgaaaacaatgattggtgtattattccatctaaatg

SEQ ID NO: 18493 - DNA, 99 bp, Neocallimastix californiae
  Cellulose docking domain, dockering
atacatatgttgtgaaggttgtaatgtaatagaagaaacagctgaaggtaaatggggtattgaaaagaaccaatggtgtggtatcaaaagttcttgttt

SEQ ID NO: 18494 - DNA, 90 bp, Neocallimastix californiae; identical to SEQ ID NO: 15951
  Cellulose docking domain, dockering

SEQ ID NO: 18495 - DNA, 102 bp, Neocallimastix californiae
  Cellulose docking domain, dockering
agattacccatgttgtaccaacactaaaactgcggtctacactgataatgccggtaatgaatggggcatggaaaataataactggtgtggtattattccgga

SEQ ID NO: 18496 - DNA, 108 bp, Neocallimastix californiae
  Cellulose docking domain, dockering
aaagggttataactgttgtaaaaattcttgtaatgtcacttacaaggataacgatggtaattgggatgtagagaacggtaactggtgtggtgttcccttctcttgttt

SEQ ID NO: 18497 - DNA, 120 bp, Neocallimastix californiae
  Cellulose docking domain, dockering
cttctctgaagctttaggttatccatgttgctctgattcaaacgctgctgttgttactaccgatgagtttggtcattggggtattgaaaataatgaatggtgtggtatactcggctctga

SEQ ID NO: 18498 - DNA, 105 bp, Neocallimastix californiae
  Cellulose docking domain, dockering
taactcaggctataattgttgtgtctttgatactactgccgttcaaaccgtggatgttgttggcaaatgggggattgaaaatggagattggtgtctctttgatga

SEQ ID NO: 18499 - DNA, 123 bp, Neocallimastix californiae
  Cellulose docking domain, dockering
ctgttggtcaaagagtttaggttacccatgctgtacctctaaaacaacagaactaatttacttttctaaaagtgcgaataaatggtatggtgttgaaaatgatgaatggtgtggtattgttga

SEQ ID NO: 18500 - DNA, 96 bp, Neocallimastix californiae
  Cellulose docking domain, dockering
ctataaatgttgttcttcctgtgaaattctttatactgacacggaagaatggggtattgaagatggtgaatggtgttccattcctcattcctgtaa

SEQ ID NO: 18501 - DNA, 111 bp, Neocallimastix californiae
  Cellulose docking domain, dockering
tatcttaaagaaaggatacaaatgttgttcaaaggattgtttcatagtttttactgatgatgatggtacatggggtattgaaaatgatcaatggtgtggttgtgatactcc

SEQ ID NO: 18502 - DNA, 120 bp, Neocallimastix californiae
  Cellulose docking domain, dockering
tgctattacttcccaaggttacaagtgttgtaaagaagataactgttcagttattgaaaccgatgatgctggtaaatggggtattgaagatggacaatggtgtggtatttctgacaaatg

SEQ ID NO: 18503 - DNA, 99 bp, Neocallimastix californiae
  Cellulose docking domain, dockering
tcaaggttatccatgttgtcaatccaccactaaagttgaatatacagatggagatggtaactggggtgttgaaaatggtgattggtgtattattagaaa

SEQ ID NO: 18504 - DNA, 117 bp, Neocallimastix californiae
  Cellulose docking domain, dockering
ttatagaattactagtcaaggttataaatgttgttctagaaattgtgttgttgtttactctgatgctgatggtaattggggtgttgaaaatggtgaatggtgtggatgtgctgctgg

SEQ ID NO: 18505 - DNA, 123 bp, Neocallimastix californiae
  Cellulose docking domain, dockering
atgttggtcagaagttttaggttatccatgttgtacttcttcctgccatgtttatgaaacagattctgatggtgaatggggttatgaaaataaacaatggtgtggtattccaagtacttgttc

SEQ ID NO: 18506 - DNA, 120 bp, Neocallimastix californiae
  Cellulose docking domain, dockering
ctgttggtctaaaaaattaggttatccatgttgtacttcttcatctcaagtttatgaaactgatgctaatggtgaatggggttatgaagataatcattggtgtggtattccaaaagaaaa

SEQ ID NO: 18507 - DNA, 117 bp, Neocallimastix californiae
  Cellulose docking domain, dockering
atgcttttcaaaatctcttggttatccctgttgtacttctaaaaatcctcgtatctatttcagtgatagtaaaggtaattggagttatgaaaatggaaaatggtgtggtgcatcctc

SEQ ID NO: 18508 - DNA, 117 bp, Neocallimastix californiae
  Cellulose docking domain, dockering
atgttttgcaactgctctcggctatccatgctgttctccatatgctaaagaacgtttcagagataaaaatggtagatggggtattgaatatggtgcatggtgtggtttatttaatta

SEQ ID NO: 18509 - DNA, 117 bp, Neocallimastix californiae
  Cellulose docking domain, dockering
atgttttaccattccattgggttatccttgttgtactaaaactaaagaagtaacttatactaatggctatggtacatggggtacagaaaatggagattggtgtggtcttaagcaagc

SEQ ID NO: 18510 - DNA, 123 bp, Neocallimastix californiae
  Cellulose docking domain, dockering
ctggtccaaaacattaggctatgattgttgtaaaaatacatgtaatgttgtttattcagataatgatggagaatggggagttgaaaataatgaatggtgtggtataatacaaagtaattgtaa

SEQ ID NO: 18511 - DNA, 76 bp, Neocallimastix californiae
  Cellulose docking domain, dockering
atatccatgttgtactcattgtgatatatattatgttgacgaaaatggtaattggggtattgaaaataataactgg

SEQ ID NO: 18512 - DNA, 108 bp, Neocallimastix californiae
  Cellulose docking domain, dockering
tgcctacagtaactgtaatagtacatgtagagttgtaacagttgaagacggtgtcagctggggtgtagaaaataatgactggtgtattattaaaccatctctttgtaa

SEQ ID NO: 18513 - DNA, 102 bp, Neocallimastix californiae
  Cellulose docking domain, dockering
agattatccatgttgtgaagaatgtaatgtatatgaagaagatgattctggtaaatggggtattgaaaataaccaatggtgtggtattaaagacagttgctt

SEQ ID NO: 18514 - DNA, 123 bp, Neocallimastix californiae
  Cellulose docking domain, dockering
tgaaaagattcaatcccaaggttataagtgttgttctgataagaactgtgctgttgtctacagtgataatgatggtacttggggtgttgaaaatggacaatggtgtggatgtaacaataagac

SEQ ID NO: 18515 - DNA, 93 bp, Neocallimastix californiae
  Cellulose docking domain, dockering
tggttatccatgttgtcaatctaacaaaactgtctacttctctgatgaatctggtgattggagtgttgaaaacaataactggtgtttaattgc

SEQ ID NO: 18516 - DNA, 120 bp, Neocallimastix californiae
  Cellulose docking domain, dockering
atgtagatttgaatctcttggatatccatgttgtagtcattgtaatgttatttacactgatgatgatggtaactggggtgctgaaaatggtcaatggtgtggtattccagaaaactgtgg

SEQ ID NO: 18517 - DNA, 120 bp, Neocallimastix californiae
  Cellulose docking domain, dockering
atgttggtctgaagctttaggttacccatgttgttctacttgttccagtcctgtctacagtgataatgatggtaactggggtattgaaaatggtgactggtgtggtcttttagccagttg

SEQ ID NO: 18518 - DNA, 120 bp, Neocallimastix californiae
  Cellulose docking domain, dockering
ttgtgttgttaaatctcttggttacccatgttgttcaccaaacaacactgaagtcttctacactgatgaaaatggtgattggggtgttgaaaatggtgactggtgtggtattactaaggc

SEQ ID NO: 18519 - DNA, 123 bp, Neocallimastix californiae
  Cellulose docking domain, dockering
atgttgggctactgctctcggttatgactgttgtagtactaatgtatgtagaactgtatactacgaagataatgacggtaaatgggatgttgaaaatggtcaatggtgtggtattacttctgc

SEQ ID NO: 18520 - DNA, 114 bp, Neocallimastix californiae
  Cellulose docking domain, dockering
ttgttggtctcttgctttaggttacccatgttgtgttggtaatgatgttatctttgttgatgaaagtggtgaatggggtgttgaaaacaataattggtgtggtattgttaaagc

SEQ ID NO: 18521 - DNA, 109 bp, Neocallimastix californiae; identical to SEQ ID NO: 15981
  Cellulose docking domain, dockering

SEQ ID NO: 18522 - DNA, 123 bp, Neocallimastix californiae
  Cellulose docking domain, dockering
gtgctggtcattgaaagatggctatccatgttgtaagactactttcacagttattgaagtagatgaaaatggtaaaaagtggggttttgaaaataataattggtgtggtattaatgggtcaaa

SEQ ID NO: 18523 - DNA, 123 bp, Neocallimastix californiae
  Cellulose docking domain, dockering
atgttgggccacaaaatatgattatccatgttgtaaaaagactactgaggtaattgaaaaagatgaacatggaaaatggggctttgaaaacaatgattggtgtggtatagttgatagtaattc

SEQ ID NO: 18524 - DNA, 117 bp, Neocallimastix californiae
  Cellulose docking domain, dockering
ttgttggtcaatagatttaggttatccatgttgtatagaaaataatgttgttgaagtcaatgaaaatggaaaatggggtattgagaataataactggtgtggtataatcgagaaaaa

SEQ ID NO: 18525 - DNA, 120 bp, Neocallimastix californiae
  Cellulose docking domain, dockering
atgctgggcatcagaatttaattatccatgttgtaaaacaaccagtaaagtaattgaagtaaacgaatatggtaaatggggtatagaaaataatgactggtgtggaattattaacgataa

SEQ ID NO: 18526 - DNA, 120 bp, Neocallimastix californiae
  Cellulose docking domain, dockering
atgctgggcatcggaatttggttatccatgttgtaaaacgactactgaagtaattgaaaaggatgagcatggaaaatggggttttgaaaataaagagtggtgtggtatagttgatagtaa

SEQ ID NO: 18527 - DNA, 105 bp, Neocallimastix californiae
  Cellulose docking domain, dockering
caattctggatataattgttgtatattaactaaatcagttaaattaatcgataatgttggtcagtggggtgttgaaaatggtgaatggtgtcttttcgaggaaga

SEQ ID NO: 18528 - DNA, 126 bp, Neocallimastix californiae
  Cellulose docking domain, dockering
ctgttgggctataagtgaaggttatccatgttgtaaaaacaaaaatactcaagttcaagatatatctagtgatggtaggaaatggggttttgaaaatgatgattggtgtggtattatcgaagagaa

SEQ ID NO: 18529 - DNA, 96 bp, Neocallimastix californiae
  Cellulose docking domain, dockering
tgaatattcttgctgtagtagttgtgatgtttattatgttgatgaatttgaatggggtgtggaagatggttcatggtgtttgactccttttaaatg

SEQ ID NO: 18530 - DNA, 117 bp, Neocallimastix californiae
  Cellulose docking domain, dockering
ttgttggtcattaccacaaggttatccttgttgtaaaaaaactacaaatgttacttacagggatgaaacaggtaattggggtttcgaatttggaaattggtgtggtatggtctatgg

SEQ ID NO: 18531 - DNA, 111 bp, Neocallimastix californiae
  Cellulose docking domain, dockering
tagtaagtttggttattcctgttgtaaaaaggaaaccactgccattttaacaactgatagagatgccgattggggagttgaggatggtaaatggtgtgccataaaagaata

SEQ ID NO: 18532 - DNA, 99 bp, Neocallimastix californiae
  Cellulose docking domain, dockering
tcaaggttatccatgctgtgaatcttctactattgtctactacaccgatggtgatggtgattggagtgttgaaaatggtgactggtgtattattagaaa

SEQ ID NO: 18533 - DNA, 117 bp, Neocallimastix californiae
  Cellulose docking domain, dockering
ttctgctaaaatcattcaacaaggttattcatgttgtcaaccaggttgtactgttgtttacactgataatgatggtgattggggtgttgaaaataatgcctggtgtggatgtggtgg

SEQ ID NO: 18534 - DNA, 117 bp, Neocallimastix californiae
  Cellulose docking domain, dockering
ttgtttctctgaaaaacttggttacccatgttgttcagctaacaataagaatgttgtttacactgacagtgatggtgattggggtgttgaaaacaacaactggtgtggtatgtccac

SEQ ID NO: 18535 - DNA, 117 bp, Neocallimastix californiae
  Cellulose docking domain, dockering
ctgttgggccactgctcttggttacaagtgttgtcaatctacttctgttgtagttgaaactgatgctaatggtaagtggggtattgaaaataatgaatggtgtggtattgtcagtgg

SEQ ID NO: 18536 - DNA, 123 bp, Neocallimastix californiae
  Cellulose docking domain, dockering
ttcatctaaaattactgctcaaggttacagttgttgttctaaatattgtactattgtttacactgataatgatggtacttggggttatgaaaatggtgattggtgtggatgtggtgacaacac

SEQ ID NO: 18537 - DNA, 105 bp, Neocallimastix californiae
  Cellulose docking domain, dockering
taacaccggatataattgttgtcttttcactactaccgttgtaactacagattcggttggtgactggggtgttgaaaatgaagattggtgtctctttgaaaataa

SEQ ID NO: 18538 - DNA, 123 bp, Neocallimastix californiae
  Cellulose docking domain, dockering
atgttggtctcttaagtatgactataaatgttgtacattaagaactacagaaccaagctacttctccaagacagccaataactggtatggtattgaaaatggagaatggtgtggtattacgga

SEQ ID NO: 18539 - DNA, 93 bp, Neocallimastix californiae
  Cellulose docking domain, dockering
atatccatgttgtaaagaatgtaatgtttattacacggatactgaagattggggtattgaagatggagaatggtgttccattccatatacttg

SEQ ID NO: 18540 - DNA, 114 bp, Neocallimastix californiae
  Cellulose docking domain, dockering
tagtataactagatatggttataaatgttgttcttcatgctctaaagtttattacactgataaagatggtaaatggggtattgaaaatagagattggtgtggtataccaagtca

SEQ ID NO: 18541 - DNA, 117 bp, Neocallimastix californiae
  Cellulose docking domain, dockering
ttctaccgctattattaatcaaggatacaagtgttgttccgatggttgtacagtcatttacattgacagtgatggagattggggagcagaaaatggggaatggtgtggatgtggcca

SEQ ID NO: 18542 - DNA, 114 bp, Neocallimastix californiae
  Cellulose docking domain, dockering
ttttgcattatctgatggttatgaatgttgtttcgataatgaagttgtttatgaagatgaaactggtaaatggggtattaatgacaaaggtgaatggtgtggtgttgaacaacc

SEQ ID NO: 18543 - DNA, 126 bp, Neocallimastix californiae
  Cellulose docking domain, dockering
atgttgggctgaagctttaggttacaaatgttgtagtgatgatggtttccatccagttatttaccaagatgaaagtggtgattggagtgctgacaatggtgaatggtgtggtgttataaagagtac

SEQ ID NO: 18544 - DNA, 117 bp, Neocallimastix californiae
  Cellulose docking domain, dockering
atgttggtcaaaggctcaaggttatgattgttgtgctgaaggaacttccgttttccttgaagatgaaagtggaaaatggggtgttactccaaatggtttatggtgtggtattaagaa

SEQ ID NO: 18545 - DNA, 93 bp, Neocallimastix californiae
  Cellulose docking domain, dockering
ttgctgtaaaaattctaatttaaaagtatcttatgttgataataatggctattggggtattgagtctgaatcatggtgcaaaataaatttcca

SEQ ID NO: 18546 - DNA, 120 bp, Neocallimastix californiae
  Cellulose docking domain, dockering
atgttggtcagaatcattaggttataaatgctgtagccttgatatagagccgatttttacagataatgatggtatttggggtatggaaaacgaacaatggtgtggcataataaataaacc

SEQ ID NO: 18547 - DNA, 123 bp, Neocallimastix californiae
  Cellulose docking domain, dockering
ttgttggagtttagatattggctatggttgttgttccagtaataacactgatatattatataataatgaagatggatcatggggaattgaaaatggtcagtggtgtggtattgttaattctat

SEQ ID NO: 18548 - DNA, 114 bp, Neocallimastix californiae
  Cellulose docking domain, dockering
ttcctctaagattcttgctcaaggttacccatgctgttctgacaattgtactgttgtttatactgatgatgatggtacttggggtgttgaaaatggtcaatggtgtggctgtgg

SEQ ID NO: 18549 - DNA, 115 bp, Neocallimastix californiae
  Cellulose docking domain, dockering
tggtgcacaaggatacccatgctgtcaaaatacttgtactgtctactccactgatgctgatggtaaatggggtattgaaaataatgactggtgtttaattaataaatctaaatgt

SEQ ID NO: 18550 - DNA, 120 bp, Neocallimastix californiae
  Cellulose docking domain, dockering
ctgttggtcagcctctttaggttatccatgctgtaaatcttgcagtgtttactattctgataatgatggaaagtggggtattgaaaacgacaactggtgtggtatattaagtagttgtac

SEQ ID NO: 18551 - DNA, 117 bp, Neocallimastix californiae
  Cellulose docking domain, dockering
ttgttggtccactagattaggttacccatgttgtgaagatagtaatgttgtttacgctgttgatgaaaatggtatttggggttatgaaaataaacattggtgtggtattactaaggc

SEQ ID NO: 18552 - DNA, 120 bp, Neocallimastix californiae
  Cellulose docking domain, dockering
ttgttgggcttctgctttaggtttcaaatgttgtaagactacttcaactgttatatttgaagatcaagatggtagttggggtatagaagatgatttctggtgtggtattattgaagaaga

SEQ ID NO: 18553 - DNA, 117 bp, Neocallimastix californiae
  Cellulose docking domain, dockering
ttgtttttctattccactgggatatccttgttgtacttccacaaaagaagttattgatacaaatgaatatggtacttggggtatagaaaatggtgattggtgtggactaaaaaaagc

SEQ ID NO: 18554 - DNA, 120 bp, Neocallimastix californiae
  Cellulose docking domain, dockering
ttgcttttctagtgctctcggtattccctgttgttcttccaaaaatgcagaaatctattacagtgacattaaaggtaattggggtattgaaaatggagactggtgtggtatatcagcagc

SEQ ID NO: 18555 - DNA, 117 bp, Neocallimastix californiae
  Cellulose docking domain, dockering
atgcttttcaaaatctcttggtttcccgtgttgttcctccaaaaataaagatatttatttcactgatgaaaaaggtaattggggtattgaaaacggtgaatggtgtggtatatcagc

SEQ ID NO: 18556 - DNA, 117 bp, Neocallimastix californiae
  Cellulose docking domain, dockering
ctgtttttccgttgcactcggttttccatgttgttcatcaagtgctactgaagtgttcagagatagttatggtagttggggtgttgaatatggtgaatggtgtggtatgtccaaagc

SEQ ID NO: 18557 - DNA, 129 bp, Neocallimastix californiae
  Cellulose docking domain, dockering
atgttggtcgctttcacaaggttacccatgttgtaagaaagaaaccactgctataaactatactagtagtagtaccggtgcggaatggggtatagaaaatggtaattggtgtggtatcactgataaaca

SEQ ID NO: 18558 - DNA, 105 bp, Neocallimastix californiae
  Cellulose docking domain, dockering
aggtactggttatgcttgttgtatattcaagaatactatagttgaaactgttgatgagagtggccaatggggacatgaaggaaatgattggtgcctaatgaactt

SEQ ID NO: 18559 - DNA, 120 bp, Neocallimastix californiae
  Cellulose docking domain, dockering
ttgttgggctttagctgaaggttataattgttgtagtggttgttctgtttcttatgaagatgaaactggtaaatggggtattgaaaatggtcaatggtgtggtattgactcttcctgtga

SEQ ID NO: 18560 - DNA, 78 bp, Neocallimastix californiae
  Cellulose docking domain, dockering
ttctgtttcttatgaagatgaaactggtaaatggggtattgaaaatggtcaatggtgtggtattgactcttcctgtga

SEQ ID NO: 18561 - DNA, 123 bp, Neocallimastix californiae
  Cellulose docking domain, dockering
ttgctggtctaaaacttatggttacccatgttgttcctctgccagtactaaggttatgtacaccgataacgatggtgaatggggtgttgaaaacggtaactggtgtggtattgtaaaggatga

SEQ ID NO: 18562 - DNA, 117 bp, Neocallimastix californiae
  Cellulose docking domain, dockering
ctgtttctcttatactttaggttacccatgttgtactagtaccactaatgttatctacactgatagctacggtcgctggggtattgaaaagggtaattggtgttttcttggtgattc

SEQ ID NO: 18563 - DNA, 117 bp, Neocallimastix californiae
  Cellulose docking domain, dockering
ttggatcaaagattacttttcttgttgtgatgagggagctgaagttatttacgaagatcataatggtaaatggggtatccaaggggctaatgattggtgtttaatagttgaaaaaca

SEQ ID NO: 18564 - DNA, 120 bp, Neocallimastix californiae
  Cellulose docking domain, dockering
atgttggagtttagaacttggttatccatgttgtaaaacaacaaaagacgtagtttatactgataatagtggtgattggggtcttgaaaatggtgattggtgtggtatcgtagaaggtaa

SEQ ID NO: 18565 - DNA, 108 bp, Neocallimastix californiae
  Cellulose docking domain, dockering
tttagcatatgaagattgtaaatcatgttatattcattatgaagatagtgatggttactggggatacaatggtgatgaatggtgtataattaatgaagaatattgtaa

SEQ ID NO: 18566 - DNA, 126 bp, Neocallimastix californiae
  Cellulose docking domain, dockering
ttgttttgcagaagtattaggttataaatgttgtgaagaccaaaacggtccaagaacatcaatagatgcagatggtgaatggtatgaagataaatatggtaattggtgtggttatagtaatagtac

SEQ ID NO: 18567 - DNA, 111 bp, Neocallimastix californiae
  Cellulose docking domain, dockering
ttgttggtcagagaaatatggttatccatgttgtccaaaatctaaagtaattacagttgataagcatggaaaatggggtattgaaaatggtgattattgtggtgtatcacc

SEQ ID NO: 18568 - DNA, 120 bp, Neocallimastix californiae
  Cellulose docking domain, dockering
atgtttctcaattaaattaggttatccatgttgtaatacatgtaatgttagcaccactgaccaagacggttcatggggtattgaaaataatcaatggtgtggtattaaagattcttgtac

SEQ ID NO: 18569 - DNA, 93 bp, Neocallimastix californiae
  Cellulose docking domain, dockering
atacccatgttgtacttcaactaaaactgtaatgtatactgatgaaaagggaccatggggtattgaaaatggtaactggtgtggtattcaaaa

SEQ ID NO: 18570 - DNA, 120 bp, Neocallimastix californiae
  Cellulose docking domain, dockering
atgtttcgctacaaaattaaattacaaatgttgttcaggttgtgatgttgctttcgttgataacgatggtaaatggggctatgaaaataacaattggtgtggtttaaaggatacttgtga

SEQ ID NO: 18571 - DNA, 123 bp, Neocallimastix californiae
  Cellulose docking domain, dockering
atgttggtctactgcattaggttattcatgttgtaaatcatgtttagctgccgttttctctgataatgatggtaaatgggcagttgaagaggataattggtgtggtattccaaagagttgtga

SEQ ID NO: 18572 - DNA, 126 bp, Neocallimastix californiae
  Cellulose docking domain, dockering
ttgctgggctactaaacttggttttaactgttgtaagaacactagtgctgtttatgaaaccgatgctaatggccgttggggtattgaaaatggtaattggtgtggtattattgaaagttcttgctg

SEQ ID NO: 18573 - DNA, 123 bp, Neocallimastix californiae
  Cellulose docking domain, dockering
ttgctgggctactaagcttggttataagtgttgtactgctaaatgtccagaagtttcttacgttgaccaagatggtgcttggggtgttgaaaacggtaactggtgtggtattaccaagacatg

SEQ ID NO: 18574 - DNA, 108 bp, Neocallimastix californiae
  Cellulose docking domain, dockering
tattatggctcaaggttacccatgttgttccgctaactgtcaagttgtttacactgatgctgatggtgaatggggtgttgaaaatggtgactggtgtggttgtggtgg

SEQ ID NO: 18575 - DNA, 99 bp, Neocallimastix californiae
  Cellulose docking domain, dockering
ccaaggtttcccatgctgtgaatcctctaccattgtttactacactgatggtgatggtgactggagtgttgaaaataatgactggtgtatcattagaaa

SEQ ID NO: 18576 - DNA, 111 bp, Neocallimastix californiae
  Cellulose docking domain, dockering
ttgctggtctactagcttaggttatccatgttgttctggtaatgaagttgtttacactgataatgatggtaagtggggtgttgaaaatggtaattggtgtggtattgctga

SEQ ID NO: 18577 - DNA, 84 bp, Neocallimastix californiae
  Cellulose docking domain, dockering
ttgttctggtaacgaagttgtttacactgataatgatggtaagtggggtgttgaaaatggtaattggtgtggtattgctgatgc

SEQ ID NO: 18578 - DNA, 126 bp, Neocallimastix californiae
  Cellulose docking domain, dockering
ttcatcttctatcttaagccaaggatataaatgctgttcctctaaatgtactattgtttatgttgatgaagatggtacatggggtattgaaaatgatgaatggtgtggatgtaacgataataaatc

SEQ ID NO: 18579 - DNA, 129 bp, Neocallimastix californiae
  Cellulose docking domain, dockering
ttcatcctccattaccaatcaaggttattcttgctgtagtagcagtaattgtaatataatctatactgataaggatggtaaatggggtgtagaaaataatacctggtgtggtattacttcaaattgcaa

SEQ ID NO: 18580 - DNA, 120 bp, Neocallimastix californiae
  Cellulose docking domain, dockering
ttcagcttctattttaaaacaaggttattcttgctgctcatcaagatgtaccgttacatttactgacgaagatggagattggggtgttgaaaatggacaatggtgtggatgtggaaatag

SEQ ID NO: 18581 - DNA, 73 bp, Neocallimastix californiae; identical to SEQ ID NO: 16044
  Cellulose docking domain, dockering

SEQ ID NO: 18582 - DNA, 111 bp, Neocallimastix californiae
  Cellulose docking domain, dockering
caataatactggatatgattgctgtgctgattctaatgctagagttcaatacactgatgaaagtggtaactggagtattgaaaatggtaattggtgtcttatttgtccaga

SEQ ID NO: 18583 - DNA, 105 bp, Neocallimastix californiae
  Cellulose docking domain, dockering
tggttatgaatgctgcaaatcatgtaatatcgttttaacagatgaaagtggtaattggggtgttgaagacggtcaatggtgtggtattgacgaagataaatgtac

SEQ ID NO: 18584 - DNA, 117 bp, Neocallimastix californiae
  Cellulose docking domain, dockering
atgttgggctgctgaacaaggttatccatgttgtaccactactacagaagtagctttcgctgatgccagtggaaagtggggtattgaagatggaaactggtgtggtattattgaagc

SEQ ID NO: 18585 - DNA, 96 bp, Neocallimastix californiae
  Cellulose docking domain, dockering
cccatgttgtcaaggatgtgtcgtagtcacttctgatagtgatggtgattggggtgttgaagatggtcaatggtgtttaattaagaagacttgtaa

SEQ ID NO: 18586 - DNA, 129 bp, Neocallimastix californiae
  Cellulose docking domain, dockering
atgttggtcagaaacttatggatacaaatgctgttctaaaggatgtagttccaacgtcttaacaaatgatgaatatggttattggggtgctgaaaatggtgaatggtgtggtatcccagaaagctgtaa

SEQ ID NO: 18587 - DNA, 111 bp, Neocallimastix californiae
  Cellulose docking domain, dockering
ttcaaatcaaggctacagttgttgtaaagattgtactgttgtatacgaagatgaagctggtaaatggggtgtagaaaacgatcaatggtgtggaattgataccacatgtga

SEQ ID NO: 18588 - DNA, 120 bp, Neocallimastix californiae
  Cellulose docking domain, dockering
ttgttgggctgctgctgaaggatttaaatgctgtagtcccggcgtcaaatctattcttacagatagtaaaggttcatggggtattgaaaatgatgaatggtgtggtattgttgatcaaaa

SEQ ID NO: 18589 - DNA, 123 bp, Neocallimastix californiae
  Cellulose docking domain, dockering
atgttgggctactgctcaaggttatggatgttgtactggatgtgaagccatcatgactgatgataatagaaaatggggttttgaaaatggtaattggtgtggaattattgactcagtttgtaa

SEQ ID NO: 18590 - DNA, 99 bp, Neocallimastix californiae
  Cellulose docking domain, dockering
taagcaaggttatccatgctgtaagaacaccaaggatgtttactatagagatgccgatggtaattggggtatcgaaaataataactggtgttacatggc

SEQ ID NO: 18591 - DNA, 123 bp, Neocallimastix californiae
  Cellulose docking domain, dockering
ttctgctaagattgttcaacaaggttacaagtgttgttccagcagtaactgtgttgttcaatatgttgatagtgatggttactgggctgttgaaaataaccaatggtgtggatgtggaactga

SEQ ID NO: 18592 - DNA, 123 bp, Neocallimastix californiae
  Cellulose docking domain, dockering
ttctgctaacattttaaaacaaggttataaatgttgtccaagtggatgtgtcgttgtttttactgataatgatggtacttggggtgttaacaatggtgaatggtgtggatgtaatacagacga

SEQ ID NO: 18593 - DNA, 102 bp, Neocallimastix californiae
  Cellulose docking domain, dockering
ttatccatgttgtagtgaatgtactgttgtatacactgatgaatctggtgactggggtgttgaaaataatgaatggtgtttaattaagaaatctaaatgtgg

SEQ ID NO: 18594 - DNA, 114 bp, Neocallimastix californiae
  Cellulose docking domain, dockering
ttgtttcgcacttgatttaggttttaaatgttgtaatgatgccactgttgtttacactgatgattcaggtgactggggttacgttaataatgattggtgtggtattggtggatc

SEQ ID NO: 18595 - DNA, 117 bp, Neocallimastix californiae
  Cellulose docking domain, dockering
ttgttttgctattaaacttggttataaatgttgtaaaactactactgttaccatttatgaagataatgatggaccatggggtattgaaaatgatgaatggtgtggtcttaaaaaagc

SEQ ID NO: 18596 - DNA, 114 bp, Neocallimastix californiae; identical to SEQ ID NO: 16057
  Cellulose docking domain, dockering

SEQ ID NO: 18597 - DNA, 91 bp, Neocallimastix californiae; identical to SEQ ID NO: 16059
  Cellulose docking domain, dockering

SEQ ID NO: 18598 - DNA, 123 bp, Neocallimastix californiae
  Cellulose docking domain, dockering
atgtgtttctgaacttgttggtttcccatgttgtccagaaaataataaggctgtttacaaccgtgatgaatttggtgattggggttatgactttgctaaaggtacatggtgtggtcttactcc

SEQ ID NO: 18599 - DNA, 99 bp, Neocallimastix californiae
  Cellulose docking domain, dockering
acaatttccatgttgtaaaaacaatgtagtagtttacactgatggttctggtgattggggttttgaaaacaacaactggtgtggtattattaaaaaaca

SEQ ID NO: 18600 - DNA, 99 bp, Neocallimastix californiae
  Cellulose docking domain, dockering
agattacccatgttgtaaaggtaacactgttgtcttaactgatgtaaaaggtgattggggtgttgaaaacaacgcctggtgtggtattaataaaaaaac

SEQ ID NO: 18601 - DNA, 66 bp, Neocallimastix californiae
  Cellulose docking domain, dockering
ttatacagacgaagacggaaactggggtgttgagaatgatcaatggtgcggatgtgaagatactaa

SEQ ID NO: 18602 - DNA, 117 bp, Neocallimastix californiae
  Cellulose docking domain, dockering
cagtattttagaaaaaggctattcatgctgtcctaaagattgtaaagttttatatactgatgaagaagggacttggggaattaacaattataaatggtgtatttgtaattctaatga

SEQ ID NO: 18603 - DNA, 99 bp, Neocallimastix californiae
  Cellulose docking domain, dockering
atttaattatccatgttgttcccttggttatgataaaattgtttattctgataaatatgcttattggggttttgaaaatggtgattggtgtgttatgat

SEQ ID NO: 18604 - DNA, 123 bp, Neocallimastix californiae
  Cellulose docking domain, dockering
atgttggtcattacaatatggtattccatgttgtagttactattatcatggtgacattgaaactgatgaaagaggtaaatggggtattagaggaactgaaaaatgtggtatattaaaagatat

SEQ ID NO: 18605 - DNA, 117 bp, Neocallimastix californiae
  Cellulose docking domain, dockering
tacatgctgggctactaaattaggttacccatgttgtactactacttcacaatcattattcactgatgaaaacggtgaatggggtgttgaaaacaatgactggtgtggtattagtaa

SEQ ID NO: 18606 - DNA, 105 bp, Neocallimastix californiae
  Cellulose docking domain, dockering
tccaaatggttatccatactgtaaacaaactaatgaagtagttttcactgatactgttgaatggggtgtagaaaatggtgcttggtgtgttataaaatcaaaaga

SEQ ID NO: 18607 - DNA, 91 bp, Neocallimastix californiae; identical to SEQ ID NO: 16067
  Cellulose docking domain, dockering

SEQ ID NO: 18608 - DNA, 123 bp, Neocallimastix californiae
  Cellulose docking domain, dockering
atgttggtctaaggcattaggttatgaatgctgttctaaagacaataccagagttgttgttagcgatgattctggtaaatggggtgttgaaaatggacaatggtgtggtattaataaatccaa

SEQ ID NO: 18609 - DNA, 123 bp, Neocallimastix californiae
  Cellulose docking domain, dockering
ttgttggtccgaaagaaaaggtttcccatgttgttcttccaaagatactaaagttgattatgaagattcagatggtaaatggggtcatgaaaataatcaatggtgtggtataagaactgaaga

SEQ ID NO: 18610 - DNA, 114 bp, Neocallimastix californiae
  Cellulose docking domain, dockering
ctgtttctcaatagatttaggttatccatgttgtaaaaaaacccaaaaagttgaatcaaaagatagtgatggtacctggggttatgaaaatggtggatggtgtggtttagaagg

SEQ ID NO: 18611 - DNA, 90 bp, Neocallimastix californiae
  Cellulose docking domain, dockering
tcaaggatatccatgctgtgcctactcttgtgattcacttttcactgatagtgatggagaatggagtgttgaaaacgaaaattggtgttt

SEQ ID NO: 18612 - DNA, 123 bp, Neocallimastix californiae
  Cellulose docking domain, dockering
ctgttggtcaaaggcttccggttttaactgttgtaagaactgtggtaaggtttacttcattgataaagatggtgaatggggtattgaaaacaatgactggtgtggtatgccaaagacttgtaa

SEQ ID NO: 18613 - DNA, 123 bp, Neocallimastix californiae
  Cellulose docking domain, dockering
ttggtcccttcaatacggttatgactgttgtaagaagaaggagacggaaccttactactattctcaatccataaagaaatggtatggagtggaagatggcgaatggtgtggtattgaggaccg

SEQ ID NO: 18614 - DNA, 105 bp, Neocallimastix californiae
  Cellulose docking domain, dockering
tactggctatgactgctgtcaatacacgaccattccaacctataccgataagcagggttactgggccatggaggatgaggaatggtgtatcattgatcaagataa

SEQ ID NO: 18615 - DNA, 108 bp, Neocallimastix californiae
  Cellulose docking domain, dockering
aggggctaactacaagtgttgtaccaccacctgtgaagtctactactctgatgaatctggcgattggggggttgaggataatgattggtgttccatgccttatacttg

SEQ ID NO: 18616 - DNA, 96 bp, Neocallimastix californiae
  Cellulose docking domain, dockering
tttcccatgttgtaccggaaaggatatagtttattctgatggtagtggtgattggggttttgaaaatggcagttggtgtggtattgttccagatag

SEQ ID NO: 18617 - DNA, 102 bp, Neocallimastix californiae
  Cellulose docking domain, dockering
atatccatgctgtactgacagtaatactccagtaatggaagaagatacacttggaaaatggggtattgaaaatggtagctggtgtggtattaaagctgataa

SEQ ID NO: 18618 - DNA, 108 bp, Neocallimastix californiae
  Cellulose docking domain, dockering
aggttccggctattcctgttgtatatttgatacaacccctgtggtttccaaggataataccggctattggggtgttgaaaatggtcaatggtgtctctttgaaaatga

SEQ ID NO: 18619 - DNA, 132 bp, Neocallimastix californiae
  Cellulose docking domain, dockering
atgttggtctgaagcacaagactatccatgttgtaaggaaccgaccaccagtgttgtgagtaaagatagtaaaggctacttatggggtgttgaaaataatgaatggtgtggtattaccggtactcaatgtcc

SEQ ID NO: 18620 - DNA, 102 bp, Neocallimastix californiae
  Cellulose docking domain, dockering
agattacccatgttgtaaaagttgtgttgaagtttatgaagatgatttaggtaaatggggtattgaaaatgatgtatggtgtggtattaaagatagttgtaa

SEQ ID NO: 18621 - DNA, 90 bp, Neocallimastix californiae
  Cellulose docking domain, dockering
ttgtgaaggttgtaaagtaattcaagaagataaagatggtaaatggggttatgaaaataatgaatggtgtggtattaaagatagttgtac

SEQ ID NO: 18622 - DNA, 102 bp, Neocallimastix californiae
  Cellulose docking domain, dockering
aggaagagaatataaatgttgtaaatcatgtgatattatttatacagacacctcagattggggagttgaagatgatgactggtgttctattccatatacatg

SEQ ID NO: 18623 - DNA, 123 bp, Neocallimastix californiae
  Cellulose docking domain, dockering
ttgctggtctcaagatcttggctatccatgttgccaaagcacagtcgatgttagatacaccgataaagatggattatggggtgtagaaaatggaaattggtgtggtattattaatagccaagc

SEQ ID NO: 18624 - DNA, 106 bp, Neocallimastix californiae; identical to SEQ ID NO: 16083
  Cellulose docking domain, dockering

SEQ ID NO: 18625 - DNA, 123 bp, Neocallimastix californiae
  Cellulose docking domain, dockering
ttgttgggctcaaggtttaggttatccatgttgtgaaggttgtgaagcctcatttactgatggtgatggtgattgggctattgaaaatggtaactggtgtggtattgatccaaagaaatgtaa

SEQ ID NO: 18626 - DNA, 120 bp, Neocallimastix californiae
  Cellulose docking domain, dockering
ttgttggtcagaattattaggttttccatgttgtgttggaactgttacagttgaatatactgatgaagatggtgaatggggtttacaaaatggtgattggtgtggtattccaaaagaaat

SEQ ID NO: 18627 - DNA, 120 bp, Neocallimastix californiae
  Cellulose docking domain, dockering
atgttggtctcaatcccaaggatttccatgttgtagtccagacacaccagtcttttctacagatgaaagtggaaaatggggtattgaaaatgatgactggtgtggtattattgaagatga

SEQ ID NO: 18628 - DNA, 117 bp, Neocallimastix californiae
  Cellulose docking domain, dockering
atgctggtctactgcattaggttacccatgttgtaaaaactctagtattgtttatttcactgataatgatggtaaatggagtgttgaagataatgaatggtgtggtatttcatccgg

SEQ ID NO: 18629 - DNA, 79 bp, Neocallimastix californiae
  Cellulose docking domain, dockering
atgctggtctactgcattaggttacccatgttgtaaaaactctagtattgtttatttcactgataatgatggtaaatgg

SEQ ID NO: 18630 - DNA, 126 bp, Neocallimastix californiae
  Cellulose docking domain, dockering
atgttggtctgaacagttaggttatccatgttgtaattcaggaaataaagaagtagtatttgaagatgaaaatggtaattggggaatcagccctaaaaccaatgattggtgtggtattcgttcaga

SEQ ID NO: 18631 - DNA, 99 bp, Neocallimastix californiae
  Cellulose docking domain, dockering
ttttaaatgctgttcttcaagtgatgccaaggtagaatatacagataatgatggtaaatggtctatagaagatggtaattggtgtggtattttaaaaaa

SEQ ID NO: 18632 - DNA, 123 bp, Neocallimastix californiae
  Cellulose docking domain, dockering
atgttgggctttggaattaggatttgagtgttgtacttcagaagatattgaagttcaatacactgacaaagatggaaaatggggaattgaaaattatgaatggtgtggtattattgaaaaaga

SEQ ID NO: 18633 - DNA, 123 bp, Neocallimastix californiae
  Cellulose docking domain, dockering
tgctagtactattaaagatcaaggttattcttgttgtaaaacttgtacagtatcatatactgatgaaagtggtgaatggggtattgaaaacaaccattggtgtggtatttctaaatcatgtaa

SEQ ID NO: 18634 - DNA, 54 bp, Neocallimastix californiae
  Cellulose docking domain, dockering
taatgatggtgattggggttttgaaaatgacaactggtgtggtttaaatgatta

SEQ ID NO: 18635 - DNA, 105 bp, Neocallimastix californiae
  Cellulose docking domain, dockering
acagtactcttgctgtaagagtacctgtactccttccttatccgataatactggtgattgggctgttgaaaatggtgcctggtgttccattccatacacctgtga

SEQ ID NO: 18636 - DNA, 105 bp, Neocallimastix californiae
  Cellulose docking domain, dockering
tggttatggatgttgtaagggttgtaaggtaagagctactgatagtactggtgaatggggttatgaaaatggtaaatggtgtggtattgataccgaatactgtgc

SEQ ID NO: 18637 - DNA, 120 bp, Neocallimastix californiae
  Cellulose docking domain, dockering
ttgctggtcaaatgcattaggatatgaatgttgtaaaggatgtactgtaattgaatcggatgcaagtggtgattggggtattgaaaataatcaatggtgtggtattccatcttcatgtaa

SEQ ID NO: 18638 - DNA, 120 bp, Neocallimastix californiae
  Cellulose docking domain, dockering
ttgttggtctaaaagtttaggatatgattgttgtaaagaatgtaatacagtttatactgatggtgatggtgattggggtttcgaaaataatcaatggtgtggaatttcagattcttgtaa

SEQ ID NO: 18639 - DNA, 93 bp, Neocallimastix californiae
  Cellulose docking domain, dockering
atgttgttcaaagtgtaatgttgtatacaccgatgatgagggtgattggggtttcgaaaaaggagcatggtgttctattagagaaaattgtaa

SEQ ID NO: 18640 - DNA, 120 bp, Neocallimastix californiae
  Cellulose docking domain, dockering
ttgttgggctgaacaatatggatatgattgttgtaagcattgtaacgttacttatactgatgaaactggtgattggggtaaagaagatgatgcttggtgtggtattttaaatacatgtaa

SEQ ID NO: 18641 - DNA, 129 bp, Neocallimastix californiae
  Cellulose docking domain, dockering
atgttgggctaatgcctatggttatgactgctgtgttgatggtactcttacatacttagaagatgaaactggaaaatggggtgttacctctgactaccaatggtgtggtctcttaaagagtgaatgttg

SEQ ID NO: 18642 - DNA, 129 bp, Neocallimastix californiae; identical to SEQ ID NO: 18641
  Cellulose docking domain, dockering

SEQ ID NO: 18643 - DNA, 93 bp, Neocallimastix californiae
  Cellulose docking domain, dockering
atgttgggctaatgcctatggttatgactgctgtgttgatggtactcttacatacttagaagatgaaactggaaaatggggtgttacctctga

SEQ ID NO: 18644 - DNA, 114 bp, Neocallimastix californiae
  Cellulose docking domain, dockering
atgttggtctgctaaatttggttacaaatgttgtgattcatcaactgaaatttcatttgaagatgaaaagggaaaatggggtattgatggatcttcttggtgtggtatagtttc

SEQ ID NO: 18645 - DNA, 120 bp, Neocallimastix californiae
  Cellulose docking domain, dockering
atgtttctctgctaaattaggttactcatgttgtactactggaattgcttcagttaaaaatgatgaaaatggctattggggtattgaaaatgatgaatggtgtggtgttgcaagtaatga

SEQ ID NO: 18646 - DNA, 120 bp, Neocallimastix californiae
  Cellulose docking domain, dockering
cagtgctaagattactagtcagggttatccatgctgttcctctagctgtactgttgtctacactgatgaatctggtgactggggtgttgaaaacaatcaatggtgtggttgtggtaaggt

SEQ ID NO: 18647 - DNA, 99 bp, Neocallimastix californiae; identical to SEQ ID NO: 16291
  Cellulose docking domain, dockering

SEQ ID NO: 18648 - DNA, 123 bp, Neocallimastix californiae
  Cellulose docking domain, dockering
ttgctggtcaagtggctatggttattcctgttgtaaaacatgtaagatttactatacagatgatatcggtgaatggggtattgaaaatggacaatggtgtggtattgttgatagtagatgtgg

SEQ ID NO: 18649 - DNA, 99 bp, Neocallimastix californiae
  Cellulose docking domain, dockering
attttatccatgctgtgaaaaaaatacagtagtatttactgataaacaagggaaatggggtattgaaaatggctcttggtgtggtataggtaaaagtat

SEQ ID NO: 18650 - DNA, 120 bp, Neocallimastix californiae
  Cellulose docking domain, dockering
ctggtccgttagccttggttataaatgttgtaccctaagaacaacaaagccatattattattctaaatctgttgataaatggtacggtgtcgaaaataatgaatggtgtggtattattga

SEQ ID NO: 18651 - DNA, 96 bp, Neocallimastix californiae
  Cellulose docking domain, dockering
atataaatgttgtaagggttgtgaagtcgtatacacggattctgaagattggggtattgaagatggtaaatggtgttctatccctcattcttgtag

SEQ ID NO: 18652 - DNA, 60 bp, Neocallimastix californiae
  Cellulose docking domain, dockering
tactgataacgatggagaatggggtataaacaatggagaatggtgcggatgtggtggtag

SEQ ID NO: 18653 - DNA, 76 bp, Neocallimastix californiae; identical to SEQ ID NO: 16112
  Cellulose docking domain, dockering

SEQ ID NO: 18654 - DNA, 105 bp, Neocallimastix californiae
  Cellulose docking domain, dockering
taccagttactcttgttgtgttttaactacaacggttgtcaccaccgatggtactggtaaatggggtattgaaggaaatcaatggtgtcttatgaaggaagacaa

SEQ ID NO: 18655 - DNA, 99 bp, Neocallimastix californiae
  Cellulose docking domain, dockering
ataccactgttgtaatgaatgtaatgttgtattagaagatgaagaaggtaaatggggttttgaaaacaataaatggtgtggtctcaaagattcttgtac

SEQ ID NO: 18656 - DNA, 105 bp, Neocallimastix californiae
  Cellulose docking domain, dockering
ttacagtaactgtacccatacttgtaacgttatagttactgaagatggcgttgaatggggagctgaaaaccaagattggtgtattattgacccatctatttgtga

SEQ ID NO: 18657 - DNA, 120 bp, Neocallimastix californiae
  Cellulose docking domain, dockering
ttgttgggcagaaaaattaggttatccttgttgttcttcttctaaagatgtattatttgaagatagtgatggacaatggagtgttgaaaacgataattggtgtggtattcctaaatcatc

SEQ ID NO: 18658 - DNA, 79 bp, Neocallimastix californiae
  Cellulose docking domain, dockering
ctcagccaaaattattgctcaaggttatgaatgctgtccaagtgactgtgaaactatttatacagatgatgatggtgac

SEQ ID NO: 18659 - DNA, 99 bp, Neocallimastix californiae
  Cellulose docking domain, dockering
tccatattgtaatggatgtgaatccaattatactgatggagatggtgattggtatttcgttgataataattggtgtaaggttaatgaaaagaaatgtca

SEQ ID NO: 18660 - DNA, 102 bp, Neocallimastix californiae
  Cellulose docking domain, dockering
tgaatgttgtaataataatgaagttgtatatactgatgaaactggagattggggtttaactgatactgtacctcctcaatggtgtagtattggtaagaagga

SEQ ID NO: 18661 - DNA, 99 bp, Neocallimastix californiae
  Cellulose docking domain, dockering
tggatatcaatgttgtaagaattcctctactgtagctgtttattcagataaggatggtgaatggggtgttgaaaataatgattggtgtattattccatc

SEQ ID NO: 18662 - DNA, 123 bp, Neocallimastix californiae
  Cellulose docking domain, dockering
ttgttggtctgttggtttaggttattcttgttgtaaatcatgtatagctgccgtctatacagataatgatggtaaatggggagttgaaaatgataaatggtgtggtattccaacaagttgtga

SEQ ID NO: 18663 - DNA, 112 bp, Neocallimastix californiae
  Cellulose docking domain, dockering
tgctgccggttatccatgttgtaaatcaagttgtaccgtttatgctgaagattctgacggtaaatggagtattgaaaatgataattggtgtttaattgaccaatccaaatgt

SEQ ID NO: 18664 - DNA, 117 bp, Neocallimastix californiae
  Cellulose docking domain, dockering
tcccgctgctattcgtaaccaaggttacaaatgttgtaaggctggttgtcaagttatttacaaagattctgatggtgattggggtgttgaaaacaaccaatggtgtggttgtggtgg

SEQ ID NO: 18665 - DNA, 79 bp, Neocallimastix californiae
  Cellulose docking domain, dockering
tgaaaagtttactaaacaaggttacaaatgttgtagtagctgtagctttgtctactacactgatgaatcaggtgactgg

SEQ ID NO: 18666 - DNA, 120 bp, Neocallimastix californiae
  Cellulose docking domain, dockering
ttgttgggcatacaaattaggttatcaatgttgtttaggagacaatgttaaaagtatatacaatgatgtagatggtgattggaattatcttaatggaagatggtgtggtattatggttga

SEQ ID NO: 18667 - DNA, 106 bp, Neocallimastix californiae; identical to SEQ ID NO: 16127
  Cellulose docking domain, dockering

SEQ ID NO: 18668 - DNA, 60 bp, Neocallimastix californiae; identical to SEQ ID NO: 16128
  Cellulose docking domain, dockering

SEQ ID NO: 18669 - DNA, 102 bp, Neocallimastix californiae
  Cellulose docking domain, dockering
attgggttataattgttgtaagtacagaagtactcctgtttatgaaaaggataatgatggtttatggggtattgaagataacgattggtgtggtgtcaccga

SEQ ID NO: 18670 - DNA, 102 bp, Neocallimastix californiae
  Cellulose docking domain, dockering
ccaaggttatgaatgctgtccaagtgattgtgaagtcatttatacagataatgatggtgactggggtgttaacaacaatcaatggtgtggttgtggtaacag

SEQ ID NO: 18671 - DNA, 114 bp, Neocallimastix californiae
  Cellulose docking domain, dockering
ttcatctaatattaaagcccaaggttataaatgttgctctgctaattgtattgtttattacactgatgctgatggtgattggggtattgaaaatgatgaatggtgtggatgtgg

SEQ ID NO: 18672 - DNA, 108 bp, Neocallimastix californiae
  Cellulose docking domain, dockering
ttatggttataaatgttgtaagggtgaaaatgtaattcctattgtcactgaatctgtaggtcaatggggtatagaaaatgatgattggtgtggtattgtttcaaaaac

SEQ ID NO: 18673 - DNA, 123 bp, Neocallimastix californiae
  Cellulose docking domain, dockering
atgttggtctgaagtagttggttattcatgctgtagttctaatgaaactacggtttatgctcatgatgataacggtgattggggttatgactttaataaacaagaatggtgtggtcttactcc

SEQ ID NO: 18674 - DNA, 96 bp, Neocallimastix californiae
  Cellulose docking domain, dockering
taattgttgtacaaaatgtgattatcgtttggaagatgaatatggtcaatggggttttgaaaatggtaaatggtgttcggtaaccttcgaatgttc

SEQ ID NO: 18675 - DNA, 102 bp, Neocallimastix californiae
  Cellulose docking domain, dockering
atatccatgttgttctaatgtcacaataactctaattaaggatatgtatggaaataaatggggtatggaaaataaaaattattgtggtattttatatgaagt

SEQ ID NO: 18676 - DNA, 96 bp, Neocallimastix californiae
  Cellulose docking domain, dockering
tgaatgttgtcaaggttgtgaagtttttgaagaaactgaagaaggtaaatggggtgctgaaaatggtgaatggtgtggtattaaaaattcctgttt

SEQ ID NO: 18677 - DNA, 111 bp, Neocallimastix californiae
  Cellulose docking domain, dockering
atgtggagctgctgctatcggttacccatgttgtgaaaatacctgtactgaagtctacactgatgaatacagatggggtgttgaagatgatgaatggtgtggtattgatga

SEQ ID NO: 18678 - DNA, 109 bp, Neocallimastix californiae; identical to SEQ ID NO: 15442
  Cellulose docking domain, dockering

SEQ ID NO: 18679 - DNA, 88 bp, Neocallimastix californiae; identical to SEQ ID NO: 16139
  Cellulose docking domain, dockering

SEQ ID NO: 18680 - DNA, 103 bp, Neocallimastix californiae; identical to SEQ ID NO: 16140
  Cellulose docking domain, dockering

SEQ ID NO: 18681 - DNA, 96 bp, Neocallimastix californiae
  Cellulose docking domain, dockering
atatccttgctgtcaggaatgcaatgttttatacacggatactgaagattggggtatcgaaaatggtagctggtgttctattccatatacctgtaa

SEQ ID NO: 18682 - DNA, 109 bp, Neocallimastix californiae; identical to SEQ ID NO: 16142
  Cellulose docking domain, dockering

SEQ ID NO: 18683 - DNA, 79 bp, Neocallimastix californiae; identical to SEQ ID NO: 16143
  Cellulose docking domain, dockering

SEQ ID NO: 18684 - DNA, 117 bp, Neocallimastix californiae
  Cellulose docking domain, dockering
ttgttggtcacaacctctcggatatccatgttgttcttctccaaatgctgaagtttattacactgataacgatggtaagtggagtgtcgaaaacaacgattggtgtggtattccagt

SEQ ID NO: 18685 - DNA, 114 bp, Neocallimastix californiae; identical to SEQ ID NO: 15140
  Cellulose docking domain, dockering

SEQ ID NO: 18686 - DNA, 117 bp, Neocallimastix californiae; identical to SEQ ID NO: 17704
  Cellulose docking domain, dockering

SEQ ID NO: 18687 - DNA, 120 bp, Neocallimastix californiae; identical to SEQ ID NO: 17690
  Cellulose docking domain, dockering

SEQ ID NO: 18688 - DNA, 120 bp, Neocallimastix californiae; identical to SEQ ID NO: 17690
  Cellulose docking domain, dockering

SEQ ID NO: 18689 - DNA, 120 bp, Neocallimastix californiae; identical to SEQ ID NO: 17690
  Cellulose docking domain, dockering

SEQ ID NO: 18690 - DNA, 97 bp, Neocallimastix californiae; identical to SEQ ID NO: 16150
  Cellulose docking domain, dockering

SEQ ID NO: 18691 - DNA, 88 bp, Neocallimastix californiae; identical to SEQ ID NO: 16139
  Cellulose docking domain, dockering

SEQ ID NO: 18692 - DNA, 100 bp, Neocallimastix californiae
  Cellulose docking domain, dockering
ttgttggtcacttgatcatggttataaatgttgtaaaggtgaaaatgttgaagttgaatatactgattctaaaggtcaatggggtaaagaaaatggtgaa

SEQ ID NO: 18693 - DNA, 109 bp, Neocallimastix californiae; identical to SEQ ID NO: 15442
  Cellulose docking domain, dockering

SEQ ID NO: 18694 - DNA, 102 bp, Neocallimastix californiae
  Cellulose docking domain, dockering
ccaaggttatccatgttgtaagactgcaactgaagttttctacactgataatgatggtaactggggtgttgaaaatggacaatggtgtggttgtggtgtgag

SEQ ID NO: 18695 - DNA, 117 bp, Neocallimastix californiae; identical to SEQ ID NO: 18684
  Cellulose docking domain, dockering

SEQ ID NO: 18696 - DNA, 120 bp, Neocallimastix californiae; identical to SEQ ID NO: 17690
  Cellulose docking domain, dockering

SEQ ID NO: 18697 - DNA, 114 bp, Neocallimastix californiae; identical to SEQ ID NO: 15140
  Cellulose docking domain, dockering

SEQ ID NO: 18698 - DNA, 120 bp, Neocallimastix californiae; identical to SEQ ID NO: 17690
  Cellulose docking domain, dockering

SEQ ID NO: 18699 - DNA, 82 bp, Neocallimastix californiae; identical to SEQ ID NO: 15255
  Cellulose docking domain, dockering

SEQ ID NO: 18700 - DNA, 112 bp, Neocallimastix californiae; identical to SEQ ID NO: 16160
  Cellulose docking domain, dockering

SEQ ID NO: 18701 - DNA, 103 bp, Neocallimastix californiae; identical to SEQ ID NO: 16140
  Cellulose docking domain, dockering

SEQ ID NO: 18702 - DNA, 120 bp, Neocallimastix californiae; identical to SEQ ID NO: 17690
  Cellulose docking domain, dockering

SEQ ID NO: 18703 - DNA, 120 bp, Neocallimastix californiae; identical to SEQ ID NO: 17690
  Cellulose docking domain, dockering

SEQ ID NO: 18704 - DNA, 88 bp, Neocallimastix californiae; identical to SEQ ID NO: 16139
  Cellulose docking domain, dockering

SEQ ID NO: 18705 - DNA, 94 bp, Neocallimastix californiae; identical to SEQ ID NO: 16165
  Cellulose docking domain, dockering

SEQ ID NO: 18706 - DNA, 120 bp, Neocallimastix californiae; identical to SEQ ID NO: 17690
  Cellulose docking domain, dockering

SEQ ID NO: 18707 - DNA, 126 bp, Anaeromyces robustus; identical to SEQ ID NO: 18289
  Cellulose docking domain, dockering

SEQ ID NO: 18708 - DNA, 123 bp, Anaeromyces robustus; identical to SEQ ID NO: 18290
  Cellulose docking domain, dockering

SEQ ID NO: 18709 - DNA, 120 bp, Anaeromyces robustus; identical to SEQ ID NO: 18291
  Cellulose docking domain, dockering

SEQ ID NO: 18710 - DNA, 117 bp, Anaeromyces robustus; identical to SEQ ID NO: 18387
  Cellulose docking domain, dockering

SEQ ID NO: 18711 - DNA, 123 bp, Anaeromyces robustus
  Cellulose docking domain, dockering
ttgctggtctgaaaaattaggtttcccatgttgttcatctccaagtgctccagttcaatacactgatgctgatggtaaatggagtgttgaaaatggtgactggtgtggtattccaaagtctgg

SEQ ID NO: 18712 - DNA, 117 bp, Anaeromyces robustus
  Cellulose docking domain, dockering
ctgtttctctgttaaattaggatacccatgttgttctagtgccaatgttccagttgcttacactgataatgatggtaactggggtattgaaaatggtgattggtgtggtattccaga

SEQ ID NO: 18713 - DNA, 120 bp, Anaeromyces robustus; identical to SEQ ID NO: 18400
  Cellulose docking domain, dockering

SEQ ID NO: 18714 - DNA, 105 bp, Anaeromyces robustus; identical to SEQ ID NO: 18401
  Cellulose docking domain, dockering

SEQ ID NO: 18715 - DNA, 120 bp, Anaeromyces robustus; identical to SEQ ID NO: 18399
  Cellulose docking domain, dockering

SEQ ID NO: 18716 - DNA, 117 bp, Anaeromyces robustus; identical to SEQ ID NO: 18413
  Cellulose docking domain, dockering

SEQ ID NO: 18717 - DNA, 123 bp, Anaeromyces robustus; identical to SEQ ID NO: 18414
  Cellulose docking domain, dockering

SEQ ID NO: 18718 - DNA, 79 bp, Anaeromyces robustus
  Cellulose docking domain, dockering
ttcttcaaagattactgctcaaggttataagtgctgttctgatccaaattgtactgtttactacactgatgccgatggt

SEQ ID NO: 18719 - DNA, 123 bp, Anaeromyces robustus; identical to SEQ ID NO: 18445
  Cellulose docking domain, dockering

SEQ ID NO: 18720 - DNA, 117 bp, Anaeromyces robustus; identical to SEQ ID NO: 18444
  Cellulose docking domain, dockering

SEQ ID NO: 18721 - DNA, 117 bp, Anaeromyces robustus; identical to SEQ ID NO: 18460
  Cellulose docking domain, dockering

SEQ ID NO: 18722 - DNA, 108 bp, Anaeromyces robustus; identical to SEQ ID NO: 18459
  Cellulose docking domain, dockering

SEQ ID NO: 18723 - DNA, 129 bp, Anaeromyces robustus; identical to SEQ ID NO: 18461
  Cellulose docking domain, dockering

SEQ ID NO: 18724 - DNA, 102 bp, Anaeromyces robustus; identical to SEQ ID NO: 18463
  Cellulose docking domain, dockering

SEQ ID NO: 18725 - DNA, 96 bp, Anaeromyces robustus; identical to SEQ ID NO: 18462
  Cellulose docking domain, dockering

SEQ ID NO: 18726 - DNA, 126 bp, Anaeromyces robustus; identical to SEQ ID NO: 18447
  Cellulose docking domain, dockering

SEQ ID NO: 18727 - DNA, 118 bp, Anaeromyces robustus; identical to SEQ ID NO: 18446
  Cellulose docking domain, dockering

SEQ ID NO: 18728 - DNA, 120 bp, Anaeromyces robustus; identical to SEQ ID NO: 18424
  Cellulose docking domain, dockering

SEQ ID NO: 18729 - DNA, 126 bp, Anaeromyces robustus; identical to SEQ ID NO: 18472
  Cellulose docking domain, dockering

SEQ ID NO: 18730 - DNA, 105 bp, Anaeromyces robustus; identical to SEQ ID NO: 18473
  Cellulose docking domain, dockering

SEQ ID NO: 18731 - DNA, 120 bp, Anaeromyces robustus; identical to SEQ ID NO: 18376
  Cellulose docking domain, dockering

SEQ ID NO: 18732 - DNA, 114 bp, Anaeromyces robustus; identical to SEQ ID NO: 18377
  Cellulose docking domain, dockering

SEQ ID NO: 18733 - DNA, 114 bp, Anaeromyces robustus; identical to SEQ ID NO: 18377
  Cellulose docking domain, dockering

SEQ ID NO: 18734 - DNA, 120 bp, Anaeromyces robustus; identical to SEQ ID NO: 18376
  Cellulose docking domain, dockering

SEQ ID NO: 18735 - DNA, 105 bp, Anaeromyces robustus; identical to SEQ ID NO: 18489
  Cellulose docking domain, dockering

SEQ ID NO: 18736 - DNA, 117 bp, Anaeromyces robustus; identical to SEQ ID NO: 18488
  Cellulose docking domain, dockering

SEQ ID NO: 18737 - DNA, 93 bp, Anaeromyces robustus; identical to SEQ ID NO: 18492
  Cellulose docking domain, dockering

SEQ ID NO: 18738 - DNA, 99 bp, Anaeromyces robustus; identical to SEQ ID NO: 18493
  Cellulose docking domain, dockering

SEQ ID NO: 18739 - DNA, 112 bp, Anaeromyces robustus
  Cellulose docking domain, dockering
tgctttaggttatccatgttgtaaatctacatgtaatgtttactcatctgatgaaagtggtcaatggggtattgaagataacaactggtgtttaattgatgcctctaaatgt

SEQ ID NO: 18740 - DNA, 123 bp, Anaeromyces robustus; identical to SEQ ID NO: 18490
  Cellulose docking domain, dockering

SEQ ID NO: 18741 - DNA, 111 bp, Anaeromyces robustus
  Cellulose docking domain, dockering
tgctttaggttatccatgttgtaaatctacatgtaatgtttactcatctgatgaaagtggtcaatggggtatagaaaatgatgcctggtgtggtattccaaaagaatgttc

SEQ ID NO: 18742 - DNA, 111 bp, Anaeromyces robustus
  Cellulose docking domain, dockering
tgctttaggttattcatgttgtaaatcatgtgatagtttcaattacaaagataatgatggtgaatggggtatagaaaatgatgcctggtgtggtattccaaaagaatgttc

SEQ ID NO: 18743 - DNA, 102 bp, Anaeromyces robustus
  Cellulose docking domain, dockering
ttattcatgttgtaaatcatgtgatagtttcaattacaaagataatgatggtgaatggggtatagaaaatgatgcctggtgtggtattccaaaagaatgttc

SEQ ID NO: 18744 - DNA, 123 bp, Anaeromyces robustus; identical to SEQ ID NO: 18478
  Cellulose docking domain, dockering

SEQ ID NO: 18745 - DNA, 117 bp, Anaeromyces robustus; identical to SEQ ID NO: 18479
  Cellulose docking domain, dockering

SEQ ID NO: 18746 - DNA, 120 bp, Anaeromyces robustus; identical to SEQ ID NO: 18502
  Cellulose docking domain, dockering

SEQ ID NO: 18747 - DNA, 111 bp, Anaeromyces robustus; identical to SEQ ID NO: 18501
  Cellulose docking domain, dockering

SEQ ID NO: 18748 - DNA, 117 bp, Anaeromyces robustus; identical to SEQ ID NO: 18534
  Cellulose docking domain, dockering

SEQ ID NO: 18749 - DNA, 117 bp, Anaeromyces robustus; identical to SEQ ID NO: 18535
  Cellulose docking domain, dockering

SEQ ID NO: 18750 - DNA, 108 bp, Anaeromyces robustus; identical to SEQ ID NO: 18512
  Cellulose docking domain, dockering

SEQ ID NO: 18751 - DNA, 102 bp, Anaeromyces robustus; identical to SEQ ID NO: 18513
  Cellulose docking domain, dockering

SEQ ID NO: 18752 - DNA, 117 bp, Anaeromyces robustus; identical to SEQ ID NO: 18551
  Cellulose docking domain, dockering

SEQ ID NO: 18753 - DNA, 105 bp, Anaeromyces robustus; identical to SEQ ID NO: 16214
  Cellulose docking domain, dockering

SEQ ID NO: 18754 - DNA, 120 bp, Anaeromyces robustus; identical to SEQ ID NO: 18552
  Cellulose docking domain, dockering

SEQ ID NO: 18755 - DNA, 93 bp, Anaeromyces robustus; identical to SEQ ID NO: 18515
  Cellulose docking domain, dockering

SEQ ID NO: 18756 - DNA, 123 bp, Anaeromyces robustus; identical to SEQ ID NO: 18514
  Cellulose docking domain, dockering

SEQ ID NO: 18757 - DNA, 99 bp, Anaeromyces robustus; identical to SEQ ID NO: 18503
  Cellulose docking domain, dockering

SEQ ID NO: 18758 - DNA, 117 bp, Anaeromyces robustus; identical to SEQ ID NO: 18504
  Cellulose docking domain, dockering

SEQ ID NO: 18759 - DNA, 120 bp, Anaeromyces robustus; identical to SEQ ID NO: 18517
  Cellulose docking domain, dockering

SEQ ID NO: 18760 - DNA, 120 bp, Anaeromyces robustus; identical to SEQ ID NO: 18518
  Cellulose docking domain, dockering

SEQ ID NO: 18761 - DNA, 109 bp, Anaeromyces robustus; identical to SEQ ID NO: 16223
  Cellulose docking domain, dockering

SEQ ID NO: 18762 - DNA, 114 bp, Anaeromyces robustus; identical to SEQ ID NO: 18542
  Cellulose docking domain, dockering

SEQ ID NO: 18763 - DNA, 126 bp, Anaeromyces robustus; identical to SEQ ID NO: 18543
  Cellulose docking domain, dockering

SEQ ID NO: 18764 - DNA, 108 bp, Anaeromyces robustus; identical to SEQ ID NO: 18565
  Cellulose docking domain, dockering

SEQ ID NO: 18765 - DNA, 117 bp, Anaeromyces robustus; identical to SEQ ID NO: 18563
  Cellulose docking domain, dockering

SEQ ID NO: 18766 - DNA, 120 bp, Anaeromyces robustus; identical to SEQ ID NO: 18564
  Cellulose docking domain, dockering

SEQ ID NO: 18767 - DNA, 117 bp, Anaeromyces robustus; identical to SEQ ID NO: 18563
  Cellulose docking domain, dockering

SEQ ID NO: 18768 - DNA, 108 bp, Anaeromyces robustus; identical to SEQ ID NO: 18574
  Cellulose docking domain, dockering

SEQ ID NO: 18769 - DNA, 99 bp, Anaeromyces robustus; identical to SEQ ID NO: 18575
  Cellulose docking domain, dockering

SEQ ID NO: 18770 - DNA, 93 bp, Anaeromyces robustus; identical to SEQ ID NO: 18569
  Cellulose docking domain, dockering

SEQ ID NO: 18771 - DNA, 120 bp, Anaeromyces robustus; identical to SEQ ID NO: 18570
  Cellulose docking domain, dockering

SEQ ID NO: 18772 - DNA, 120 bp, Anaeromyces robustus; identical to SEQ ID NO: 18568
  Cellulose docking domain, dockering

SEQ ID NO: 18773 - DNA, 120 bp, Anaeromyces robustus; identical to SEQ ID NO: 18637
  Cellulose docking domain, dockering

SEQ ID NO: 18774 - DNA, 120 bp, Anaeromyces robustus; identical to SEQ ID NO: 18638
  Cellulose docking domain, dockering

SEQ ID NO: 18775 - DNA, 99 bp, Anaeromyces robustus; identical to SEQ ID NO: 18600
  Cellulose docking domain, dockering

SEQ ID NO: 18776 - DNA, 99 bp, Anaeromyces robustus; identical to SEQ ID NO: 18599
  Cellulose docking domain, dockering

SEQ ID NO: 18777 - DNA, 120 bp, Anaeromyces robustus
  Cellulose docking domain, dockering
ctgctggtcatctgcaatgggatatgcctgttgtaatggctgtgatgtagcatatgaagatggatctggaaaatggggtattgaaaataataattggtgtggtatagatgataaatgttt

SEQ ID NO: 18778 - DNA, 105 bp, Anaeromyces robustus; identical to SEQ ID NO: 18583
  Cellulose docking domain, dockering

SEQ ID NO: 18779 - DNA, 96 bp, Anaeromyces robustus; identical to SEQ ID NO: 18585
  Cellulose docking domain, dockering

SEQ ID NO: 18780 - DNA, 117 bp, Anaeromyces robustus; identical to SEQ ID NO: 18584
  Cellulose docking domain, dockering

SEQ ID NO: 18781 - DNA, 108 bp, Anaeromyces robustus
  Cellulose docking domain, dockering
taatactggatatgattgctgtgctgattctaatgctagagttcaatacactgatgaaagtggtaactggagtattgaaaatggtaattggtgtcttatttgtccaga

SEQ ID NO: 18782 - DNA, 111 bp, Anaeromyces robustus
  Cellulose docking domain, dockering
atgtttcagtatttcacttggttacccatgctgtcaaggaaacacagttgtatataccgataaggatggcaaatggggattagaaaatggtcaatggtgtggtattgctga

SEQ ID NO: 18783 - DNA, 99 bp, Anaeromyces robustus
  Cellulose docking domain, dockering
aactaagaatggttatcctgtttgtaaaacaactactactgttgtctacaccgactctgataagtggggtgttgaaaatggtgaatggtgtattatgtg

SEQ ID NO: 18784 - DNA, 123 bp, Anaeromyces robustus; identical to SEQ ID NO: 18598
  Cellulose docking domain, dockering

SEQ ID NO: 18785 - DNA, 117 bp, Anaeromyces robustus
  Cellulose docking domain, dockering
ttgctggtcagaatctttcggttacccatgctgtcacagttgttacgtttttgaaactgatgacaatggtaagtggggttttgaaaacaacacctggtgtggtattcaatcttactg

SEQ ID NO: 18786 - DNA, 123 bp, Anaeromyces robustus; identical to SEQ ID NO: 18519
  Cellulose docking domain, dockering

SEQ ID NO: 18787 - DNA, 114 bp, Anaeromyces robustus; identical to SEQ ID NO: 18520
  Cellulose docking domain, dockering

SEQ ID NO: 18788 - DNA, 123 bp, Anaeromyces robustus; identical to SEQ ID NO: 18591
  Cellulose docking domain, dockering

SEQ ID NO: 18789 - DNA, 99 bp, Anaeromyces robustus; identical to SEQ ID NO: 18590
  Cellulose docking domain, dockering

SEQ ID NO: 18790 - DNA, 129 bp, Anaeromyces robustus
  Cellulose docking domain, dockering
ctgttgggctaaatctcttggttacaactgttgttctacaagtagttgtagaactgctcaattcagcgatgctgatggtcaatgggatgttgaaaatggtaattggtgtggtattactacctccaatgt

SEQ ID NO: 18791 - DNA, 117 bp, Anaeromyces robustus
  Cellulose docking domain, dockering
ttgttggtctaaatctttaggttacccatgttgtacctcaaaatctactgttatattcactgattctaacggtcaatggggtattgaaaatggtaactggtgtggtaaaccaaacag

SEQ ID NO: 18792 - DNA, 102 bp, Anaeromyces robustus; identical to SEQ ID NO: 18617
  Cellulose docking domain, dockering

SEQ ID NO: 18793 - DNA, 96 bp, Anaeromyces robustus; identical to SEQ ID NO: 18616
  Cellulose docking domain, dockering

SEQ ID NO: 18794 - DNA, 120 bp, Anaeromyces robustus
  Cellulose docking domain, dockering
ttgtttttctgaagcctctggatatggctgttgtaaaggatgtgatgtagcttatactgatgatagtggtgattggggtgttgaaaatggtgaatggtgtggtattccagatagttgtaa

SEQ ID NO: 18795 - DNA, 117 bp, Anaeromyces robustus
  Cellulose docking domain, dockering
ttcctctaagattcttgctcaaggttacccatgctgttctgacaattgtactgttgtttatactgatgatgatggtacttggggtgttgaaaatggtcaatggtgtggctgtggcgg

SEQ ID NO: 18796 - DNA, 99 bp, Anaeromyces robustus
  Cellulose docking domain, dockering
tgcccaaggttacccatgttgtaaaactgctacccaagtttacttcagtgataatgatggtgactggagtgttgaaaacaataactggtgtttaattcc

SEQ ID NO: 18797 - DNA, 123 bp, Anaeromyces robustus; identical to SEQ ID NO: 18608
  Cellulose docking domain, dockering

SEQ ID NO: 18798 - DNA, 120 bp, Anaeromyces robustus
  Cellulose docking domain, dockering
atgttggtctcttgaatacggttacaaatgttgttcacactgtaaagttcttctcaaggatgactatggtaaatggggagaaatgaatggtcaatggtgtggtattgatccagccaaatg

SEQ ID NO: 18799 - DNA, 108 bp, Anaeromyces robustus
  Cellulose docking domain, dockering
tccagattatgaatgttgtaaaggatgtcaaacaattttaaccgatgatgaaggtaattggggtgctgaaaataatcaatggtgtttcattgatgaaaataaatgtag

SEQ ID NO: 18800 - DNA, 120 bp, Anaeromyces robustus; identical to SEQ ID NO: 18516
  Cellulose docking domain, dockering

SEQ ID NO: 18801 - DNA, 120 bp, Anaeromyces robustus; identical to SEQ ID NO: 18588
  Cellulose docking domain, dockering

SEQ ID NO: 18802 - DNA, 123 bp, Anaeromyces robustus; identical to SEQ ID NO: 18589
  Cellulose docking domain, dockering

SEQ ID NO: 18803 - DNA, 111 bp, Anaeromyces robustus; identical to SEQ ID NO: 18587
  Cellulose docking domain, dockering

SEQ ID NO: 18804 - DNA, 102 bp, Anaeromyces robustus; identical to SEQ ID NO: 18620
  Cellulose docking domain, dockering

SEQ ID NO: 18805 - DNA, 105 bp, Anaeromyces robustus
  Cellulose docking domain, dockering
cccagattatccatgttgtgaaggttgtaaagtaattcaagaagataaagatggtaaatggggttatgaaaataatgaatggtgtggtattaaagatagttgtac

SEQ ID NO: 18806 - DNA, 102 bp, Anaeromyces robustus
  Cellulose docking domain, dockering
agctttcagtgactgtagtacttgtagagtagtaacagttgatgataatatttattggggtgtagaaaacaatgactggtgcattgttccctcaacttgttc

SEQ ID NO: 18807 - DNA, 108 bp, Anaeromyces robustus
  Cellulose docking domain, dockering
cccagattatccatgttgtaataattgtgaagtaatttacgttgattcagatggagaatggggtgtagaaaataataattggtgtgctattgatgcaagtcaatgtta

SEQ ID NO: 18808 - DNA, 102 bp, Anaeromyces robustus
  Cellulose docking domain, dockering
ttatccattctgtaagggttgtacagtagtatatactgataatgatggtgattggggtgtagaaaataatgattggtgtcttattaagaaatctaattgtga

SEQ ID NO: 18809 - DNA, 123 bp, Anaeromyces robustus; identical to SEQ ID NO: 18592
  Cellulose docking domain, dockering

SEQ ID NO: 18810 - DNA, 126 bp, Anaeromyces robustus
  Cellulose docking domain, dockering
ttcatcatcaattagatcacttggttattcatgttgtagtgataataactgtactgtttatgccaccgatgaatctggtaaatggggtattgaaaatgaccaatggtgtggtatttctaacaaatg

SEQ ID NO: 18811 - DNA, 114 bp, Anaeromyces robustus
  Cellulose docking domain, dockering
aagaaagaatcttggatacaaatgttgtcaatattgtgatatagtatatactgatagtgatggtgattatggtttcgaaaataatgactggtgtggtattgctgattcatgtta

SEQ ID NO: 18812 - DNA, 102 bp, Anaeromyces robustus
  Cellulose docking domain, dockering
tccaaatggttatccatactgtaaacaaactaatgaagtagttttcactgatactgttgaatggggtgtagaaaatggtgcttggtgtgttataaaatcaaa

SEQ ID NO: 18813 - DNA, 117 bp, Anaeromyces robustus; identical to SEQ ID NO: 18605
  Cellulose docking domain, dockering

SEQ ID NO: 18814 - DNA, 117 bp, Anaeromyces robustus; identical to SEQ ID NO: 18595
  Cellulose docking domain, dockering

SEQ ID NO: 18815 - DNA, 114 bp, Anaeromyces robustus; identical to SEQ ID NO: 16057
  Cellulose docking domain, dockering

SEQ ID NO: 18816 - DNA, 126 bp, Anaeromyces robustus
  Cellulose docking domain, dockering
ttccgctaagattcaagctcaaggttacaaatgctgttctgacaagaattgtactatcttctactccgataatgatggtaattggggtgttgaaaatggacaatggtgtggttgtgaaaacagcaa

SEQ ID NO: 18817 - DNA, 96 bp, Anaeromyces robustus
  Cellulose docking domain, dockering
tgttggttacccatgctgtaaaactaacaagcaagtttacttcactgataatgatggtaactggagtttcgaaaacaacaactggtgtttaatcaa

SEQ ID NO: 18818 - DNA, 111 bp, Anaeromyces robustus
  Cellulose docking domain, dockering
attacttggttacaactgttgtagaaacacttgtagtatttcatacaaagatgatgatggtaattggggtattgaaaacggtaattggtgtggtattccattcacttgtta

SEQ ID NO: 18819 - DNA, 102 bp, Anaeromyces robustus
  Cellulose docking domain, dockering
agattaccaatgttgtagaaatactagagtaagtcaatacactgactcagctggtaatgaatggggtatcgaaaacaatcaatggtgtggtattattccaca

SEQ ID NO: 18820 - DNA, 123 bp, Anaeromyces robustus; identical to SEQ ID NO: 18625
  Cellulose docking domain, dockering

SEQ ID NO: 18821 - DNA, 120 bp, Anaeromyces robustus
  Cellulose docking domain, dockering
ttgtttctccattgacatgggttacccatgttgttcaacttgtactgtagtctacactgatagtgatggaggttggggtgttgaaaatggtgaatggtgtggtgtcccatcttcctgttt

SEQ ID NO: 18822 - DNA, 123 bp, Anaeromyces robustus; identical to SEQ ID NO: 18662
  Cellulose docking domain, dockering

SEQ ID NO: 18823 - DNA, 112 bp, Anaeromyces robustus; identical to SEQ ID NO: 18663
  Cellulose docking domain, dockering

SEQ ID NO: 18824 - DNA, 99 bp, Anaeromyces robustus; identical to SEQ ID NO: 18603
  Cellulose docking domain, dockering

SEQ ID NO: 18825 - DNA, 120 bp, Anaeromyces robustus
  Cellulose docking domain, dockering
ttgttggtcacaaccattaggatatccatgttgttctagtagtaataaaaatgtcatttacaccgataaagatggtgactggggtattgaaaataatggttggtgtggttttttaaagga

SEQ ID NO: 18826 - DNA, 123 bp, Anaeromyces robustus; identical to SEQ ID NO: 18604
  Cellulose docking domain, dockering

SEQ ID NO: 18827 - DNA, 123 bp, Anaeromyces robustus
  Cellulose docking domain, dockering
atgttggtcggaaaaattaggttatccatgttgtaaaaacagtaatactgatgttgcttatatcgatgcagacggtaaatggggtgttgaaaatcatgaatggtgtggtattacaaaggaaac

SEQ ID NO: 18828 - DNA, 123 bp, Anaeromyces robustus
  Cellulose docking domain, dockering
aacttctattacttctcaaggttatagatgttgtaaagaaaataactgttcagttattgaaactgatgactctggtaaatggggtattgaagatggacaatggtgtggtatttctaacaagtg

SEQ ID NO: 18829 - DNA, 111 bp, Anaeromyces robustus
  Cellulose docking domain, dockering
tatattaaagaaaggatataaatgttgttcaaatgattgtttcgtaatctatactgatgatgatggtacatggggtattgaaaatgatcaatggtgtggttgtgatactcc

SEQ ID NO: 18830 - DNA, 120 bp, Anaeromyces robustus; identical to SEQ ID NO: 18657
  Cellulose docking domain, dockering

SEQ ID NO: 18831 - DNA, 117 bp, Anaeromyces robustus
  Cellulose docking domain, dockering
atgttggtcagaaaaattaggttatccatgttgttcatattctaaaaatgtattatttgaagataatgatggtcaatggagtgttgaaaatgataattggtgtggtattccaaaagg

SEQ ID NO: 18832 - DNA, 99 bp, Anaeromyces robustus; identical to SEQ ID NO: 16291
  Cellulose docking domain, dockering

SEQ ID NO: 18833 - DNA, 120 bp, Anaeromyces robustus; identical to SEQ ID NO: 18646
  Cellulose docking domain, dockering

SEQ ID NO: 18834 - DNA, 94 bp, Anaeromyces robustus
  Cellulose docking domain, dockering
tgtaggttacccatgttgtaagaataataagactgtttatttcactgataattctggtaaatggagtgttgaaaataacaactggtgtttaatt

SEQ ID NO: 18835 - DNA, 126 bp, Anaeromyces robustus
  Cellulose docking domain, dockering
ttcttctaagattactaaacaaggttacaaatgttgttcatcaaagagctgtattgtttattacactgataatgccggtaattggggtgttgaaaatggagaatggtgtggatgtgctaatgaacc

SEQ ID NO: 18836 - DNA, 123 bp, Anaeromyces robustus
  Cellulose docking domain, dockering
atgttggtctgaatcaaagggttactcatgttgtaaaggatgtgatatctacaccaatgatagatttggtgcttggggtattgaaaagggaaaatggtgtggtattaagccacaaaagtgtca

SEQ ID NO: 18837 - DNA, 123 bp, Anaeromyces robustus
  Cellulose docking domain, dockering
ctgttgggctagttggtatggttatgaatgttgtaaaggttgtaaagtcaaaggtgaagatagtaaaggtaaatggggttgggaaaatggtaaatggtgtggtattgatgaagattattgtaa

SEQ ID NO: 18838 - DNA, 123 bp, Anaeromyces robustus
  Cellulose docking domain, dockering
atgttggtctagcggttatggttacccatgttgtgataactgtaaggtttattacattgataaaattggagaatggggtattaagaatggtaattggtgtggtattgttgaccgtaaatgtag

SEQ ID NO: 18839 - DNA, 105 bp, Anaeromyces robustus
  Cellulose docking domain, dockering
tggatatccatgttgtaaaaagtgtgatgtttacagttacgatagacatggttactggggtattgaaaagggaaactggtgtggtattgatactattaagtgtca

SEQ ID NO: 18840 - DNA, 123 bp, Anaeromyces robustus
  Cellulose docking domain, dockering
atgttgggctagttggtatggttatggatgttgtaagggttgtaaggtaagagctactgatagtactggtgaatggggttatgaaaatggtaaatggtgtggtattgataccgaatactgtgc

SEQ ID NO: 18841 - DNA, 123 bp, Anaeromyces robustus
  Cellulose docking domain, dockering
ttgttggtctgaagaattaggatacaagtgttgtaagggttgtaaggtatacagtgttgatcgtaacggttcatggggtgttgaagataaacaatggtgtggtattgattctgaagtttgtgg

SEQ ID NO: 18842 - DNA, 114 bp, Anaeromyces robustus
  Cellulose docking domain, dockering
taaatctacttcctacccatgttgttcaagctgtaatttaccagtttattctaccgatagtgatggtaaatggagtattgaaaacaataactggtgtaactttaataccaattg

SEQ ID NO: 18843 - DNA, 111 bp, Anaeromyces robustus
  Cellulose docking domain, dockering
ttgtttcgctattaagttaggttataagtgttgtaataatgaagccgttgttcttgttgataatgatggtaaatggggttacaatggtgattggtgtggtattggtggttc

SEQ ID NO: 18844 - DNA, 96 bp, Anaeromyces robustus
  Cellulose docking domain, dockering
atgctgtagtcactgtaatggtatttaccatgataacgatggtgactggggtgttgaaaataaccaatggtgtttaattaagagtagtaaatgtaa

SEQ ID NO: 18845 - DNA, 123 bp, Anaeromyces robustus
  Cellulose docking domain, dockering
atgctggtcagaagaacttggctacaaatgctgtaaatattgtaatgtcttaatggaagatgaaaatggacaatggggttttgaaaatgatgaatggtgtggtataactgaatctgcttgcaa

SEQ ID NO: 18846 - DNA, 105 bp, Anaeromyces robustus
  Cellulose docking domain, dockering
accaacatacccatgttgttcaaagtgtaatgttgtatacaccgatgatgagggtgattggggtttcgaaaaaggagcatggtgttctattagagaaaattgtaa

SEQ ID NO: 18847 - DNA, 120 bp, Anaeromyces robustus; identical to SEQ ID NO: 18640
  Cellulose docking domain, dockering

SEQ ID NO: 18848 - DNA, 120 bp, Anaeromyces robustus
  Cellulose docking domain, dockering
ctgttggtcaaaggcttccggttttaactgttgtaagaactgtggtaaggtttacttcattgataaagatggtgaatggggtattgaaaacaatgactggtgtggtatgccaaagacttg

SEQ ID NO: 18849 - DNA, 109 bp, Anaeromyces robustus
  Cellulose docking domain, dockering
tcaaggatatccatgctgtgcctactcttgtgattcacttttcactgatagtgatggagaatggagtgttgaaaacgaaaattggtgtttaattaataagagtatttgt

SEQ ID NO: 18850 - DNA, 111 bp, Anaeromyces robustus
  Cellulose docking domain, dockering
ttgctggtctattgcttttggttatggatgttgtgaaggatgtactactgtttacactgataaagatggtgcttggggatatgaaaatgaaaattggtgtggtattaattg

SEQ ID NO: 18851 - DNA, 102 bp, Anaeromyces robustus
  Cellulose docking domain, dockering
tcaatacagtaattgtaaaagtacttgcgaagtctcttatgaagatgaccaaaaatggggtattgaaaatggacaatggtgtattcttccagaatcatgttt

SEQ ID NO: 18852 - DNA, 120 bp, Anaeromyces robustus
  Cellulose docking domain, dockering
ctgctggtctgaagctttaggttatccatgttgtaaaggttgtgaaagtgcaaccactgattcatctggtgcttggggtattgaagatggtgaatggtgtggtattccatccacctgtaa

SEQ ID NO: 18853 - DNA, 99 bp, Anaeromyces robustus
  Cellulose docking domain, dockering
ctatccatgctgttctaagggtgctgaagttatttacactgatgaatcaggtgattggggattagaaaatggtgactggtgctttattaaggaagatgg

SEQ ID NO: 18854 - DNA, 120 bp, Anaeromyces robustus
  Cellulose docking domain, dockering
ttgttggtctgctccttatggttatccatgctgtaagtcatgcgaaattcataccactaatgattccggaaaatggggtatggaaaataataaatggtgtggtattcctgattcttgcga

SEQ ID NO: 18855 - DNA, 117 bp, Anaeromyces robustus
  Cellulose docking domain, dockering
ttgtactggtattgaggatggttatccatgttgtaagacatgtaatgctatttacaatgatgaacaaggaccatggggttatgaaaataatgaatggtgtggtatcaagacttcttg

SEQ ID NO: 18856 - DNA, 123 bp, Anaeromyces robustus
  Cellulose docking domain, dockering
atgctgggcttcttctcttggttacggttgttgtaatggttgtgaagctattactgttgatggtagtggtaaatggggtttcgaaaatggagcctggtgtggtattattgactccaaatgtaa

SEQ ID NO: 18857 - DNA, 108 bp, Anaeromyces robustus
  Cellulose docking domain, dockering
aaaggatggttatccatgctgtaaaggttgttcagtaacttacgaagatgccagtggtaaatggggtgtcgaaaataatgcttggtgtggtattgacagttcatgtaa

SEQ ID NO: 18858 - DNA, 117 bp, Anaeromyces robustus
  Cellulose docking domain, dockering
ttgctggtctactgctgaaggttacccatgctgtaccccaggtactgcagttacacttactgatagtaagggtaaatggggtattgaaaacggaagctggtgtggtattaccgaaac

SEQ ID NO: 18859 - DNA, 79 bp, Anaeromyces robustus; identical to SEQ ID NO: 16319
  Cellulose docking domain, dockering

SEQ ID NO: 18860 - DNA, 108 bp, Anaeromyces robustus; identical to SEQ ID NO: 18857
  Cellulose docking domain, dockering

SEQ ID NO: 18861 - DNA, 117 bp, Anaeromyces robustus
  Cellulose docking domain, dockering
ttgctggtcaactaaattaggatatccatgttgtagtgccggtaacaaagatgtttattataatgacgatgatggattatggggtgttgaaaatggtgattggtgtggcattccaaa

SEQ ID NO: 18862 - DNA, 123 bp, Anaeromyces robustus
  Cellulose docking domain, dockering
ttgtttctccattgctcttggctatccatgctgtaaaggaaatacaattgtttacactgatgatagcggagactggggtgttgaaaataataactggtgtggtattccttctaattcttgctg

SEQ ID NO: 18863 - DNA, 99 bp, Anaeromyces robustus; identical to SEQ ID NO: 18661
  Cellulose docking domain, dockering

SEQ ID NO: 18864 - DNA, 120 bp, Anaeromyces robustus
  Cellulose docking domain, dockering
tccaggttatgaattaggatatgaatgttgtaataataatgaagttgtatatactgatgaaactggagattggggtttaactgatactgtacctcctcaatggtgtagtattggtaagaa

SEQ ID NO: 18865 - DNA, 99 bp, Anaeromyces robustus; identical to SEQ ID NO: 18659
  Cellulose docking domain, dockering

SEQ ID NO: 18866 - DNA, 99 bp, Anaeromyces robustus
  Cellulose docking domain, dockering
cgcatatgacgaatgtaaaggttgtactgtgtattatgaggatgatacaaaatggggtgttgaaaatgacgactggtgtattattccatcatcatgtga

SEQ ID NO: 18867 - DNA, 96 bp, Anaeromyces robustus
  Cellulose docking domain, dockering
tccatgttgtgaaggatgtaatgtttatgaagaaaccgaagaaggtaaatggggtattgaaaatgatgcttggtgtggtgttaaagattcatgttt

SEQ ID NO: 18868 - DNA, 117 bp, Anaeromyces robustus
  Cellulose docking domain, dockering
atgttggtctgaaagattaggttacccatgttgtaccagtggtgctcaagtttattacagtgatgctgatggtcaatggggtgttgaaaacaataactggtgtggtattattactgg

SEQ ID NO: 18869 - DNA, 117 bp, Anaeromyces robustus
  Cellulose docking domain, dockering
ttgtttcgccaccaaattaggttacccatgttgtactactactactgaagttgtttacactgatagtgatggtcaatggggtgttgaaaacaataactggtgtggtattaatactgc

SEQ ID NO: 18870 - DNA, 90 bp, Anaeromyces robustus
  Cellulose docking domain, dockering
ttacccatgttgttcttcatctgttggagtttccttcgttgatgaaagtggttcatggggtattgaaaatggtaattggtgtggtattcc

SEQ ID NO: 18871 - DNA, 120 bp, Anaeromyces robustus
  Cellulose docking domain, dockering
atgtttcgctgctaaacttaattacaagtgctgttctacttgtgatgtagcttatactgatggtgatggtgattggggtttcgaaaataatgaatggtgtggtattaaagattcttgtaa

SEQ ID NO: 18872 - DNA, 123 bp, Anaeromyces robustus
  Cellulose docking domain, dockering
ttgtttctcaattcaaatgggatatccatgttgtaatggttgtgatgttgtatcctttgatgatggtaaaccatggggtattgaaaacggaaattggtgtggtattaaagaaaatgtatgtct

SEQ ID NO: 18873 - DNA, 99 bp, Anaeromyces robustus
  Cellulose docking domain, dockering
gttaaatccatcctacccatgttgtgaaggtgatgtcgttgtctatgtcgataaagatggtgaatggggtgtagaaaatggaaattggtgtggtattgg

SEQ ID NO: 18874 - DNA, 123 bp, Anaeromyces robustus
  Cellulose docking domain, dockering
ttgtttttctgttgctcttggctatccatgttgtgaatcatcttgtaacgtatattacacagataatgatggtgaatggggtgtagaaaatggaaattggtgtggtttaaaggacagttgtaa

SEQ ID NO: 18875 - DNA, 99 bp, Anaeromyces robustus
  Cellulose docking domain, dockering
agattacccatgttgtgaaggcactgatgttgtatacagtgatgcttctggtgattggggtgttgaaaatggtcaatggtgtggtattgttgaaactaa

SEQ ID NO: 18876 - DNA, 99 bp, Anaeromyces robustus
  Cellulose docking domain, dockering
agattacccatgttgtaaagaaggggccgaagctatctatgaagatgctcaaggaaaatggggtgtagaaaatggtcaatggtgtggaattgaaccaga

SEQ ID NO: 18877 - DNA, 117 bp, Anaeromyces robustus
  Cellulose docking domain, dockering
atgctgggctttgcaatatggatatacatgttgtgaagatgatacaatagtatacactgatgaactcggtgattggggtgttgaagatggtcaatggtgtggtattaaaaaggaaga

SEQ ID NO: 18878 - DNA, 123 bp, Anaeromyces robustus
  Cellulose docking domain, dockering
ctgctggtcgactgctcttaattatccatgttgtaaaaatagttgtgacgttgttatttcagatgacgatggtgattggggtgttgaagatggtcaatggtgtggtataactaaaaattgtgg

SEQ ID NO: 18879 - DNA, 117 bp, Anaeromyces robustus
  Cellulose docking domain, dockering
atgtgctgttctttctcaaggttacccatgttgtcaacaaacttgtgatgtcgtctatgtagatgactacaaatggggtgttgaaaatggtgaatggtgtggtattaaggattcctg

SEQ ID NO: 18880 - DNA, 102 bp, Anaeromyces robustus
  Cellulose docking domain, dockering
agattacaagtgctgttcaggatgtgacattgtctacactgataaccacaactggggtgttgaaaatggtgaatggtgtggtattgatgacaaacaatgtgg

SEQ ID NO: 18881 - DNA, 135 bp, Anaeromyces robustus
  Cellulose docking domain, dockering
ttgttgggctaaagcattaggatttaaatgttgtgatgaagaaaatccacaagtttattatacagatgaaagtggtgattggagtgttgaatttaaaggagattcaggtgaatggtgtggtattattaaatcaaa

SEQ ID NO: 18882 - DNA, 114 bp, Anaeromyces robustus
  Cellulose docking domain, dockering
ttgttgggcaaatagacttggttaccaatgttgtaaaggtaatactgtagtatacactgatagtgatggaaaatggggtgttgaaaatggtaattggtgtggtatcgtagatgg

SEQ ID NO: 18883 - DNA, 117 bp, Anaeromyces robustus
  Cellulose docking domain, dockering
ttgttggtctcaacctcttggttacccatgttgtcaaagtacaagtgatgttatttacactgatagtgatggtgactggggtgttgaaaatggtaattggtgtggtataattaaagg

SEQ ID NO: 18884 - DNA, 123 bp, Anaeromyces robustus
  Cellulose docking domain, dockering
ttgttggtctaaaagtattggttacgaatgttgtaaagaaactactactgctatttataatgatgaaaatggtaaatggggatatgaaaacggagattggtgtggtattgtagaagaatgtag

SEQ ID NO: 18885 - DNA, 99 bp, Anaeromyces robustus
  Cellulose docking domain, dockering
atatccatgctgtaaaggttgtgatatttcttacagtgatgaaagtggtgattggggtgttgaaaatggcaaatggtgtggtattaaagcttcctgtaa

SEQ ID NO: 18886 - DNA, 108 bp, Anaeromyces robustus
  Cellulose docking domain, dockering
tgaaccagattatccatgctgtaattcatgtaatattgttgaaaccgatgctcttggaagatggggtgttgaaaatggtgaatggtgtggaattccagattcttgctc

SEQ ID NO: 18887 - DNA, 48 bp, Anaeromyces robustus
  Cellulose docking domain, dockering
cggtgactggggtgttgaaaacggtaactggtgtggtattccagttcc

SEQ ID NO: 18888 - DNA, 100 bp, Anaeromyces robustus; identical to SEQ ID NO: 16346
  Cellulose docking domain, dockering
  modified_base (70)..(70): a, c, t, g, unknown or other

SEQ ID NO: 18889 - DNA, 114 bp, Anaeromyces robustus
  Cellulose docking domain, dockering
ttgtttttcagagagacttggctatccatgttgtgtatatactactaaagttgaatacgttgatgccgatggtgactggggtgttgaaaacggtaattggtgtggaatgccaga

SEQ ID NO: 18890 - DNA, 120 bp, Anaeromyces robustus
  Cellulose docking domain, dockering
atgtttctctgttagtttaggttacccatgttgtcaaaagactactaaagttgttgtcgttgatgaagatggtgaatggggagctgaagatggtaattggtgtggtcttaaagctaaccc

SEQ ID NO: 18891 - DNA, 114 bp, Anaeromyces robustus
  Cellulose docking domain, dockering
atgtttctctattaaattaggttacccatgttgtcaaaatacttctgatgttattcttactgatgaagatggtaaatggggagctgaaaacggtgactggtgtggtattaacaa

SEQ ID NO: 18892 - DNA, 120 bp, Anaeromyces robustus
  Cellulose docking domain, dockering
atgctgggcagaaaaacttggttatggatgttgtaaaactacaaccactcctattttagaagatgatgatggcaaatggggtgttgaaaatgacgaatggtgtggtattatggaacaaaa

SEQ ID NO: 18893 - DNA, 120 bp, Anaeromyces robustus
  Cellulose docking domain, dockering
atgctgggctgaaaaattaggatataaatgctgtgaaaaatgtacagtaacttttaatgatgaaaatggagattggggttttgaaaatggagattggtgtggtattttaagaacatgtac

SEQ ID NO: 18894 - DNA, 105 bp, Anaeromyces robustus
  Cellulose docking domain, dockering
ccctaattacccatgttgttctgaatgtaaaactatatatactgaccaaactggtgactggggatatgaaaatgaacaatggtgtggtattaaagattcctgtaa

SEQ ID NO: 18895 - DNA, 81 bp, Anaeromyces robustus
  Cellulose docking domain, dockering
agaaaaggatatgggttatccttgttgtgataattgtgaagttgtcactacagacagcgatggtggttgggggtatcaaag

SEQ ID NO: 18896 - DNA, 123 bp, Anaeromyces robustus
  Cellulose docking domain, dockering
atgctgggctgaagctttaggatattcatgctgtaaaggttgtgatattatctacagtgataatgatggtgattggagtgttgaaaatgatgaatggtgtggtattattagcaaaaaatgtaa

SEQ ID NO: 18897 - DNA, 120 bp, Anaeromyces robustus
  Cellulose docking domain, dockering
atgttggtctgaagcaagtggttattcatgttgtaaattaaaaacaacaactgttgaatttactgatagtaaaggtaacaaatatggtattgaaaatggtcatttttgtggtatcaatga

SEQ ID NO: 18898 - DNA, 99 bp, Anaeromyces robustus
  Cellulose docking domain, dockering
tgaatataaatgttgtaaaaagtgtaatgttgtatacagagatgattatgattggggtgtagaaaacaatgattggtgttctattccacattcctgtta

SEQ ID NO: 18899 - DNA, 117 bp, Anaeromyces robustus; identical to SEQ ID NO: 18664
  Cellulose docking domain, dockering

SEQ ID NO: 18900 - DNA, 123 bp, Anaeromyces robustus; identical to SEQ ID NO: 18633
  Cellulose docking domain, dockering

SEQ ID NO: 18901 - DNA, 117 bp, Anaeromyces robustus
  Cellulose docking domain, dockering
ttcagctagtattaaaaatcaaggtttttcatgttgtgaaggatgtacaaaatattatagtgataatgatggtgattggggttttgaaaatgacaactggtgtggtttaaatgatta

SEQ ID NO: 18902 - DNA, 105 bp, Anaeromyces robustus
  Cellulose docking domain, dockering
accagaattcaaatgttgtaccaagagttgtactgtttacttcactgatgatcatgaatggggtgttgaagatgatgaatggtgtggtattccagaatcttgttc

SEQ ID NO: 18903 - DNA, 102 bp, Anaeromyces robustus
  Cellulose docking domain, dockering
attctacccatgttgtgaaacttgtaatgtcttctctgaagaagatggtgaccgttggggtgttgaaaacgatcaatggtgtagtattaaatacaagtgtaa

SEQ ID NO: 18904 - DNA, 96 bp, Anaeromyces robustus
  Cellulose docking domain, dockering
tccatgttgtgaaggttgtgatgtatatgaagaatctgaagaaggtaaatggggtattgaaaaagatgcttggtgtggtattaaagactcttgctt

SEQ ID NO: 18905 - DNA, 99 bp, Anaeromyces robustus
  Cellulose docking domain, dockering
tgcctatgaagaatgtaaaggttgtgtcgtatattatgaagatgatacgaagtggggtattgaaaacgatgattggtgtattattccatcatcatgtga

SEQ ID NO: 18906 - DNA, 108 bp, Anaeromyces robustus
  Cellulose docking domain, dockering
cccaaattatccatgttgtaatggctgtgaagttgtttacactgatgtagacggagaatggggtgttgaaaatggtgcttggtgtttacttcaaccttctaaatgcta

SEQ ID NO: 18907 - DNA, 120 bp, Anaeromyces robustus
  Cellulose docking domain, dockering
ttgtaatacagaaagtttaggttatccttgctgtacccattgtaatactatttacactgatgcagatggtgattggggtattgaaaatggtgattggtgtggtattaataatagttgtaa

SEQ ID NO: 18908 - DNA, 111 bp, Anaeromyces robustus
  Cellulose docking domain, dockering
atgttggtcagaaaaacttggataccaatgttgtaagagtactaaagatattgttttcaccgataatgatggtaattggggtatagaaaatggtaattggtgtggtcttat

SEQ ID NO: 18909 - DNA, 120 bp, Anaeromyces robustus
  Cellulose docking domain, dockering
ttgtttcagtgttaatcttggtttcaaatgttgttcaggatgtaatgttatctatactgataatgatggtgactggggtgttgaaaatgatcaatggtgtggtattccagatgaatgtaa

SEQ ID NO: 18910 - DNA, 117 bp, Anaeromyces robustus
  Cellulose docking domain, dockering
atgttggtcattaagattgggttataattgttgtaagtacagaagtactcctgtttatgaaaaggataatgatggtttatggggtattgaagataacgattggtgtggtgtcaccga

SEQ ID NO: 18911 - DNA, 102 bp, Anaeromyces robustus
  Cellulose docking domain, dockering
acaagattatccatgttgtaaaggatgtatagtaaagtatgtagatgattatgaatggggtgtagaagaaaataattggtgttatattccattcaaatgtaa

SEQ ID NO: 18912 - DNA, 117 bp, Anaeromyces robustus
  Cellulose docking domain, dockering
attaaaacgtaatcatccatacccatgttgtgaaaaatcagaaaccgaagtagtttatatttcatctaatggtgatgaatggggtactgaaaacggtgattggtgtggtattactga

SEQ ID NO: 18913 - DNA, 102 bp, Anaeromyces robustus
  Cellulose docking domain, dockering
aaatggttatccatattgtaaaactacaactttagttctctatactgatgatttagaatggggttatgaaaatgatgaatggtgtgttatgagagaaaaaag

SEQ ID NO: 18914 - DNA, 114 bp, Anaeromyces robustus
  Cellulose docking domain, dockering
agaaaaaaatcttggttatccatgttgtaaatattgtgtcattgttgaaagtgattcctacggtgattatggtatagaaaatgatcaatggtgtagtattccatattcatgttc

SEQ ID NO: 18915 - DNA, 114 bp, Anaeromyces robustus
  Cellulose docking domain, dockering
taaatgttggtctgaaaaattaggttatccatgttgtacaaataaaaatgttgttcatgttgatgaaaatggtcaatggggaattgaaaatgatatgtggtgtggtattaaaaa

SEQ ID NO: 18916 - DNA, 120 bp, Anaeromyces robustus
  Cellulose docking domain, dockering
ttgctgggctactaagcttggttataagtgttgtactgctaaatgtccagaagtttcttacgttgaccaagatggtgcttggggtgttgaaaacggtaactggtgtggtattaccaagac

SEQ ID NO: 18917 - DNA, 126 bp, Anaeromyces robustus; identical to SEQ ID NO: 18572
  Cellulose docking domain, dockering

SEQ ID NO: 18918 - DNA, 123 bp, Anaeromyces robustus; identical to SEQ ID NO: 18573
  Cellulose docking domain, dockering

SEQ ID NO: 18919 - DNA, 126 bp, Anaeromyces robustus; identical to SEQ ID NO: 18572
  Cellulose docking domain, dockering

SEQ ID NO: 18920 - DNA, 120 bp, Anaeromyces robustus; identical to SEQ ID NO: 18666
  Cellulose docking domain, dockering

SEQ ID NO: 18921 - DNA, 123 bp, Anaeromyces robustus
  Cellulose docking domain, dockering
atgttgggcagaagctaaaggatataagtgttgtcaagatccaaatactccagtttacgaaactgatagtgatggtaaatggggtattgaagatggtcaatggtgtggtatagtagaaaatat

SEQ ID NO: 18922 - DNA, 114 bp, Anaeromyces robustus
  Cellulose docking domain, dockering
atgttgggcaaaaagatatggatatgaatgttgtagtgaaaatgctaaatattacaaagaagatagtaatggtccatggggtaaggaacctgatggtacaaagtgtggtttaat

SEQ ID NO: 18923 - DNA, 114 bp, Anaeromyces robustus
  Cellulose docking domain, dockering
ttggtctaaaaaattaggttatccattatgtaaagaatctaaagaagtattatatgaagataaagatggtaaatggggatatgaaaatgattggtgtggaattgctgaagaaga

SEQ ID NO: 18924 - DNA, 123 bp, Anaeromyces robustus
  Cellulose docking domain, dockering
atgttggtcagaatctttaggttatagttgttgtaccttctgttctccaattatttattctgatgaaagtggtgattggggtgttataaataatgaatggtgtggtattccaagtaattgtaa

SEQ ID NO: 18925 - DNA, 112 bp, Anaeromyces robustus
  Cellulose docking domain, dockering
tgctcaaggttatccatgttgtactaaatcatgtgattccatttatcaagatggagatggagactggagtcttgaaaataataactggtgtttaattgataagagtatttgt

SEQ ID NO: 18926 - DNA, 120 bp, Anaeromyces robustus
  Cellulose docking domain, dockering
ttgctgggcaaatgctttaggttatagatgttgtaaatcaagtcaagaagtaattgcaactgataaggatggtgaatggagtgttgaagatggtcattggtgtggtattccaaaggataa

SEQ ID NO: 18927 - DNA, 120 bp, Anaeromyces robustus
  Cellulose docking domain, dockering
atgctttgctgaagatttaggattcaaatgttgtagttatagtaccatggaagtttattcagatagtaatggtaaatggagtgttgaaagtggtgaatggtgtggtattgatccaaatgc

SEQ ID NO: 18928 - DNA, 111 bp, Anaeromyces robustus
  Cellulose docking domain, dockering
atgttgggccgaaaaacttggttattcatgttgtcaaggatgtcatgttatttatgttgataatgatggagaatggggtgttgaaaataatgcctggtgtggaattaacca

SEQ ID NO: 18929 - DNA, 117 bp, Anaeromyces robustus
  Cellulose docking domain, dockering
atgtttctctattaaacttggttacccatgttgtcaaggtaatactgtttattatattgataatgatggacaatggggtttcgaaaataataattggtgtggaatgaagaataatat

SEQ ID NO: 18930 - DNA, 117 bp, Anaeromyces robustus
  Cellulose docking domain, dockering
ttgtactggtaaacttcaaggttatcaatgttgtttaacatgtaatgttgtaacgactgatgcagatggaagatggggtattgaaaatggaaattggtgtggtattaaaaattcatg

SEQ ID NO: 18931 - DNA, 123 bp, Anaeromyces robustus
  Cellulose docking domain, dockering
ttgttggtctgaaaaacttggttatccatgttgtaacaatagttgttatgcttttaccactgataatgatggtgaatggggttatgaagatggtcattggtgtggtgttccagcttcttgttc

SEQ ID NO: 18932 - DNA, 123 bp, Anaeromyces robustus
  Cellulose docking domain, dockering
atgttggtcaaagaaatatggttatgaatgttgtcaaggttgtactgcttatgaagttgatgaatttggaaaatggggttatgaaaaaaaccactggtgtggtattattgaagaaaattgtca

SEQ ID NO: 18933 - DNA, 120 bp, Anaeromyces robustus
  Cellulose docking domain, dockering
gtgttggtctaaaaaattaggttttccatgctgtaaaactaataaagtagttttgtttgaagatgcagatggtaaatggggtgttgaaaatgataattggtgtggtataattgaagaaga

SEQ ID NO: 18934 - DNA, 126 bp, Anaeromyces robustus
  Cellulose docking domain, dockering
ttgttgggcatatgaattaggttatcaatgttgttttgaaactggtcctgaaaaagccagacaacaagatcaatatggtaaatggggtgttgaatggggaagatggtgtggtattattgaagaaac

SEQ ID NO: 18935 - DNA, 99 bp, Anaeromyces robustus
  Cellulose docking domain, dockering
ttttccatgttgttccccagacaatacttatatattctttagtgataataatggtgattggggtattgaaaatggagattggtgtggtattataaatgg

SEQ ID NO: 18936 - DNA, 120 bp, Anaeromyces robustus
  Cellulose docking domain, dockering
ttgttggtcagcagtctttggttacccatgttgtaaatatactaaagttgtaagatctactgatgaaaatggagattggggtattgaatatgatcattggtgtggtattccaaaatctca

SEQ ID NO: 18937 - DNA, 63 bp, Anaeromyces robustus
  Cellulose docking domain, dockering
tactgatgataatggtaaatggagtgttgaaaatgatgaatggtgtggtattgttgaaaatga

SEQ ID NO: 18938 - DNA, 120 bp, Anaeromyces robustus
  Cellulose docking domain, dockering
atgttggtctttaaaacaaggttattcatgttgtcaaaataaaaatactaaagttagttacatttctaaaaatggtgacgaatggggtgttgaaaataatgaatggtgtggtattactga

SEQ ID NO: 18939 - DNA, 96 bp, Anaeromyces robustus
  Cellulose docking domain, dockering
atacaagtgttgtcaacaatgtaaagttagatatactgatgattatgaatggggtgttgaagatggtgaatggtgttcaattccatatagttgttc

SEQ ID NO: 18940 - DNA, 117 bp, Anaeromyces robustus
  Cellulose docking domain, dockering
ttgttggtctgaaaagttcaacattccatgttgtcaatccacttctgaagtagttagaaaaacttatgacggtgaatggggtatagaagatggtaaatggtgtagtattggtgaatc

SEQ ID NO: 18941 - DNA, 96 bp, Anaeromyces robustus
  Cellulose docking domain, dockering
atataaatgttgtgaaagttgtaatgtagtttatactgatttccaaaaatggggttatgaagataatgaatggtgttctattccttattcatgtga

SEQ ID NO: 18942 - DNA, 120 bp, Anaeromyces robustus
  Cellulose docking domain, dockering
ctgtttttctattaaatttggatatccatgttgtaatggatgtgatgtcatatacgtggatgaagatggtaaatggagtgtagaaaatgatagctggtgtggtttaatggacagttgtga

SEQ ID NO: 18943 - DNA, 105 bp, Anaeromyces robustus
  Cellulose docking domain, dockering
tcaatatgcttgttgtaaagatccaaatacatatattagtaccaccgataaaactggagactggggtatagaaggtaattactggtgtttaattgataaagatgt

SEQ ID NO: 18944 - DNA, 117 bp, Anaeromyces robustus
  Cellulose docking domain, dockering
ttgttgggcattaaaatataattacaaatgttgtattgaaacaactgatgtaattgaaactgatgaacatggtgattggggtgtagaaaatggtgattggtgtggtattgttaaaaa

SEQ ID NO: 18945 - DNA, 117 bp, Anaeromyces robustus
  Cellulose docking domain, dockering
ttgctggtctaagaaattaggttatgaatgctgtgctggttgtagtgttgcttacaccgatagtgatggtgaatggggtcttgaaaacgaccaatggtgtggtattccagatacttg

SEQ ID NO: 18946 - DNA, 108 bp, Anaeromyces robustus
  Cellulose docking domain, dockering
taaatcatcaggttacccatgttgtgaaaactgtgaagtcatttacgatgatggaaacacaaaatggggtcttttaaataatgactggtgtgctctttctgatgcttg

SEQ ID NO: 18947 - DNA, 96 bp, Anaeromyces robustus
  Cellulose docking domain, dockering
atatgattgctgttctggatgtaccgtcgttgatcaaggtgatggtaaaatcaaatggggtgtcgaaaacaatcaatggtgtattattaagagtac

SEQ ID NO: 18948 - DNA, 123 bp, Anaeromyces robustus
  Cellulose docking domain, dockering
ttgttggtctgaagtatttggctataaatgttgtagtgaagataacaaaaatgctgaatatactgatattaatggaaaatggggtgtagaaaatgatgattggtgtggtattattgaaaactc

SEQ ID NO: 18949 - DNA, 129 bp, Anaeromyces robustus
  Cellulose docking domain, dockering
atgttgggcagattcctatggttacccatgttgtagcgaaggtattttagctttaccattttacactgacgaaaaaggtaataaatggggtagagaaaatgatgattattgtggtatcattgaaaaacc

SEQ ID NO: 18950 - DNA, 117 bp, Anaeromyces robustus
  Cellulose docking domain, dockering
tattggcaatggttatccatgttgtaaagatcaaagacctgaaaaaaaaacttacttagatatggatggtgattggactatagaagatggtaaatggtgtggattttatgatagttc

SEQ ID NO: 18951 - DNA, 102 bp, Anaeromyces robustus
  Cellulose docking domain, dockering
tgcttatagcaactgtcaaggttgtagagtcattcttgaagaaaacggtgttaaatggggtgttgaaaacaatgactggtgcattgtttcatcaagttgtaa

SEQ ID NO: 18952 - DNA, 102 bp, Anaeromyces robustus
  Cellulose docking domain, dockering
atatatgtgttgtaaaggatgtgatgttgtagaagatgacggagaaacaactaaatggggtattgaaaataatgaatggtgtggtcttaaagaatcttgtta

SEQ ID NO: 18953 - DNA, 120 bp, Anaeromyces robustus
  Cellulose docking domain, dockering
ctgttggtctaaaggattaggatatgattgttgtaaaggatgtaatacaatttatactgatggaagtggtgattggggtgttgaaaacaatcaatggtgtggaattccagaatcatgtaa

SEQ ID NO: 18954 - DNA, 120 bp, Anaeromyces robustus
  Cellulose docking domain, dockering
ttgctggtcaaatgcattaggatatgaatgttgtaaaggatgtactgtaattgaaactgatggaagtggagattggggtgttgaaaataatcaatggtgtggtattccatcttcatgtaa

SEQ ID NO: 18955 - DNA, 126 bp, Anaeromyces robustus
  Cellulose docking domain, dockering
atgttgggctgaaccattaggtttcaaatgttgttcttctcctgatgctcaaatattcacttctgatagtgatggtgattgggctattgaaaatggtcaatggtgtggtattatgaaaaagaaagc

SEQ ID NO: 18956 - DNA, 111 bp, Anaeromyces robustus
  Cellulose docking domain, dockering
atgttgggctgaagctttaggttttgaatgttgtaagacctctgttccagttacttatactgataaagatggaaaatggggtgttgaaaatggaaactggtgtggtttaaa

SEQ ID NO: 18957 - DNA, 123 bp, Anaeromyces robustus
  Cellulose docking domain, dockering
ttgttgggctgagccattaggatttaaatgttgtactggtactgatccaaagattgtttattcagatgaagatggtgattgggctattgaaaatggtcaatggtgtggtgttgtaaaaaatat

SEQ ID NO: 18958 - DNA, 114 bp, Anaeromyces robustus
  Cellulose docking domain, dockering
ttttgctctttctgatggttatgaatgttgttttgataatgaagttgtttatgaagatgaaactggtaaatggggtattaatgaaaatggtgaatggtgtggtgtagaacaacc

SEQ ID NO: 18959 - DNA, 105 bp, Anaeromyces robustus
  Cellulose docking domain, dockering
aagtaaatatagatgttgtacagaatgtaatgttagttatacaggtagtgatggacatacttggggtattgaatatggtcaatggtgttccattccatatacttg

SEQ ID NO: 18960 - DNA, 123 bp, Anaeromyces robustus
  Cellulose docking domain, dockering
atgttgggctagttttgaaggttatccatgttgtgaagatccaaaaactcctgtttcctatgttaataaacaaacccgtgttgaatatggttttgaacatggggaatggtgtggtattagttc

SEQ ID NO: 18961 - DNA, 123 bp, Anaeromyces robustus
  Cellulose docking domain, dockering
atgttgggctgaagctcaaggttatcaatgttgtaagaatatttgtgatgttgtttacaccgatgattctggttcatggggtttagaaaacaatgactggtgtggtattccaaatacttgtaa

SEQ ID NO: 18962 - DNA, 123 bp, Anaeromyces robustus
  Cellulose docking domain, dockering
ttgttggagtcaaagattaggtttcccatgttgtaatggatgtgatgttgcctatacggatagtgatggtgattggggacttgaaaataataattggtgtggtatagataagagtaaatgttc

SEQ ID NO: 18963 - DNA, 117 bp, Anaeromyces robustus
  Cellulose docking domain, dockering
atgtttctctcaatcattaggtttcccatgttgtaataattgtaatgttgtttacacggatgaaagtggatcatggggtgttgaaaataatgattggtgtggtattaaaagctcttg

SEQ ID NO: 18964 - DNA, 123 bp, Anaeromyces robustus
  Cellulose docking domain, dockering
ttgttgggctgaagctttatcttataaatgttgttctaatccaaatacacctgttgtacttactgataaatcaggagaatggggtattgaaaatggtaattggtgtggtattattccaaaaac

SEQ ID NO: 18965 - DNA, 123 bp, Anaeromyces robustus
  Cellulose docking domain, dockering
ttgttgggctgaagctttacattataaatgttgtactgatccagatacacctgttaaaggtactgatgaattcggaaaatggggtaaggaaaatggtgaatggtgtggtatttatcttgataa

SEQ ID NO: 18966 - DNA, 120 bp, Anaeromyces robustus
  Cellulose docking domain, dockering
ttgttggtcacttgatcatggttataaatgttgtaaaggtgaaaatgttgaagttgaatatactgattctaaaggtcaatggggtaaagaaaatggtgaatggtgtggtattattccaaa

SEQ ID NO: 18967 - DNA, 123 bp, Anaeromyces robustus
  Cellulose docking domain, dockering
atgttgggcggaagctttaaattataaatgttgttctgatccagatacacctgttagatctactgatgaattcggaaaatggggtagagaaaatcatgaatggtgtggtattaatcatgatac

SEQ ID NO: 18968 - DNA, 123 bp, Anaeromyces robustus
  Cellulose docking domain, dockering
ttgttggtcacttaattatggatataaatgttgtaaagatgaaaatgttgaagttattactactgatatttatggtcaatggggtaaagaagatggtaaatggtgtggtattattccaaaaac

SEQ ID NO: 18969 - DNA, 102 bp, Anaeromyces robustus
  Cellulose docking domain, dockering
tagtgacaaataccaatgttgtaaagataagaaatctatatatactgatgatgatggtgattgggcatatactaatggtgaatggtgtggtgtcaagtttag

SEQ ID NO: 18970 - DNA, 123 bp, Anaeromyces robustus
  Cellulose docking domain, dockering
ttgttgggctcttgattatggttataaatgttgtaagggtgaaaatgtaattcctattgtcactgaatctgtaggtcaatggggtatagaaaatgatgattggtgtggtattgtttcaaaaac

SEQ ID NO: 18971 - DNA, 120 bp, Anaeromyces robustus
  Cellulose docking domain, dockering
ttgttgggcagaaaaaatcagttataaatgttgtactgatccagatacagttgttattgaaactgatgaattaggaaaatggggtgttgaaaatggtgattggtgtggtataattagtac

SEQ ID NO: 18972 - DNA, 111 bp, Anaeromyces robustus
  Cellulose docking domain, dockering
ttgtttttctgttgctatgggatatccatgttgtaaaagtaataaagttgtttatactgatgaaagtggagaatggggtatagaaaataatgaatggtgtggtattggtga

SEQ ID NO: 18973 - DNA, 120 bp, Anaeromyces robustus
  Cellulose docking domain, dockering
ctgtttttctattgctcaaggatatccatgttgtcaatcctgtaaaataaaatatactgatgaatctggtaaatggggtgtagaagatggtaaatggtgtggtataaaggatagttgttc

SEQ ID NO: 18974 - DNA, 99 bp, Anaeromyces robustus
  Cellulose docking domain, dockering
attaactccttcttacccatgttgtaaaggtgataaagtcatctatactgataaaaatggagattggggtgttgaaaatggagaatggtgtggtattgg

SEQ ID NO: 18975 - DNA, 126 bp, Anaeromyces robustus
  Cellulose docking domain, dockering
ctgttggagtgaaagccttggtgttagatgttgtaagggtgctgaaaacattgtagaatacatggatcaagaaggatggtggggtgttactgaagaagatcaatggtgtggtattgttaaaaatga

SEQ ID NO: 18976 - DNA, 111 bp, Anaeromyces robustus
  Cellulose docking domain, dockering
ttgttggtcagaaaaattaggttataaatgttgtacaggatgtacagttattaccaccgatgaaagtggaaaatggggtattgaaaataatgaatggtgtggtattaaatg

SEQ ID NO: 18977 - DNA, 93 bp, Anaeromyces robustus
  Cellulose docking domain, dockering
atatccatgttgtaaaggtaatgtagtttattataccgatgaacaaggagcttggggtgttgaaaatggtaattggtgtggtattagtaatcc

SEQ ID NO: 18978 - DNA, 108 bp, Anaeromyces robustus
  Cellulose docking domain, dockering
tattattcaagaaggatatgaatgttgtccaataggttgtaaaatttattatacggatagttctggggattggggtatttataataatgattggtgtggatgtggtag

SEQ ID NO: 18979 - DNA, 111 bp, Anaeromyces robustus
  Cellulose docking domain, dockering
tttatatggttatccatgttgttctgaatgttccaccgtttattatcaggataaaaatggtgaatggggtattgaaaatggtgattggtgtggaatgccatataaatgtaa

SEQ ID NO: 18980 - DNA, 105 bp, Anaeromyces robustus
  Cellulose docking domain, dockering
ttacagttatccatattgtaaaactacaaaagatgtagcatttgatgatggtacattacaatggggtgttgaaaatgataactggtgtataattaaaggtcaatc

SEQ ID NO: 18981 - DNA, 114 bp, Anaeromyces robustus
  Cellulose docking domain, dockering
taattgttgggcacaaaaattaggatatccttgttgtacagaaaaggttatttattactctgatggtgatggtgattggggatttgaaaataaccaatggtgtggtataatgaa

SEQ ID NO: 18982 - DNA, 123 bp, Anaeromyces robustus
  Cellulose docking domain, dockering
tccatcttctattactaaccaaggttatccatgttgttcatcctgttcaactgtttattatgttgataatgatggtaaatggggtgttgaaaacaatgattggtgtggaataccaacaaattg

SEQ ID NO: 18983 - DNA, 117 bp, Anaeromyces robustus
  Cellulose docking domain, dockering
ttcatcaagaattatagctcttggttataaatgttgttctgttggttgtcaagtttcttatactgataatgatggagattggagttttgaaaatggtcaatggtgtggttgtggaat

SEQ ID NO: 18984 - DNA, 102 bp, Anaeromyces robustus
  Cellulose docking domain, dockering
tacaggttatgcttgttgtatatttagtgatactactttagccagtcaagatccaagtggtgattggggtaaagaaggtgataaattctgtctttttgaaaa

SEQ ID NO: 18985 - DNA, 117 bp, Anaeromyces robustus; identical to SEQ ID NO: 16451
  Cellulose docking domain, dockering

SEQ ID NO: 18986 - DNA, 108 bp, Anaeromyces robustus
  Cellulose docking domain, dockering
aggaaccggttatccatgttgtatatttgatacaactaaagccgttcttcatgatgatgatggggattggggtatagaaggtgattattgtcttattgttaataataa

SEQ ID NO: 18987 - DNA, 117 bp, Anaeromyces robustus
  Cellulose docking domain, dockering
aaaaggatatagatgttgtaaaaatcctaatacaaaaattgaatatattagtaaaaatggagatgaatggggtgttgaaaataatgattggtgtggtattactaattcacaatgtac

SEQ ID NO: 18988 - DNA, 105 bp, Anaeromyces robustus
  Cellulose docking domain, dockering
tggttataaatgttgttctaatattaatgctgaagtacaatatcatgataaagatggtgattggagtattgaaaataatgaatggtgtattattaaaaaggatga

SEQ ID NO: 18989 - DNA, 114 bp, Anaeromyces robustus
  Cellulose docking domain, dockering
ttgtaaagctgaagaaattggatattcatgttgtaaaaaacaaaaagaagtaatttatactgatgatttaggtgaatggggtatagaaaatggtgattggtgtggtatttctac

SEQ ID NO: 18990 - DNA, 90 bp, Anaeromyces robustus
  Cellulose docking domain, dockering
tgattatccagtttgtaaaacaacttctgaaatagttttcactgacacggaaaaatggggaatagaaaataatgaatggtgtatcttgtg

SEQ ID NO: 18991 - DNA, 126 bp, Anaeromyces robustus
  Cellulose docking domain, dockering
ttgttgggctgaaaaacttggtttcaaatgttgtgatccaaagaaatgtagagatgttgtttactttgattatgatggtcaatgggatgttgaaaatggtgaatggtgtggtattaccactcaaaa

SEQ ID NO: 18992 - DNA, 123 bp, Anaeromyces robustus
  Cellulose docking domain, dockering
ttgttggggtgatgaaatgggttactcttgttgtaaggaaaagaaaactattgttatgtacactgatattagtggacgttggagtgttgaaggtggtaaatggtgtgctattaaaaacactaa

SEQ ID NO: 18993 - DNA, 120 bp, Anaeromyces robustus
  Cellulose docking domain, dockering
ttctgctaatattacaaaacaaggttataaatgttgtccaagtggatgtattgttatttatactgatgatgatggtacttggggtataaataatggtgaatggtgtggatgtaatgctga

SEQ ID NO: 18994 - DNA, 126 bp, Anaeromyces robustus
  Cellulose docking domain, dockering
tccagctactattactgctcaaaattatccatgctgtagtgataataattgtgatgtatatgctgttgatgaatctggtaaatggggtcttgaaaataatcaatggtgtggtatttccaacaaatg

SEQ ID NO: 18995 - DNA, 111 bp, Anaeromyces robustus
  Cellulose docking domain, dockering
catacttaataaaggatattcatgttgtccatacaagtgtgaagttatttacactgatgaagatggtacttggggtatttatgataatgaatggtgtggatgcaatcccga

SEQ ID NO: 18996 - DNA, 114 bp, Anaeromyces robustus
  Cellulose docking domain, dockering
atgttttagtactgttttaggttacccatgttgtaagaatactaaggaagtatctgttaaggattgtgatggttcatggggagtagaaaatgatcaatggtgtggtattggtgg

SEQ ID NO: 18997 - DNA, 117 bp, Anaeromyces robustus
  Cellulose docking domain, dockering
ttgttgggctaaaaaattaggttattcttgctgtgctagtaaatgcgctgaagtatactacactgatgccaacggcaaatggggtgtagagaatggtaaatggtgtggtattattgc

SEQ ID NO: 18998 - DNA, 99 bp, Anaeromyces robustus
  Cellulose docking domain, dockering
tacatacaaatgttgtaaaagttgtgatatagtttatactgatactactaattggggtgttgaaaataatgaatggtgttctattccatataaatgtgg

SEQ ID NO: 18999 - DNA, 123 bp, Anaeromyces robustus
  Cellulose docking domain, dockering
ttgttggtcaactgaatatggttatccatgttgtgtattaaagtctacagttatcgaatacgatgatgttgagaatggaagaaaatatggtattgaagataacaaaatttgtggtattagtga

SEQ ID NO: 19000 - DNA, 99 bp, Anaeromyces robustus
  Cellulose docking domain, dockering
taaatgttgtaaaaatacttgtaaagtttatcttgaagattcctcggattattggaatattgaaaatggggaatggtgttctataccttattcttgtta

SEQ ID NO: 19001 - DNA, 102 bp, Anaeromyces robustus
  Cellulose docking domain, dockering
tgattatgaatgttgtgtttatccggatactcaattagtttattatactaatgttggtccatggggtatagaaaataatagttggtgtcttattaataaaac

SEQ ID NO: 19002 - DNA, 120 bp, Anaeromyces robustus
  Cellulose docking domain, dockering
ttgttggtctgaaaaattaggatataaatgttgtagtacttgtggtcaagtttattatgctgataaagatggagaatggggttacaccaatgattggtgtggtattccaagttcatgtaa

SEQ ID NO: 19003 - DNA, 120 bp, Anaeromyces robustus
  Cellulose docking domain, dockering
tactgctcctgatggttataaatgttgtaaagaatcatgtgcttactatgataaagatagtaaaggttactggggacttgaaaataaagaatggtgttatattgatactgctaaatgtga

SEQ ID NO: 19004 - DNA, 123 bp, Anaeromyces robustus
  Cellulose docking domain, dockering
atgttgggcagaatctaaaggttatccatgttgtgatccaagtaataccaatgttataatggaagatattgatggtaaatggggattagaaaacaatcaatggtgtggtatagttaataataa

SEQ ID NO: 19005 - DNA, 120 bp, Anaeromyces robustus
  Cellulose docking domain, dockering
atgttgggcaacaaaattaggttatccatgttgtacaggaaaatatcctggtattagttatactgataaagatggatcatggtctattgaaaatggtcaatggtgtggtgttattataaa

SEQ ID NO: 19006 - DNA, 105 bp, Anaeromyces robustus
  Cellulose docking domain, dockering
aggtacaggttatccatgttgtattttagaaagtaccgcttttagaacctatgatagaagtggttattggggattagaaggaggtaattattgtcttatagaaga

SEQ ID NO: 19007 - DNA, 120 bp, Anaeromyces robustus
  Cellulose docking domain, dockering
ttgttggtctgaagcattaggttatccatgttgtcgtgatcctcgaaccaccatttataaaactgaaaaagatggtaaagaatggggtatagaatctaatcaatggtgtggtattaatga

SEQ ID NO: 19008 - DNA, 129 bp, Anaeromyces robustus
  Cellulose docking domain, dockering
tccaggttatgccgaaggctataattgttgtaaaaattgtgaagttacctatatttcccattccgatccaaataaaaaatggggattcttttctaatggagattggtgttctattccatattcttgtga

SEQ ID NO: 19009 - DNA, 108 bp, Anaeromyces robustus
  Cellulose docking domain, dockering
aaaattaggttatccatgttgtagtaataaaaatggtaaagttgtatataaagatgaaaatggtaattggggtgttgaacatcatcaatggtgtatcttctcagataa

SEQ ID NO: 19010 - DNA, 120 bp, Anaeromyces robustus
  Cellulose docking domain, dockering
atgttggtctaatgaattaggttacccatgttgtaaatctactactgaaattgttttcactgatgatcgtggtaattggggtgttgaagataagaaatggtgtggagttattgttgatga

SEQ ID NO: 19011 - DNA, 123 bp, Anaeromyces robustus
  Cellulose docking domain, dockering
ttgctggtctgaaaaattaggttataaatgctgtaacacttgtttcccagtttattataccgataatgatggtcaatggggtatagtcaatggtgaatggtgtggtattgctaagacttgtac

SEQ ID NO: 19012 - DNA, 111 bp, Anaeromyces robustus
  Cellulose docking domain, dockering
ttgtagttcaaaatctttaggttatccatgttgtaaatcatctaacaatgtagtctctactgatgaattaggaaaatggggtgttgaaaacggtgattggtgttacattaa

SEQ ID NO: 19013 - DNA, 120 bp, Anaeromyces robustus
  Cellulose docking domain, dockering
atgttgggcaaaaatattaggttctccatgctgtcttaccactaaagtagtcgttgaaattgatgactttggtaaatggggtattgaaaatggtgcatggtgtggtattattgaagaagt

SEQ ID NO: 19014 - DNA, 120 bp, Anaeromyces robustus
  Cellulose docking domain, dockering
atgttggtcattaaaattaggttcaccatgttgtactaccactaaggaaattatttataccgatgatgatggaaactggggtattgaaaataatgactggtgtggtataattgatgataa

SEQ ID NO: 19015 - DNA, 117 bp, Anaeromyces robustus
  Cellulose docking domain, dockering
ttgggcattaaaattaggttcaccatgttgtactttcaataaagatgtttatgctattgatgaaaatggtaaatggagtgttgaaaatggaatttggtgtggtataattgatgatgg

SEQ ID NO: 19016 - DNA, 120 bp, Anaeromyces robustus
  Cellulose docking domain, dockering
ctgttgggcacacgcctataattacccatgttgtaagactaccaagaatttagttgaaactgattctaaaggtaataaatggggtattgaagacaatcattggtgtggtctttcaaaagg

SEQ ID NO: 19017 - DNA, 120 bp, Anaeromyces robustus
  Cellulose docking domain, dockering
ttgtttttctgaaaaacttggttatccatgttgtgattcctcaaatgatattgttctctacactgacagtgatggtaagtggggtgtagaaaataataattggtgtggtattactgccac

SEQ ID NO: 19018 - DNA, 105 bp, Anaeromyces robustus
  Cellulose docking domain, dockering
aggtacaggttatgcttgttgtattatgaataatggttatattgatagtaccgatagtgatggtacatggggtattgaaggaggtagatattgtctttatgaaga

SEQ ID NO: 19019 - DNA, 108 bp, Anaeromyces robustus
  Cellulose docking domain, dockering
agtagaaggttataaatgttgtaaatccacctgtacagtatcttataccgatagtaataaatggggagttgaaaataatgaatggtgtattattccttatgaatgtga

SEQ ID NO: 19020 - DNA, 129 bp, Anaeromyces robustus
  Cellulose docking domain, dockering
ttgttggtcgatgaaagaaggttatccatgttgtaaagatgaaaatacacccgtttcctatattagtaaaagtacaggtaaagaatggggtatggaaaatggagaatggtgtggtattgttgataaaca

SEQ ID NO: 19021 - DNA, 105 bp, Anaeromyces robustus
  Cellulose docking domain, dockering
aagtactggttataaatgttgtcctgatgctgaagtaaaagcaacatatggtaatagtacatggggtaaagtaaatggtgaatggtgtggtattaaacaaaatat

SEQ ID NO: 19022 - DNA, 120 bp, Anaeromyces robustus
  Cellulose docking domain, dockering
gtgctggtcattaaaacaaggatatccatgttgtgtaaaaaccgaaattgtagttatagaagatgaaaatggaaaatggggtgttgaaaatgatgattggtgtggtattattgttgaaac

SEQ ID NO: 19023 - DNA, 120 bp, Anaeromyces robustus
  Cellulose docking domain, dockering
atgtccatttaatcaatatggttacccatgttgtaaaacgactaaagttgttgtatctatcgattcaatgggaaaatggggtattgaagatggtcaatggtgtggtatcgttgatgataa

SEQ ID NO: 19024 - DNA, 105 bp, Anaeromyces robustus
  Cellulose docking domain, dockering
aagaacatacccatgttgtagtccagataataaaaaaataaaatatgttgatcaacatggtcaatggggttttgaaaatggtgattggtgtggtatgcctgatgg

SEQ ID NO: 19025 - DNA, 123 bp, Anaeromyces robustus
  Cellulose docking domain, dockering
atgtttatctgaacttgtaggttatccatgttgtgctaaaggaattaaagctgtttatgctaaagatgaatatggtgaatggggttatgatttcaaaaagaatgaatggtgtggacttactcc

SEQ ID NO: 19026 - DNA, 117 bp, Anaeromyces robustus
  Cellulose docking domain, dockering
ttgttggtcagaaaaatatggttatccatgttgtaatggctgttatgtttttgaaactgatgatgatggtcaatggggatatgaaaacaatcaatggtgtggtattcaatcctactg

SEQ ID NO: 19027 - DNA, 120 bp, Anaeromyces robustus
  Cellulose docking domain, dockering
ttgtagaagtgctttagaaggttatatgtgttgtaaaactcctggtaaagtcttttatagagatgattttggatcatggggtgtagaaaatgaacaatggtgtggttttaatgaaaaata

SEQ ID NO: 19028 - DNA, 117 bp, Anaeromyces robustus
  Cellulose docking domain, dockering
ttgttgggctgaaaaattaggttatccatgttgtaaaggtaatgaaccaaaagttgaatttactgatgaacatggagattggagtatagaaaatggacaaaaatgtggtattttagt

SEQ ID NO: 19029 - DNA, 99 bp, Anaeromyces robustus
  Cellulose docking domain, dockering
attatatgaaatttgtaaagaacaacatgatgtagtatttaaagataatgaaggagtatggagtgtagaaaatggaaattggtgtagtatacaatattg

SEQ ID NO: 19030 - DNA, 123 bp, Anaeromyces robustus
  Cellulose docking domain, dockering
tccttttgaatctattggttataaatgttgttcaaaaacatgtcttgtactttattctgacgaaagtggtgattggggtgtagaagatgatgaatggtgtggtattaatccatcactttgtaa

SEQ ID NO: 19031 - DNA, 120 bp, Anaeromyces robustus
  Cellulose docking domain, dockering
ttgtttttctgaaaaattaggatatccatgttgttctggatgtactgttatttattctgataatgatggagaatggggtatagaaaatgataattggtgtggtattaaaaacaattgttc

SEQ ID NO: 19032 - DNA, 117 bp, Anaeromyces robustus
  Cellulose docking domain, dockering
ttgggcagatgaattaggttttagttgttgtgaaaatgacaacggaaaaatagtaattggggataataatggtctttggggtaaagaaaatggtaactggtgtggttttaaaaatgg

SEQ ID NO: 19033 - DNA, 120 bp, Anaeromyces robustus
  Cellulose docking domain, dockering
atgctggtctacagaatatggatatccatgttgctcttcaccagatacaaaaagtaattcaactgacagtaaaggcacatggggttttgaaaatggagattggtgtggtttagcaaaagc

SEQ ID NO: 19034 - DNA, 117 bp, Anaeromyces robustus
  Cellulose docking domain, dockering
acctgattatccatgttgttccaattgtgatgtcgaaataatttggaatgatgaaaataaaggacaatcttggagtattgaaaataataattggtgtggtatattacaaagttgttt

SEQ ID NO: 19035 - DNA, 117 bp, Anaeromyces robustus
  Cellulose docking domain, dockering
ttgttggtctttagctttaggttatccatgttgtcaatcatctactaaagttcatactacagatgaaaatggttcatggggtatagaaaataatcaatggtgtggtattccaacaaa

SEQ ID NO: 19036 - DNA, 99 bp, Anaeromyces robustus
  Cellulose docking domain, dockering
taaatgttgtaaaaaatcttgtaaagtttatcgtgaagaagatggtgattattggaatgttgaaaataatgaatggtgttctttaccttattcttgtta

SEQ ID NO: 19037 - DNA, 126 bp, Anaeromyces robustus
  Cellulose docking domain, dockering
atgtatggctgaagttattggttatccatgttgtacatcaaaacaaactaaagtttaccgtactgatgaatatggtgattggagtttcaacttcttaaagttacaatggtgtggtttaacaaaata

SEQ ID NO: 19038 - DNA, 126 bp, Anaeromyces robustus
  Cellulose docking domain, dockering
ttgggctagaaaattaggatacccatgttgtgaaaaatgcccattattaactctttacaaagattctaacggatcatggggacttgaacatcttcgttggtgtggtattattgaatcccaatgttc

SEQ ID NO: 19039 - DNA, 123 bp, Anaeromyces robustus
  Cellulose docking domain, dockering
atgtttatctgaacttgtaggttatccatgttgtgctaaaggaattaaagttgtttatgcaaaagatgaatatggtgaatggggttatgatttcaaaaagaatgaatggtgtggacttactcc

SEQ ID NO: 19040 - DNA, 114 bp, Anaeromyces robustus
  Cellulose docking domain, dockering
atgttggtcagaaaaatatggttatccatgttgtaatggctgttatgtttttgaaactgatgatgatggtcaatggggatatgaaaacaatcaatggtgtggtattcaatcctt

SEQ ID NO: 19041 - DNA, 117 bp, Anaeromyces robustus
  Cellulose docking domain, dockering
atgttggtcattaaatttaggtttcccatgttgtgaagaaactaaaaatgtcattgaaattgatgataatggtaaatggggtatagaaaacaataactggtgtggtataactgaaaa

SEQ ID NO: 19042 - DNA, 99 bp, Anaeromyces robustus
  Cellulose docking domain, dockering
aagtccttgctgtgaaaataatgatggtgaaatattatattatgatatggatggtgattggggttatgaaaatggtttatggtgtgcttatcataatag

SEQ ID NO: 19043 - DNA, 93 bp, Anaeromyces robustus
  Cellulose docking domain, dockering
tggttataaatgttgtccgaatgctactgcactactcgaagatgattatggatcttggtctatagttaatggagaatggtgtggtgttgaagg

SEQ ID NO: 19044 - DNA, 120 bp, Anaeromyces robustus
  Cellulose docking domain, dockering
atgctggtcattaaatttaggttttccatgttgtgaagaaactcaaaatgtcattgaaattgatgataatggtaaatggggtatagaaaacaataattggtgtggtataattgaaaaccc

SEQ ID NO: 19045 - DNA, 111 bp, Anaeromyces robustus; identical to SEQ ID NO: 16508
  Cellulose docking domain, dockering

SEQ ID NO: 19046 - DNA, 120 bp, Anaeromyces robustus
  Cellulose docking domain, dockering
atgttggtcattaagacttggttccccatgttgtactactactgataaagttatctatactgatggtgatggtaattggggttatgaaaataatgagtggtgtggtataattaacaaaag

SEQ ID NO: 19047 - DNA, 123 bp, Anaeromyces robustus
  Cellulose docking domain, dockering
ttgttgggcaaaagccaaaggttatccatgttgtgataatgatgaaggttatttacaaagttatgatatggatggtaaatggggttatgaaaataatgcctggtgtggatataaaagttccaa

SEQ ID NO: 19048 - DNA, 111 bp, Anaeromyces robustus
  Cellulose docking domain, dockering
atgttggtcaatgccattaggttacccatgttgtgtaggaaatgatgtttataagaaagatgtttatggtttatggggtattgaaaatgataattattgtggtatagcaag

SEQ ID NO: 19049 - DNA, 102 bp, Anaeromyces robustus
  Cellulose docking domain, dockering
tgttggatacgcttgttgtaagagtagtgatgttaaaatttatgaaaccgatgaatatggtaaatggggtgttgaagataataaatggtgtttattagatag

SEQ ID NO: 19050 - DNA, 120 bp, Anaeromyces robustus
  Cellulose docking domain, dockering
ttcttctagaattcaaaaccaaggttttaaatgttgttccaataattgtatggtattctattctgatggtgatggtaactggggttatgaagatggagaatggtgtggatgtaatagtac

SEQ ID NO: 19051 - DNA, 114 bp, Anaeromyces robustus
  Cellulose docking domain, dockering
atgtttctcaattgctttaggttatccatgttgtcaaggtaacgaaattgtttatactgataatgatggtaattggggtgtagaaaatggtcaatggtgtggtattggtagcaa

SEQ ID NO: 19052 - DNA, 117 bp, Anaeromyces robustus
  Cellulose docking domain, dockering
ttgtttctctgaagctttaggttatccatgttgtacatcatgtaatgtaatctttactgacagtgatggtaaatggggtgttgaaaataatagttggtgtggtattaaagactcttg

SEQ ID NO: 19053 - DNA, 102 bp, Anaeromyces robustus
  Cellulose docking domain, dockering
tacttcctattcctgttgtgtctttagagataccgctgtttatagtaccgatgaaactggtacatggggtattgaaggtaatcgttggtgtctttttaattt

SEQ ID NO: 19054 - DNA, 135 bp, Anaeromyces robustus
  Cellulose docking domain, dockering
ttgttggtcaatcgctgaaggttatccatgttgtcaaaatcctgaaaccaccgtttcctatactagtaaatcttcaggaaaattatggggtgttgaaaataatgaatggtgtggtattactgaaaaacaatgtcc

SEQ ID NO: 19055 - DNA, 114 bp, Anaeromyces robustus
  Cellulose docking domain, dockering
atgtgttaaaaataagaatggattaaaatgttgtagtacttgtgaaattgctttaactgatgctactggtagatatggttatgaaaatggtgaatggtgtaatactccattcaa

SEQ ID NO: 19056 - DNA, 120 bp, Anaeromyces robustus
  Cellulose docking domain, dockering
ttggtcacgttctattggttttgtttgttgtgataaatgtaatgttctttatgttgatgaacaaggtaaatggggtattgaagatgaatactggtgtggtattaacccagataaatgtaa

SEQ ID NO: 19057 - DNA, 90 bp, Anaeromyces robustus
  Cellulose docking domain, dockering
tgactatccagtttgtaaggaaactaccaaggtgatgtataccgatacggaaaaatggggtgtagaacatggagaatggtgtgtcctctg

SEQ ID NO: 19058 - DNA, 108 bp, Anaeromyces robustus
  Cellulose docking domain, dockering
tagtagtggttacccatgttgtactgatcctcacaccaaagttgtctaccatgatgatgaaggtgactggggggtggaaaataaagaatggtgctttattcctgtgga

SEQ ID NO: 19059 - DNA, 111 bp, Anaeromyces robustus
  Cellulose docking domain, dockering
taatagtgaaaaatatggttattcctgttgtaaaacagagcaaaaagttgtttatacggatagccaaggggattggggaattgaagatggaaattggtgtggtatttattc

SEQ ID NO: 19060 - DNA, 120 bp, Anaeromyces robustus
  Cellulose docking domain, dockering
tatgcaaagacaaggatatccatgttgtgaagaaaataattgtaatatctatttcaaggatggtgatggtgactggggtattagttcaaaatctaattggtgtggtattagattcacctg

SEQ ID NO: 19061 - DNA, 123 bp, Anaeromyces robustus
  Cellulose docking domain, dockering
ctcaagtaaattcaatcaaatgggatacaaatgctgtaatggatgtaatgttattttaacagacgaaactggtaaatggggtgttgaaaataatgaatggtgtggtattcgtaatgattgtaa

SEQ ID NO: 19062 - DNA, 129 bp, Anaeromyces robustus
  Cellulose docking domain, dockering
ttcagctaaatttacttcacttggttattcatgttgtagtgataataattgtgttgtctataccgtagattcaaccggtaattggggtgtagaaaataatgaatggtgtggtatttctaatagttgtaa

SEQ ID NO: 19063 - DNA, 120 bp, Anaeromyces robustus
  Cellulose docking domain, dockering
ttcttctcgtattttaaatcaaggttataaatgttgttccgataattgtaaggtagtttataccgatgaagatggtacatggggttatgaaaataatcaatggtgtggatgtactataaa

SEQ ID NO: 19064 - DNA, 123 bp, Anaeromyces robustus
  Cellulose docking domain, dockering
atgtttggctgaattaataggttatccatgttgtccatctataattaaaacaatttatgcccaagatgaatatggagattggggatttgatttcaaaaaacaagaatggtgtggacttacacc

SEQ ID NO: 19065 - DNA, 117 bp, Anaeromyces robustus
  Cellulose docking domain, dockering
atgttggtcaaaaatatatggatactcatgttgtaaaagatgtatggtatatgaaactgatgaaaatggtaaatggggttttgaatctaatcaatggtgtggtattccagctagctg

SEQ ID NO: 19066 - DNA, 120 bp, Anaeromyces robustus
  Cellulose docking domain, dockering
ttgttgggcttatcaatatggattccaatgttgtttctattacacaaaaccatatcttgtcgatgaacgtggttcatggtcatttgaacgtggtaattggtgtggtattgtcacaaatga

SEQ ID NO: 19067 - DNA, 117 bp, Anaeromyces robustus
  Cellulose docking domain, dockering
atgttggtcaaaaaaattaggctattcatgttgtgaagaatcaaaagaagttttctatgaagatcaagatggtaaatggggttatgaaaaagataattggtgtggtatagtggaagc

SEQ ID NO: 19068 - DNA, 114 bp, Anaeromyces robustus; identical to SEQ ID NO: 16531
  Cellulose docking domain, dockering

SEQ ID NO: 19069 - DNA, 99 bp, Anaeromyces robustus
  Cellulose docking domain, dockering
ctatgaaccttgttgtaaaaatgataataccccagtagtttattttaatatggatggaagattaggaatggaagatggtcattattgtggaattaaagg

SEQ ID NO: 19070 - DNA, 129 bp, Anaeromyces robustus
  Cellulose docking domain, dockering
ttgttggggggaaaaattaggatacccttgttgtccaccaacaaattgtagaattttttatgttaatgatgatggtgactggggatttcataattataaatggtgtgccattgataaaaaaatatgtga

SEQ ID NO: 19071 - DNA, 129 bp, Anaeromyces robustus
  Cellulose docking domain, dockering
ttgttgggcaaaaaaatttggttatgaatgctgtccacctggagtttgtgaagtttctcaaaaagatgaaaatggttcatggggtgcatatgatggagaatggtgtggaattataccatcttattgtca

SEQ ID NO: 19072 - DNA, 114 bp, Anaeromyces robustus
  Cellulose docking domain, dockering
ttcattattaggttatccatgttgtaaaagatgtgattcatttttacttacagacgatgatgctaattggggtgttgaaaattcagaatggtgtattataaaaagcaactgtga

SEQ ID NO: 19073 - DNA, 129 bp, Anaeromyces robustus
  Cellulose docking domain, dockering
ttgttggtcagaatctcttggttataaatgttgttcagcaggatgtaaagcagcttctatttttgtagattcagatggttcatggggtgttgaaaatggagaatggtgtggtattccatcagaatgttc

SEQ ID NO: 19074 - DNA, 123 bp, Anaeromyces robustus
  Cellulose docking domain, dockering
ttgttggtctgaagaaataggttatccatgttgtaaaacatgtgatgtattttacgaagaagattatgaaggtaggtggggtatagaaaatgataattggtgtggtattcctacttcatgctc

SEQ ID NO: 19075 - DNA, 123 bp, Anaeromyces robustus
  Cellulose docking domain, dockering
ttgtttagctgaattattaggatattcttgttgttcacctgaaaatactaacatatatttacaagatgaaaatggtgattggggttttgattttgaaaaaaatgaatggtgtggtcttacacc

SEQ ID NO: 19076 - DNA, 123 bp, Anaeromyces robustus
  Cellulose docking domain, dockering
ttgttggtccgaagctcttggtttcccatgttgtagtactaacggttgtcaagtcgtttattacactgataccgatggtaagtggggtgttgaaaacaacaattggtgtggtattactgctgc

SEQ ID NO: 19077 - DNA, 117 bp, Anaeromyces robustus
  Cellulose docking domain, dockering
atgttggtcagaaagattaggttacccatgttgtaagggtaatgtagttgtcacctccgatgctgatggtgattggggtgttgaaaacaacaattggtgtggtattatcaagtcttg

SEQ ID NO: 19078 - DNA, 120 bp, Anaeromyces robustus
  Cellulose docking domain, dockering
atgtaatacatataataataaatatccatgttgtagtcactgtaatgtttatcacacagatactgatggcagcagatggggtattgaaaatgataactggtgttctattaattattcatg

SEQ ID NO: 19079 - DNA, 126 bp, Anaeromyces robustus
  Cellulose docking domain, dockering
ttgctggtctgagactttaggttatacttgttgtaagagttcttgtgatatttattatactgatcaagatggccattggggtgttgaaaataatcaatggtgtggtataattgatagtgtttgtag

SEQ ID NO: 19080 - DNA, 117 bp, Anaeromyces robustus
  Cellulose docking domain, dockering
ttgttgggctgaaaaattaggttatccatgttgtaaaggtaatgaaccaaaagttgaatttactgatgaatatggagattggagtaccgaagatggtcaaaaatgtggtattttagt

SEQ ID NO: 19081 - DNA, 111 bp, Anaeromyces robustus
  Cellulose docking domain, dockering
gagtttcttattaggttatgatacttgtaaagaacaacatgaatacatatataaagataatgaaggattatggagtatagaaggtggaaaatggtgtggtatacaatattg

SEQ ID NO: 19082 - DNA, 120 bp, Anaeromyces robustus
  Cellulose docking domain, dockering
ttgtagaagtgctttaaatggttatatgtgttgtaaaaatactgataaagttgtttacagagatgattttggatcatggggtatagaaaatggacaatggtgtggttttaatgaaaaata

SEQ ID NO: 19083 - DNA, 102 bp, Anaeromyces robustus
  Cellulose docking domain, dockering
ttatccatattgtgatggatgtgaaacaaattatactgataaagatggtggttggtattacactaataaaacttggtgtaaagttaatgaaaagaaatgttt

SEQ ID NO: 19084 - DNA, 99 bp, Anaeromyces robustus
  Cellulose docking domain, dockering
aggatatcaatgttgtaaagattcttctactaaagttatctctgaagataatgatggtacttggggtattgaaaataaaaaatggtgtcttattcaaac

SEQ ID NO: 19085 - DNA, 120 bp, Anaeromyces robustus
  Cellulose docking domain, dockering
atgttggtctgaagttttcggttacccatgttgtcaaagttgttatgtatatgaagaagatgaaaatggcaaatggggttatgatttcaatgaatctacctggtgtggtattcaatctta

SEQ ID NO: 19086 - DNA, 120 bp, Anaeromyces robustus
  Cellulose docking domain, dockering
ttgttgggttgaacaatttggttatccatgttgtcaaaaaaatgctaaagtttatgctgtagatgatgaaggtgaatggggttataatttcaaaactcaagaatggtgtggtattactcc

SEQ ID NO: 19087 - DNA, 114 bp, Anaeromyces robustus
  Cellulose docking domain, dockering
tccagattatgccacaggatattcctgttgttatgaatgtaatattgtttataatgatggacatgattggggaattgaaaatggtaaatggtgttccattccatattcttgtaa

SEQ ID NO: 19088 - DNA, 102 bp, Anaeromyces robustus
  Cellulose docking domain, dockering
tgcctatgatgaatgtaaatcttgcttaacatattacattgaagatggtgtcaaatggggtgttgaaaacaatgactggtgtcttattccatctaaatgtga

SEQ ID NO: 19089 - DNA, 102 bp, Anaeromyces robustus
  Cellulose docking domain, dockering
acaatatccatgttgtgaaggctgtacagttattgaagaaacagctgaaggtaaatggggtattgaaaatagtcaatggtgtggtattaaagattcttgctt

SEQ ID NO: 19090 - DNA, 114 bp, Anaeromyces robustus
  Cellulose docking domain, dockering
ttgggctggtcaattaggttacccatattgtacttctactactagagaagtttataaggataatgatggtaaatggggtattgaaaacaataattggtgttgtttatcatcatc

SEQ ID NO: 19091 - DNA, 120 bp, Anaeromyces robustus
  Cellulose docking domain, dockering
ttgtttttcaagtaaattaggttatccatgttgttcatcaactaaagttattgtttatcaagataatagtggtaattggggtgttgaaaataatgaatggtgtggaattgatactcaatc

SEQ ID NO: 19092 - DNA, 111 bp, Anaeromyces robustus
  Cellulose docking domain, dockering
ttgttttgcaactagattaggttatgaatgttgtaattataatgaaattctttattcagatgatgatggagattggggtgttaatgataatcgttggtgtggtatcggtgc

SEQ ID NO: 19093 - DNA, 99 bp, Anaeromyces robustus
  Cellulose docking domain, dockering
ttataaatgttgtcaaaaatgtgaaatagtatatgaagataaagaaggtaaatggggagttgaaaatgatgaatggtgtgtcataggaagaaattgttg

SEQ ID NO: 19094 - DNA, 123 bp, Anaeromyces robustus
  Cellulose docking domain, dockering
ttggtctttaaaatatggttatccatgttgtaaagaaaatgctactactattcgtaaagataaaaatggtgaatggggatttgattttcaaaaatttagatggtgtggtatccaaaaaaaaaa

SEQ ID NO: 19095 - DNA, 120 bp, Anaeromyces robustus
  Cellulose docking domain, dockering
atgtttttcactttcagaaggatatccatgttgtgaattttgtatggtagaacaatgtattgataataatttatggggtgtagaaaatggacaatggtgtggtattgctgattcatgtca

SEQ ID NO: 19096 - DNA, 117 bp, Anaeromyces robustus
  Cellulose docking domain, dockering
ttgtttttcattggaaataggattcccatgttgtagagaaggagaaaaaattgtttattctgatgatgatggttattggggtgtagaaaatggtgaatggtgtggtattgatggaaa

SEQ ID NO: 19097 - DNA, 120 bp, Anaeromyces robustus
  Cellulose docking domain, dockering
atgtttctcaattaaattaggatacccatgttgtaaaaaaactactgaagtagctcatattgataaaaatggtaaatggggtattgaagataatcattggtgtggtttaaaagataaaaa

SEQ ID NO: 19098 - DNA, 114 bp, Anaeromyces robustus
  Cellulose docking domain, dockering
ttgttggtctgaacaatatggttatccatgctgtgattctaatgatgttttcttagaagatgaattaggtaaatggggtgttatgaatggttcatggtgtggtattccaaatgc

SEQ ID NO: 19099 - DNA, 111 bp, Anaeromyces robustus
  Cellulose docking domain, dockering
tgaagatcttggttttaaatgttgttcacattgtgttcatatctatgatgataaaactggtttatggggtgtcgaagccaatgaatggtgtggtatctctgatgaatgttt

SEQ ID NO: 19100 - DNA, 123 bp, Anaeromyces robustus
  Cellulose docking domain, dockering
ttgctggtcttcttctttaggttacccatgttgttccaatagtaacacccttgttgaatatacagataatgatggagaatggggtatagaaaatggtatatggtgtggtatagccaaaacgaa

SEQ ID NO: 19101 - DNA, 123 bp, Anaeromyces robustus
  Cellulose docking domain, dockering
tagtagttttgccgctaattcaaattatccagtttgtaaatataatagtatagtttatttcactgatgaagatggtcaatggagtgttgaaaatgataattggtgtttaattccttcttcatt

SEQ ID NO: 19102 - DNA, 108 bp, Anaeromyces robustus
  Cellulose docking domain, dockering
tcataattcaggttatagttgttgtgtttctacaactaaagttttatcaggagatggtacaggtgattggggtgttgaatttaatgactggtgtttatttgatgaatc

SEQ ID NO: 19103 - DNA, 120 bp, Anaeromyces robustus
  Cellulose docking domain, dockering
atgctggtcacttagtcaaggttatccatgttgtgtaaataaaaacacaaaaataaaatctacttctagtaatggagatgaatggggtgttgaaaataatgaatggtgtggtataactga

SEQ ID NO: 19104 - DNA, 123 bp, Anaeromyces robustus
  Cellulose docking domain, dockering
atgttggtctatagctgaaggttttccatgttgtgaaaataaagatactataatttccattattcaatcaggaagaggatggggtgttgaaaatggtcattggtgtggtattatagatgaaga

SEQ ID NO: 19105 - DNA, 102 bp, Anaeromyces robustus
  Cellulose docking domain, dockering
tggggattatccttgttgtaaaggttgtgatgtttattatactgatgatgtagaatggggtattgaaaatggtgattggtgttctattccatatgaatgtaa

SEQ ID NO: 19106 - DNA, 102 bp, Anaeromyces robustus
  Cellulose docking domain, dockering
aaattataaatgttgtaaatcatcttgcagtgtttattatgttgatacggaagaatggggttatgaacatggtgaatggtgtttaattccttataaatgtaa

SEQ ID NO: 19107 - DNA, 123 bp, Anaeromyces robustus
  Cellulose docking domain, dockering
ttgttgggctgaattaattggttatccatgttgtccatcccacaacaaaatagtatacagtcatgatgaaaatggagattggggatatgattataaaactaatcaatggtgtggtattactcc

SEQ ID NO: 19108 - DNA, 114 bp, Anaeromyces robustus
  Cellulose docking domain, dockering
atgttggtcagaaatatatggatactcatgttgtaaaggatgtattatttatgaatcggatgaaaatggtaaatggggttataaaaatggtaaatggtgtggtattccatctta

SEQ ID NO: 19109 - DNA, 117 bp, Anaeromyces robustus
  Cellulose docking domain, dockering
cttttctatcgccttgggatatccatgttgtaaaaaatgtgatgtattattcgttgataaagatggtcaatggggtgtagaagataatgagtggtgtggtataaaggataattgtga

SEQ ID NO: 19110 - DNA, 111 bp, Anaeromyces robustus
  Cellulose docking domain, dockering
agcacttaatccatcttacccatgttgtaaaagtaataaagtcgtctatactgataaaagtggggattggggtgtagaaaatgatcaatggtgtggtattggaaatagtac

SEQ ID NO: 19111 - DNA, 123 bp, Anaeromyces robustus
  Cellulose docking domain, dockering
atgttggtctgaagagcaaggctttccatgttgtaaaggatgtgtagttatttatactgaaaataatgaaaaatggggaatagaaaatgatgaatggtgtggtattaataaaacaacatgtca

SEQ ID NO: 19112 - DNA, 105 bp, Anaeromyces robustus
  Cellulose docking domain, dockering
aaataatgaatatgaatgttgtgaaacttgtacagagtattttagcgataatactggcagatatggatatgaaaatgaaaaatggtgtcttcttaaagatagttg

SEQ ID NO: 19113 - DNA, 123 bp, Anaeromyces robustus
  Cellulose docking domain, dockering
tccttcccatattttagatcaaggttataattgttgtattcatgattgtatttatattacttcagatgaaaatagaaattggagtgttgaaaatggagaatggtgttggtgtattatggataa

SEQ ID NO: 19114 - DNA, 126 bp, Anaeromyces robustus
  Cellulose docking domain, dockering
ctgttggtctattcaatatggttatgaatgttgtaaagatccagaaactccagtatatagtaaagatagtactggggaatggggtattgaaaacaataattggtgtggaattgttaagaataataa

SEQ ID NO: 19115 - DNA, 120 bp, Anaeromyces robustus
  Cellulose docking domain, dockering
atgttggtcggaaagattaggttatccatgttgtaccactacaaaaaaagcttatacagaagattcggatggtaaatggggggttgaaaaaggtaattattgtggtattattgaagaaga

SEQ ID NO: 19116 - DNA, 117 bp, Anaeromyces robustus
  Cellulose docking domain, dockering
ttgctggtcaattccacttggttatccatgttgttctaattcctatcttccaacactttttacagatgataatggtgaatggagtgttgaaaatgataattggtgtggtaaaatcgt

SEQ ID NO: 19117 - DNA, 105 bp, Anaeromyces robustus
  Cellulose docking domain, dockering
tggagtatatgattgttgtccaaaaaatcaacccgtatatgaagaaaattctctcggaaaatggggtaaaattaatggaaattattgtggtataaaaacctctat

SEQ ID NO: 19118 - DNA, 117 bp, Anaeromyces robustus
  Cellulose docking domain, dockering
ttgtttttcagtgaaattaggttatccatgttgtcaatatacagatgaagtagtttatgttgatgatgatggggattggggtgttgaaaataatgactggtgtggtattggtgaaga

SEQ ID NO: 19119 - DNA, 108 bp, Anaeromyces robustus
  Cellulose docking domain, dockering
ggttgaaggttatgaatgttgtgaaggatgtacagttgaatctgaagaagataatattaaatggggttatgaaaatagaaattggtgtgtaattccatattcctgtaa

SEQ ID NO: 19120 - DNA, 114 bp, Anaeromyces robustus
  Cellulose docking domain, dockering
aacaagatttggatatccctgttgtgatacatgtaaattagaatatattgatgattttggtgattggggattcgaaaatgataattggtgtggtctttcacaaaacctatgtaa

SEQ ID NO: 19121 - DNA, 108 bp, Anaeromyces robustus
  Cellulose docking domain, dockering
gaaattgggatatagatgttgtaatacatgtaaaattgaatatattgataataatattaaatatggttatgaaaatggtgaatggtgtggtattccagatgaatgtta

SEQ ID NO: 19122 - DNA, 123 bp, Anaeromyces robustus
  Cellulose docking domain, dockering
atgttgggctgaatttattggatatccatgttgttcagaaaaggatacatatgtttacgatacagatagttatggtgattggagttatgatttcgataataatgaatggtgtggtcttactcc

SEQ ID NO: 19123 - DNA, 114 bp, Anaeromyces robustus
  Cellulose docking domain, dockering
atgttggtcagaaattatcggatattcatgttgtaagggttgtaccgtttatgaagaagatgaatttggtaaatggggttatgaaaagaaccactggtgtggtattcaatcctt

SEQ ID NO: 19124 - DNA, 120 bp, Anaeromyces robustus
  Cellulose docking domain, dockering
ttgttggtcagcaaaacttggttacccatgttgtaaatcaactacagcagtcgaaatgtcagatagtgatggtcaatggggtgttgaaaatggacaatggtgtggtattcaaaaaactca

SEQ ID NO: 19125 - DNA, 120 bp, Anaeromyces robustus
  Cellulose docking domain, dockering
ttgttgggcaacacgtcttggttttccatgttgtgaatattctgcacaagttttttatacagataatgatggtaagtggagtattgaaaatggtgaatggtgtggtataattgaaaatca

SEQ ID NO: 19126 - DNA, 123 bp, Anaeromyces robustus
  Cellulose docking domain, dockering
ttgttgggctacttctataggttatggatgttgtaatcactgtaattctatatatacagatggtacatacagatggggtgttcaaaataatcaatggtgtggtattattgaatccaattgtaa

SEQ ID NO: 19127 - DNA, 123 bp, Anaeromyces robustus
  Cellulose docking domain, dockering
ttgttggtcagtttcagaaggatataaatgttgtagcttaggtactaaaacagtacttactgatagtaaaggtaaatggggtattgaaaataatgaatggtgtggtatttccaatgaaaaagc

SEQ ID NO: 19128 - DNA, 105 bp, Anaeromyces robustus
  Cellulose docking domain, dockering
tacaaagcttggatattcttgttgtaaaacttgtatggtagctttaactgataaagatggtaaatggggtgttgaaaataagaactggtgtggaattgattcagt

SEQ ID NO: 19129 - DNA, 129 bp, Anaeromyces robustus
  Cellulose docking domain, dockering
atgttgggctgaaaaatacggaagaccttgttgtaaaaacagttcaactaaaaatgtttatactgataatgaaggtatgtggggtgttgaaaatgatgaatggtgtggtataactgaagaacaatgttg

SEQ ID NO: 19130 - DNA, 129 bp, Anaeromyces robustus
  Cellulose docking domain, dockering
atgttgggccaaaaaatacggaagaccttgttgtttaaataatttaactgaatatgtttatgctgatgatgaaggtatgtggggtgttgaaaacggtgattggtgtggtataaatgaacatcaatgttg

SEQ ID NO: 19131 - DNA, 120 bp, Anaeromyces robustus
  Cellulose docking domain, dockering
atgttgggcccaaaaattaggatttaaatgttgtaagaatccaaatgcaacagttattaacattgatgaagacggtacaaaatggggtattgaaaatgatgaatggtgtggtattttaga

SEQ ID NO: 19132 - DNA, 111 bp, Anaeromyces robustus
  Cellulose docking domain, dockering
atctgacaaagaagaagataattgctgtaaaaccaatactgaaattctctattcagatgatgaaggtgcatggggttatgaaaatgatgcctggtgtattgtaagaaaatt

SEQ ID NO: 19133 - DNA, 123 bp, Anaeromyces robustus
  Cellulose docking domain, dockering
atgtaaatctgaaaaactcggtattgaatgttgtaaagatatttcaactgaaaatgtttatactgatgatgaaggtattaagtttggtgttgaaaaagatgattggtgtggtattaaggatat

SEQ ID NO: 19134 - DNA, 105 bp, Anaeromyces robustus
  Cellulose docking domain, dockering
acaatatccatgttgtaatggctgtgatgttaaatacactgataacagtggtaaatggggtgttgaaaataataattggtgtaaaatagataataataaatgtaa

SEQ ID NO: 19135 - DNA, 120 bp, Anaeromyces robustus
  Cellulose docking domain, dockering
atgtaaatttgaagctcttggttacccatgctgttcacactgtgagtctatttatgaagataattcaggtaaatggggtgttgaaaataataattggtgtggtattccagatacatgtga

SEQ ID NO: 19136 - DNA, 126 bp, Anaeromyces robustus
  Cellulose docking domain, dockering
atgttgggctgattattttaattataaatgttgtagtaccagaaattgtagaagcgtttatcttacagatgcaaatggagattgggatatagaagatggtcaatggtgtggtattacatctaaaaa

SEQ ID NO: 19137 - DNA, 123 bp, Anaeromyces robustus
  Cellulose docking domain, dockering
ttgttggtctcttaaattaggttattcatgttgtacatcaaatgatattattttatattctgatgcagatggtgattggagtgtagaaaataatgagtggtgtggtataattaaaagtaataa

SEQ ID NO: 19138 - DNA, 111 bp, Anaeromyces robustus
  Cellulose docking domain, dockering
ttggtcaaaagaattaggttttccatgttgtaaaggatgtttagttattgataaagatgaatttggatcatggggatttgaattagatcattggtgtggtattcaatccta

SEQ ID NO: 19139 - DNA, 123 bp, Anaeromyces robustus
  Cellulose docking domain, dockering
atgttgggcacaattagtaggttatggatgttgtccagaaggtacaaatgatgtatattatgaagatagttatggtaaatggggtatagatcttaaaaaggaagattggtgtggtattacccc

SEQ ID NO: 19140 - DNA, 120 bp, Anaeromyces robustus
  Cellulose docking domain, dockering
atgttgggcaagtagtttaggtttcccatgttgtcaatcctctaaagtagttttccgtacggattctaatggttcatggagtcttgaaaatgatgaatggtgtggtattatagaagaaga

SEQ ID NO: 19141 - DNA, 120 bp, Anaeromyces robustus
  Cellulose docking domain, dockering
ttgttgggctgaacttttaggatataattgttgtaaaagtaagaatccaattattattcaaactgatgaatatggtgattgggcaattgaaaagaataattggtgtggtattccaggtag

SEQ ID NO: 19142 - DNA, 123 bp, Anaeromyces robustus
  Cellulose docking domain, dockering
atgttgggctaaaaaaattggatatgaatgttgtaaagattctaaaacttatgccatatataccgataataatggagattggggtgttgaaaatgaagtatggtgtggtattattaagaaaaa

SEQ ID NO: 19143 - DNA, 117 bp, Anaeromyces robustus
  Cellulose docking domain, dockering
atgttgggctaaatctttaggttataaatgttgtaccagtaaagccatttattatgcctccgataatgatggtgattggggtattgaaaatgatgattggtgtggtattattaaagg

SEQ ID NO: 19144 - DNA, 111 bp, Anaeromyces robustus
  Cellulose docking domain, dockering
ttgttgggcttatcaattaggttataaatgttgtaaaaaaagtgaaacagtagaagtagaaagtggttatggtgtacttaatggtaattggtgtggtattattgatgataa

SEQ ID NO: 19145 - DNA, 123 bp, Anaeromyces robustus
  Cellulose docking domain, dockering
atgttgggctaaaagtttaggatttaaatgttgtactggttcaaaaccaaccgtagtttatacagataataatggagattggagtgtagaaaatgatgaatggtgtggtattattaaaaatgg

SEQ ID NO: 19146 - DNA, 120 bp, Anaeromyces robustus
  Cellulose docking domain, dockering
ttgttgggctaataaatttggatatgattgttgtaaatcaggtgccgtatttgttactaaagatagtgatggagattggggtattgaaaatggtaaatggtgtggatttaaaaagaatat

SEQ ID NO: 19147 - DNA, 114 bp, Anaeromyces robustus
  Cellulose docking domain, dockering
ttggtcagaagtatttggttatccatgttgtgaaagttgttacgtttttgaaactgatgattatggaaaatggggttatgaaaataatcattggtgtggtattcaatcttactg

SEQ ID NO: 19148 - DNA, 123 bp, Anaeromyces robustus
  Cellulose docking domain, dockering
atgttgggctgaacttgctggttacccatgttgttctgaaagaataaagattgtttatgaacatgatgaatttggtgattggggttatgattactctattaaacaatggtgtggtcttactcc

SEQ ID NO: 19149 - DNA, 120 bp, Anaeromyces robustus
  Cellulose docking domain, dockering
atgtttatcagaattaatcggatatgcatgttgttcattagaattaacatccatttatactgatgaatatggagattggggttatgattataataaaaaagaatggtgtggccttacacc

SEQ ID NO: 19150 - DNA, 120 bp, Anaeromyces robustus
  Cellulose docking domain, dockering
ttgctggtcaaaaaaattaggatattcatgttgtgaaggatgtaaagttattgaaacagatgaagatggatcatggggatatgaatatgatcaatggtgtggtattccattaaactgtca

SEQ ID NO: 19151 - DNA, 120 bp, Anaeromyces robustus
  Cellulose docking domain, dockering
atgttggtcacttaaacttggatataaatgctgtaagaaaaacaatatggttgttttaactgatacagatggtcaatggggtgtagaaaataatgaatggtgtggaattgtacatagttc

SEQ ID NO: 19152 - DNA, 120 bp, Anaeromyces robustus
  Cellulose docking domain, dockering
atgttggtctaagaaacttggttataattgttgtactgcaaaatgcccaaaagaatattatattgataatgatggaagttggggtgttgaaaataataattggtgtggtattctaaaatt

SEQ ID NO: 19153 - DNA, 120 bp, Anaeromyces robustus
  Cellulose docking domain, dockering
atgtccaggaaagaaatatggttattcatgttgtgaaacctgtgatgtttatttaaatgatgatgaaggtaaatggggtgttgataatggatattggtgcagtattaaaactagctgtca

SEQ ID NO: 19154 - DNA, 123 bp, Anaeromyces robustus
  Cellulose docking domain, dockering
atgttggtctgaagctttaggttacaaatgttgttcaaaaggttgtgatgctgtagttttagctattgacaatagtggtaactggggagctgaaaatggtgaatggtgtggtattcaatgtga

SEQ ID NO: 19155 - DNA, 123 bp, Anaeromyces robustus
  Cellulose docking domain, dockering
atgttggtctgaacttattggatatccatgttgttcagaaggaaataatatggtatatggtcatgatgattatggggattggagttacgattttcaaaagaatatatggtgtggtcttgatgc

SEQ ID NO: 19156 - DNA, 117 bp, Anaeromyces robustus
  Cellulose docking domain, dockering
atgttggtcagaaatttttggttatccatgttgtaaaagttgtgttgtttatgaagaagaagaagaatatggtaaatggggttatgaaaataatcaatggtgtggtattcaatcttt

SEQ ID NO: 19157 - DNA, 117 bp, Anaeromyces robustus
  Cellulose docking domain, dockering
ctgttgggcaaataatttaggttatccatgttgttcaagtaatactcaagtaatttatacagataataatggtcaatggggtgttgaaaacaataattggtgtggtattgttaatgg

SEQ ID NO: 19158 - DNA, 120 bp, Anaeromyces robustus
  Cellulose docking domain, dockering
ttgcttttcaactagattaggttacccatgctgtactaaaactacagctgttgtttaccatgacaatgatggtgactggggtgttgaagacaatcattggtgtggtctttcaaatcaaag

SEQ ID NO: 19159 - DNA, 123 bp, Anaeromyces robustus
  Cellulose docking domain, dockering
atgttggtcagaatctcaaggttacaagtgttgtaaaacatgtgttgttgtttacgttgatgaatttggatcttggggtgttgaaaatgatcaatggtgtggtgttaaagctgatgcttgtca

SEQ ID NO: 19160 - DNA, 123 bp, Anaeromyces robustus
  Cellulose docking domain, dockering
ttgttggtcaagcggttatggctacccatgttgtactacatgtaaggtttattacgaagattactctggtgaatggggtgtagaaaatggcgattggtgtggtatcgttagtcaatattgtgg

SEQ ID NO: 19161 - DNA, 117 bp, Anaeromyces robustus
  Cellulose docking domain, dockering
ttgctgggctgaaaaattaggttactcttgctgtacttctacttctcaagttgtttacactgatggtgatggtaactggggtgttgaaaacggtaactggtgtggtattccagttcc

SEQ ID NO: 19162 - DNA, 126 bp, Anaeromyces robustus
  Cellulose docking domain, dockering
ttgtttttctgaatctttaggatatccatgttgtagaaaacaaaatccaaaagtttattatactaatgaagatggagaatggagtgttgaaaatggtaaatggtgtggtgttattaaatcaaaaca

SEQ ID NO: 19163 - DNA, 108 bp, Anaeromyces robustus
  Cellulose docking domain, dockering
tccaaatcttggatacccatgttgtaatgattgtagagttgtttaccaagatgaatataactggggtgttttaaataaccaatggtgtgtaactccatattcatgtga

SEQ ID NO: 19164 - DNA, 124 bp, Anaeromyces robustus
  Cellulose docking domain, dockering
ttgctgggctacagctcatggatataactgttgttcaggatgtaaagtaatttttgaagaaactgaaacaatgaaatggggtgttgaaaatcatgaatggtgtggtattgttaactcaaattgt

SEQ ID NO: 19165 - DNA, 117 bp, Anaeromyces robustus
  Cellulose docking domain, dockering
atgcttttcatcaaaattaggttatccatgttgtacatctactacagatatttattattctgataatgatggaaaatggggtattgaaaatggtaattggtgtggaattgttgaaac

SEQ ID NO: 19166 - DNA, 120 bp, Anaeromyces robustus
  Cellulose docking domain, dockering
ttgttgggctactgctttaggatacccatgttgtacaactactactgatgttgtctttactgacaatagtggtgattggggtgttgaaaaaggtaattggtgtggtattgttaagtctag

SEQ ID NO: 19167 - DNA, 126 bp, Anaeromyces robustus
  Cellulose docking domain, dockering
ttgttgggctgaagtacttggattcccatgttgtagcaccgataaatgtagaactgtctatttcactgatgatgatggtgaatgggatgttgaaaacaataattggtgtggtattactgcttctaa

SEQ ID NO: 19168 - DNA, 90 bp, Anaeromyces robustus
  Cellulose docking domain, dockering
aaaatataaatgttgtaaaagttgtgatatattttatgttgataattataaatggggtgttgaaaataatgaatggtgttctattccatt

SEQ ID NO: 19169 - DNA, 123 bp, Anaeromyces robustus
  Cellulose docking domain, dockering
atgttggtcagaagttcatggttatccatgttgtgaattaaaaaccactcaagttgaatttacagatagtagtaccggtgaacaatatggaattgaaaatggccgtatttgtggtataaacga

SEQ ID NO: 19170 - DNA, 99 bp, Anaeromyces robustus
  Cellulose docking domain, dockering
agcttcttacccatgctgtgaaaatacttgtgctgttcaatatactgacgctgatggtcaatggggtattgaaaatggaaattggtgtggtatgagtag

SEQ ID NO: 19171 - DNA, 99 bp, Anaeromyces robustus; identical to SEQ ID NO: 19170
  Cellulose docking domain, dockering

SEQ ID NO: 19172 - DNA, 114 bp, Anaeromyces robustus
  Cellulose docking domain, dockering
atgtttttctgaaaatcttggttataaatgttgtaaaggtaatacaatttattacactgataataatggtgcatggggtattgagaatggtgaatggtgtggtattgaaaacgg

SEQ ID NO: 19173 - DNA, 114 bp, Anaeromyces robustus
  Cellulose docking domain, dockering
tttttcagtaaaacttggttttaaatgttgtaaaggtaataatattatttatactgataaagatggtgattggggtgttgaagatgatgaatggtgtggtatttccaataaaag

SEQ ID NO: 19174 - DNA, 111 bp, Anaeromyces robustus; identical to SEQ ID NO: 16637
  Cellulose docking domain, dockering

SEQ ID NO: 19175 - DNA, 114 bp, Anaeromyces robustus
  Cellulose docking domain, dockering
tgttgaagatatgggttacactatttgtcccgtaggaactaaaataacttatgctaatacgcaggccacttggggtaaaaataatgatgattggtgtgtaatccttgaaaagaa

SEQ ID NO: 19176 - DNA, 123 bp, Anaeromyces robustus
  Cellulose docking domain, dockering
ttgtattgctgaattaattggttataaatgttgttcaccaaataatactaaagtatatgcacatgatgaaaatggtgattggggttatgattttaaaaaaggagaatggtgtggtcttactcc

SEQ ID NO: 19177 - DNA, 117 bp, Anaeromyces robustus
  Cellulose docking domain, dockering
ttgttggtctgaaatttttggttattcatgttgtaaaggatgtactatttatgaagttgataatgatggttcatggggttatgaaaatggagaatggtgtggtattcaatcctattg

SEQ ID NO: 19178 - DNA, 103 bp, Anaeromyces robustus
  Cellulose docking domain, dockering
ttgttggtctgttgatttaggttatccatgttgtaaatctactaatgaagtttatgtaactgatgaaaatggtaaatggggtttagaaaataataactggtgt

SEQ ID NO: 19179 - DNA, 117 bp, Anaeromyces robustus
  Cellulose docking domain, dockering
atgtttctccttagcattaggttattcttgttgtcaaaaaactactgccgttatttatgaagataaagatggtaaatggggtattgaaaataatcaatggtgtggtattaaaccaac

SEQ ID NO: 19180 - DNA, 120 bp, Anaeromyces robustus
  Cellulose docking domain, dockering
atgttggtctacagctttaggttacccatgttgtactaatgcaaatttagatgtacttttcactgatgatgatggtgattggtctatcgaaaataataactggtgtggtataagaaaagt

SEQ ID NO: 19181 - DNA, 120 bp, Anaeromyces robustus
  Cellulose docking domain, dockering
atgctggtctcttatattaggttataagtgctgtagttcatgcttacctattgtggaaacagatagtagtggtaattggagtattgaagataatcaatggtgtggtcttgaagaaagatg

SEQ ID NO: 19182 - DNA, 126 bp, Anaeromyces robustus
  Cellulose docking domain, dockering
atgtttttcagaacgtttaggtttcccatgttgtccacctggtacaaaagttgaatactctgatgaggaaggggattggggtattataaacgaagaatggtgtggtattagtgatcgtggatgttg

SEQ ID NO: 19183 - DNA, 120 bp, Anaeromyces robustus
  Cellulose docking domain, dockering
atgttgggctgaagaatttggttatccatgttgttcaaatcttaataataaaattgtttattacattgatgaatatggtaataaatggggtgttgaaaatgatgattggtgtggtttaat

SEQ ID NO: 19184 - DNA, 117 bp, Anaeromyces robustus
  Cellulose docking domain, dockering
ttgttgggcagaaaaattaggttatccttgttgttcttcttctaaaaatgtattatttgaagataatgatggtcaatggagtgttgaaaatgataattggtgtggtattccaaaagg

SEQ ID NO: 19185 - DNA, 120 bp, Anaeromyces robustus
  Cellulose docking domain, dockering
atgttggtctgaagctttaggttacccatgttgttctacttgttccagtcctgtctacagtgataatgatggtaactggggtgttgaaaatggtgactggtgtggtattactaaggctca

SEQ ID NO: 19186 - DNA, 126 bp, Anaeromyces robustus
  Cellulose docking domain, dockering
ttgttgggctgctgccttaggttataaatgttgtaatcattgtaatgtagttgaaactgatgatcaagatcatgaatggggttcattgaatggtgaatggtgtggtattaatgtaactatgtgtaa

SEQ ID NO: 19187 - DNA, 79 bp, Anaeromyces robustus
  Cellulose docking domain, dockering
tgattatccatgttgtagtcattgtgatgtattatttactgatagaactgctcgttggggtattgaaaacaatgattgg

SEQ ID NO: 19188 - DNA, 114 bp, Anaeromyces robustus
  Cellulose docking domain, dockering
ttgtttttcagagagacttggttatccatgttgtaaatacactagcaaagttgaatacgttgatgccgatggtgactggggtgttgaaaacggtgactggtgtggtatgccaga

SEQ ID NO: 19189 - DNA, 114 bp, Anaeromyces robustus; identical to SEQ ID NO: 19188
  Cellulose docking domain, dockering

SEQ ID NO: 19190 - DNA, 114 bp, Anaeromyces robustus
  Cellulose docking domain, dockering
atgttgggctgaagcttatggttatagttgttgtagtaaatgtgttaaagttattgatacctcatataataaaaaatggggtttagaaaatggaaaatggtgtggtcttccatc

SEQ ID NO: 19191 - DNA, 105 bp, Anaeromyces robustus
  Cellulose docking domain, dockering
ttctccagcttataaatgttgttcatcatgtattgtttatttcgaagataattataaatggggaactatgaatggtgaatggtgtagtcttacttatgattgtct

SEQ ID NO: 19192 - DNA, 93 bp, Anaeromyces robustus
  Cellulose docking domain, dockering
taaatgttgtaatagttgtgatatagtttatacggattttcaatattggggttatgaaaataatgaatggtgttctattccttattcttgtac

SEQ ID NO: 19193 - DNA, 117 bp, Anaeromyces robustus
  Cellulose docking domain, dockering
ttgtttttctgttgctatgggatacccatgttgtacaggaaataaaattgtctatacggataaaagtggaaattggggtatagaaaataataaacggtgtggtattggtgatagttc

SEQ ID NO: 19194 - DNA, 108 bp, Anaeromyces robustus
  Cellulose docking domain, dockering
aacattaaaaccttcttatccatgttgtaaaggtaataaagttgtttataccgataaaaatggaaattggggtttcgaaaataataaatggtgtggtattggtaatgg

SEQ ID NO: 19195 - DNA, 114 bp, Anaeromyces robustus
  Cellulose docking domain, dockering
atgttggtcaaaggctcaaggttatgattgttgtgctgaaggaacttccgttttccttgaagatgaaagtggtgattggagtgctgacaatggtgaatggtgcggtgttataaa

SEQ ID NO: 19196 - DNA, 57 bp, Anaeromyces robustus
  Cellulose docking domain, dockering
tgaaagtggtgattggagtgctgacaatggtgaatggtgtggtgttataaagagtac

SEQ ID NO: 19197 - DNA, 120 bp, Anaeromyces robustus
  Cellulose docking domain, dockering
ttgttggtctgagaccctgggttatccatgttgtaatactaatggatgtcaaactatttatttcatcgattcaaatggtatgtggagtgttgaaaatgataattggtgtggtataactcc

SEQ ID NO: 19198 - DNA, 123 bp, Anaeromyces robustus
  Cellulose docking domain, dockering
ttgttgggctcatagattaggttttcaatgttgtaaaaattataaaattgaagttgcctattctgattctgatggtgattggggtatcgaaaatggtgaatggtgcggtattgacaatacttg

SEQ ID NO: 19199 - DNA, 108 bp, Anaeromyces robustus
  Cellulose docking domain, dockering
aattcttgaccaaggatacaaatgctgttctgataattgtataatttattataatgatgaagatggtgattggggtgtcgaaaatggtgaatggtgtggttgtggtgg

SEQ ID NO: 19200 - DNA, 123 bp, Anaeromyces robustus
  Cellulose docking domain, dockering
ttctgctaatattcttaaacaaggttataaatgttgtccagataactgtgtagtaacatatgtagatgctgatggtgattggagtatcgatggtcaagaatggtgtggttgtggtaatagaaa

SEQ ID NO: 19201 - DNA, 108 bp, Anaeromyces robustus; identical to SEQ ID NO: 19199
  Cellulose docking domain, dockering

SEQ ID NO: 19202 - DNA, 123 bp, Anaeromyces robustus; identical to SEQ ID NO: 19200
  Cellulose docking domain, dockering

SEQ ID NO: 19203 - DNA, 105 bp, Anaeromyces robustus
  Cellulose docking domain, dockering
aagttctggttataaatgttgtcctaacgctaaagaagtacaatcagatgataatggatcatggggttatgttgatggtcaatggtgtggtattagtccaaaaaa

SEQ ID NO: 19204 - DNA, 117 bp, Anaeromyces robustus
  Cellulose docking domain, dockering
atttttaggatctccatatccatgttgtagtccagacaatcaaaaaatagaatttattgatcatgatggtttatggggtagagaaaacggtaaatggtgtggaataatgaatagtaa

SEQ ID NO: 19205 - DNA, 129 bp, Anaeromyces robustus
  Cellulose docking domain, dockering
ttgctggtcaactaaattaggatatccatgttgtagtgccggtaacaaagatgtttattataatgacgatgatggattatggggtgttgaaaataataactggtgtggtattccttctaattcttgctg

SEQ ID NO: 19206 - DNA, 99 bp, Anaeromyces robustus
  Cellulose docking domain, dockering
tggatatcaatgttgtaaagattcatccactcaagttatcttaacagatgatgatggtacttggggtattgaaaataatcattggtgtcatattaaaac

SEQ ID NO: 19207 - DNA, 102 bp, Anaeromyces robustus
  Cellulose docking domain, dockering
ttatccatattgtgatggatgtgatgcaaattatgttgataaagatggtcgttggaatttagttgataaaacatggtgtaaagttaaggaaaagaaatgttt

SEQ ID NO: 19208 - DNA, 120 bp, Anaeromyces robustus
  Cellulose docking domain, dockering
ttgttggtcaaatgcattaggatatgaatgttgtaaaggatgtactgtaattgaatcggatgcaagtggtgattggggtattgaaaataatcaatggtgtggtattccatcttcatgtaa

SEQ ID NO: 19209 - DNA, 120 bp, Anaeromyces robustus
  Cellulose docking domain, dockering
atgctggtcattaaaacatggatatccatgttgtcaaaaaactaaagttgttactcttgaagatgaaaatggaaaatggggtgttgaaaatgatgattggtgtggtattattgatgaacc

SEQ ID NO: 19210 - DNA, 120 bp, Anaeromyces robustus
  Cellulose docking domain, dockering
atgtccatttgaaaaatatggttatccatgctgtgaaataactaatattgttgtatacacagatgatatgggtaaatggggtattgaaaatgatgtatggtgtggtattgttgaaaatga

SEQ ID NO: 19211 - DNA, 123 bp, Anaeromyces robustus
  Cellulose docking domain, dockering
ttgtaccgctcaagaccaaggatataaatgttgttctacctgtaatgtagtttacactgatgaatctggtgactggggtgttgaaaataatgaatggtgtttaattaagaaatctaaatgtgg

SEQ ID NO: 19212 - DNA, 124 bp, Anaeromyces robustus
  Cellulose docking domain, dockering
atgttggtcagaaagatttggttatccatgttgtacttcttcatgtcatgtttatgaaactgatgataatggtgaatggggttatgaaaatcaacactggtgtggtattttaaaagaaaattgt

SEQ ID NO: 19213 - DNA, 120 bp, Anaeromyces robustus
  Cellulose docking domain, dockering
atgttggtctgaagtttttggttttccatgttgtacttcttcatgtcatgtttatgaaattgatgatagtggtgaatggggttatgaagataatcattggtgtggtattccatctacttg

SEQ ID NO: 19214 - DNA, 106 bp, Anaeromyces robustus; identical to SEQ ID NO: 16676
  Cellulose docking domain, dockering

SEQ ID NO: 19215 - DNA, 129 bp, Anaeromyces robustus
  Cellulose docking domain, dockering
ttgttggtctgaaaaattaggttacccatgttgtccagctaatcgttgtagagtttatactaccgataaggatggaaaatggggttacactaaaaacagttggtgtggtattgatgaagaagtttgtaa

SEQ ID NO: 19216 - DNA, 126 bp, Anaeromyces robustus
  Cellulose docking domain, dockering
atgttggtcagaattaattggatatccatgttgtgattcttccgtaacaaccgtatttgttcaagatgattatggagattggggatatgattttaataaaaatgaatggtgtggaataacttccta

SEQ ID NO: 19217 - DNA, 108 bp, Anaeromyces robustus
  Cellulose docking domain, dockering
aggttcaggttatgcttgttgtaaatttaatactactactgttactactaccgattatactggtaaatggggtattgaaggtttaagatattgtcttatcgatgaaga

SEQ ID NO: 19218 - DNA, 111 bp, Anaeromyces robustus
  Cellulose docking domain, dockering
aaaaggatatccatgttgtactaaaaagacaagtaatgttaattatattagtaaaaatggagatcaatatggttatgaaaataataaatggtgtggtataacaactattca

SEQ ID NO: 19219 - DNA, 99 bp, Anaeromyces robustus
  Cellulose docking domain, dockering
aaaatacaagtgttgtaattcttgtaaagttcgttacaccgatgactatgaatggggtgttgaaggtggtgaatggtgttctattccttactcttgtaa

SEQ ID NO: 19220 - DNA, 99 bp, Anaeromyces robustus
  Cellulose docking domain, dockering
aaaatacaagtgttgtaattcttgtaaagttcgttacaccgataattatgaatggggtgttgaagatggtgaatggtgttctattccttactcttgtaa

SEQ ID NO: 19221 - DNA, 126 bp, Anaeromyces robustus
  Cellulose docking domain, dockering
atgttggtcagaattaattggatataaatgttgtgctcctaatgttactgcaatttatgcaagtgatgaatatggatattggggttatgactttgaaaataatgaatggtgtggtattaccactta

SEQ ID NO: 19222 - DNA, 120 bp, Anaeromyces robustus
  Cellulose docking domain, dockering
ttgttggtcacaaaaatatggttatccatgttgtcaaacttgtatagtatatcataatgataatgaaggttcatggggatatgaatataacggttggtgtggtattccaactcattgtaa

SEQ ID NO: 19223 - DNA, 126 bp, Anaeromyces robustus; identical to SEQ ID NO: 19221
  Cellulose docking domain, dockering

SEQ ID NO: 19224 - DNA, 120 bp, Anaeromyces robustus
  Cellulose docking domain, dockering
atgttggtctgaaaaaatcggatataaatgttgtactgatgcagaaatttatttaacagacacatttggacattggagtattgaagatggagaatggtgtcttgttaaacgaagttgttt

SEQ ID NO: 19225 - DNA, 126 bp, Anaeromyces robustus
  Cellulose docking domain, dockering
atgttggtctaaaataattggatatgaatgttgtagttcaccgaatccacatatttatgtaacagacatattgggtcattggagtattgaaaatggtgattggtgttatgtcagacgtagttgtta

SEQ ID NO: 19226 - DNA, 120 bp, Anaeromyces robustus
  Cellulose docking domain, dockering
ttgtttttctgaaaaattaggttttccttgttgttcagatccttcaactgttatagtatttgtagatgaaagtggtgaatggggcgtcgaaaatgatggatggtgtggttttccttatga

SEQ ID NO: 19227 - DNA, 120 bp, Anaeromyces robustus
  Cellulose docking domain, dockering
ttgtttttctgaaaaattaggttttccttgttgttcagatccttcaactgttgtagtatttgtagatgaaagtagtgaatggggcgtcgaaaatgatggatggtgtggttttccttatga

SEQ ID NO: 19228 - DNA, 123 bp, Anaeromyces robustus
  Cellulose docking domain, dockering
atgttggtctgaaaaaattggatataaatgttgtagttcacctaatgcagtccttcaattaacagatatatttggatattggagtgttgaagaggatgaatggtgttttataagacgacgttg

SEQ ID NO: 19229 - DNA, 120 bp, Anaeromyces robustus
  Cellulose docking domain, dockering
ttgttttgccgaaaaattaggttattcatgttgtatatctccttcatcggctgttttacatgaagataaagatggtaaatggggtattgaatatggtaaatggtgtggtttgccttatga

SEQ ID NO: 19230 - DNA, 120 bp, Anaeromyces robustus
  Cellulose docking domain, dockering
atgtttttcattaagtcatgggtataaatgctgtgaaacatgtaatgttgtagaaaagggaaaagaaggtgattggggaattgaaaatcataaatggtgtggaataaaatattcatgcta

SEQ ID NO: 19231 - DNA, 96 bp, Anaeromyces robustus
  Cellulose docking domain, dockering
ttttccatgttgtaaagaaaataaagttgtattagttgatgaagaaggtgaatggggtatagaaaataaaaaatggtgtggtatttcttccagtaa

SEQ ID NO: 19232 - DNA, 126 bp, Anaeromyces robustus
  Cellulose docking domain, dockering
atgttggtcagaagaacaaggatattcatgttgtcaaggatgtaatattcttttagttgaagaaggacaacaaaaatggggatttgaaaataataaatggtgtggaattgttgaaagtgtttgtca

SEQ ID NO: 19233 - DNA, 120 bp, Anaeromyces robustus
  Cellulose docking domain, dockering
ttcaacttcaattttaaatcaaggttacagttgttgttcatctgaatgtattgttgttcttaccgatagcgatggtacatggggttatgaaaataataaatggtgtggatgtaatgtaga

SEQ ID NO: 19234 - DNA, 114 bp, Anaeromyces robustus
  Cellulose docking domain, dockering
cttatataaaggttattcatgttgtagtgaaaataactgtaaaataagatatgtagatgaagatggtaattggggtgctgaaaacggccaatggtgcggtatttctaacaaatg

SEQ ID NO: 19235 - DNA, 111 bp, Anaeromyces robustus
  Cellulose docking domain, dockering
tattttaagccaaggttataaatgttgttctgacaattgtcttgttgtatatactgatgatgatggtacatggggttatgaaaatgataaatggtgtggatgtgaacaaaa

SEQ ID NO: 19236 - DNA, 126 bp, Anaeromyces robustus
  Cellulose docking domain, dockering
ttgttggtcagaattaattggttataaatgttgtcctcctaacatcacagcagtttatgccagagataaatatggatattggggttatgactttgataagaaggaatggtgtggtattaccactta

SEQ ID NO: 19237 - DNA, 117 bp, Anaeromyces robustus
  Cellulose docking domain, dockering
ttgttggtccaatgaatataattatccttgttgtaaaacttgtatagtatatgaaatagatgataaaggatcatggggttatgaaaataatgaatggtgtggtattccatctcattg

SEQ ID NO: 19238 - DNA, 126 bp, Anaeromyces robustus
  Cellulose docking domain, dockering
ttcatcaaaaattattgcacaaggttataaatgttgtagttctatttgtaaacaaccatatgttgatgaaaatggtgaatggggtgttgaagatggtaaatggtgtggatgtattgaaaataaaaa

SEQ ID NO: 19239 - DNA, 106 bp, Anaeromyces robustus
  Cellulose docking domain, dockering
tccatcaaccattactaacaaaggttattcatgttgttcaacatgttccaaagttcgttatgttgatgaagatggtaaatggggtgttgaaaaccatcaatggtgt

SEQ ID NO: 19240 - DNA, 123 bp, Anaeromyces robustus
  Cellulose docking domain, dockering
atgttgggctagagaatcaggttatgattgttgttccgaagataaccaaaaggttatttacactgatgaaatgggttcatggggttatgaaaatgataattggtgtggtattattgtaaagaa

SEQ ID NO: 19241 - DNA, 120 bp, Anaeromyces robustus
  Cellulose docking domain, dockering
atgttgggctaaagaatttggttataactgttgttccaaggataaccaaaatgttatttacactgaagaaatgtattcatggggttatgaaaatgataattggtgtggtattgtaaaggt

SEQ ID NO: 19242 - DNA, 120 bp, Anaeromyces robustus
  Cellulose docking domain, dockering
atgttgggctaaagaatttggttataactgttgttccaaggataaccaaaatgttatttacactgaagatatgtattcatggggttatgaaaaagatgaatggtgtggtattgtaaaggt

SEQ ID NO: 19243 - DNA, 106 bp, Anaeromyces robustus
  Cellulose docking domain, dockering
tgctattacttcccaaggatacaaatgttgttcaaaggattgtttcatagtttttactgatgatgatggtacatggggtattgaaaatgatcaatggtgtggttgt

SEQ ID NO: 19244 - DNA, 63 bp, Anaeromyces robustus
  Cellulose docking domain, dockering
ttttactgatgatgatggtacatggggtattgaaaatgatcaatggtgtggttgtgatactcc

SEQ ID NO: 19245 - DNA, 117 bp, Anaeromyces robustus
  Cellulose docking domain, dockering
tcctggtataaaattaggttattcatgttgtgaaaaatgtaatagtttaattactaataaagatggttcatggagtttagaaaattttaaaatatgtagtattaaatattcttgctt

SEQ ID NO: 19246 - DNA, 120 bp, Anaeromyces robustus
  Cellulose docking domain, dockering
atgttgggctcaaaatcaaggttatcaatgttgtacttcatgtgatattgtttatgaagataatgatggttcatggggaattgaaaatggtgattggtgtggaattaatacttcatgttt

SEQ ID NO: 19247 - DNA, 76 bp, Anaeromyces robustus
  Cellulose docking domain, dockering
atgtttttcaattaattttggatttccatgttgtagtagttgtgtttattattatgaagatgatgatggaaaatgg

SEQ ID NO: 19248 - DNA, 120 bp, Anaeromyces robustus
  Cellulose docking domain, dockering
ttgtactggtattgaggatggttatccatgttgtaagacatgtaatgctatttacaatgatgaacaaggaccatgggagatggaaaataataaatggtgtggtattcctgattcttgcga

SEQ ID NO: 19249 - DNA, 117 bp, Anaeromyces robustus
  Cellulose docking domain, dockering
atgtttttcagttaaattaggatatccatgttgtactaaaactaatgaagttatttacactgatgaacaaggtcaatggggtgttgaagattatcattggtgtggtattgataacac

SEQ ID NO: 19250 - DNA, 114 bp, Anaeromyces robustus
  Cellulose docking domain, dockering
attacaaccagcttatccatgttgttatatgagaaataaagaagttgtatccattgattctaatggtaaatggagtactgaacatggtacatggtgtggcataattgaagaaca

SEQ ID NO: 19251 - DNA, 120 bp, Anaeromyces robustus
  Cellulose docking domain, dockering
ttgttggtccactagattaggttacccatgttgtgaagatagtaatgttgtttacgctgttgatgaaaatggtatttggggttatgaaaataaacattggtgtggtattattgaagaaga

SEQ ID NO: 19252 - DNA, 75 bp, Anaeromyces robustus; identical to SEQ ID NO: 16720
  Cellulose docking domain, dockering

SEQ ID NO: 19253 - DNA, 123 bp, Anaeromyces robustus
  Cellulose docking domain, dockering
ttgtttttctattgaattaggatatccatgttgtcaaacatcatgtgaggtatactacattgatgaagatggtgattggggaatagaagataatcattggtgtggtataggtgaaaattgtgg

SEQ ID NO: 19254 - DNA, 106 bp, Anaeromyces robustus; identical to SEQ ID NO: 16723
  Cellulose docking domain, dockering

SEQ ID NO: 19255 - DNA, 66 bp, Anaeromyces robustus; identical to SEQ ID NO: 16724
  Cellulose docking domain, dockering

SEQ ID NO: 19256 - DNA, 132 bp, Anaeromyces robustus
  Cellulose docking domain, dockering
ttgctgggctactaagcttggttataagtgttgtactgctaaatgtccagaagtttcttacgttgaccaagatggtgcttggggtattgaaaatggtaattggtgtggtattattgaaagttcttgctgggc

SEQ ID NO: 19257 - DNA, 105 bp, Anaeromyces robustus
  Cellulose docking domain, dockering
agaaaaattaggttatccatgttgtagtgaaactactgatgttgtatctgttgatgctaatggaaaatggggtttagaaaatggtactatctgtggtattaaacc

SEQ ID NO: 19258 - DNA, 114 bp, Anaeromyces robustus
  Cellulose docking domain, dockering
tgctaatgcttacaataactgtactcacacttgtagagtattagttactgaagacggtgttgaatggggagctgaaaataatgactggtgcattattgatcaatctctctgtgt

SEQ ID NO: 19259 - DNA, 99 bp, Anaeromyces robustus
  Cellulose docking domain, dockering
ctatctttgttgtaatgaatgtaatgttgtattagaagatgaagaaggtaaatggggttatgaaaacaacagatggtgtggtatcaaggatacttgtac

SEQ ID NO: 19260 - DNA, 99 bp, Anaeromyces robustus; identical to SEQ ID NO: 19259
  Cellulose docking domain, dockering

SEQ ID NO: 19261 - DNA, 114 bp, Anaeromyces robustus; identical to SEQ ID NO: 19258
  Cellulose docking domain, dockering

SEQ ID NO: 19262 - DNA, 111 bp, Anaeromyces robustus
  Cellulose docking domain, dockering
ttgttggtcaaaggtattaggttatccatgttgcacagtcaatacttatgtttactatattgatgataatggtatgtggggtattgaaaacgacaactggtgtggtattaa

SEQ ID NO: 19263 - DNA, 105 bp, Anaeromyces robustus
  Cellulose docking domain, dockering
cttatataattgttgtaaaaatacctgtaaattagttgccatacaagataaaatacaattaggtattgaaaatggtgaatattgttctataccttattcttgttt

SEQ ID NO: 19264 - DNA, 69 bp, Anaeromyces robustus; identical to SEQ ID NO: 16733
  Cellulose docking domain, dockering

SEQ ID NO: 19265 - DNA, 114 bp, Anaeromyces robustus
  Cellulose docking domain, dockering
ttgttggtcaaaagattatggatacccatgttgtaagagttgttttgtttttgaagaaactgaagaaggtaaatggggttatgaagataatcattggtgtggtattcaatcatt

SEQ ID NO: 19266 - DNA, 126 bp, Anaeromyces robustus
  Cellulose docking domain, dockering
ttgtataggtgaagttgctggttatccatgttgttcagaaggtgttaataaagtttatgaacatgatattaatggagaatggggttatgatttcagtaagaaacaatggtgtagtcttacaccatc

SEQ ID NO: 19267 - DNA, 102 bp, Anaeromyces robustus
  Cellulose docking domain, dockering
atacccatgttgtacttcaactaaaactgtaatgtatactgatgaaaagggaccatggggtattgaaaatggtaactggtgtggtattaaagattcttgtac

SEQ ID NO: 19268 - DNA, 94 bp, Anaeromyces robustus
  Cellulose docking domain, dockering
ctgttgggctaaatctcttggttacaactgttgttctacaagtagttgtagaactgctcaattcagcgatgctgatggtcaatgggatgttgaa

SEQ ID NO: 19269 - DNA, 69 bp, Anaeromyces robustus
  Cellulose docking domain, dockering
tgttatattcactgattctaacggtcaatggggtattgaaaatggtaactggtgtggtaaaccaaacag

SEQ ID NO: 19270 - DNA, 106 bp, Anaeromyces robustus; identical to SEQ ID NO: 16723
  Cellulose docking domain, dockering

SEQ ID NO: 19271 - DNA, 91 bp, Anaeromyces robustus; identical to SEQ ID NO: 16739
  Cellulose docking domain, dockering

SEQ ID NO: 19272 - DNA, 100 bp, Anaeromyces robustus
  Cellulose docking domain, dockering
tgctattacttcccaaggttacaagtgttgtaaagaagataactgttcagtttttgaaactgatgatgatggtacatggggtattgaaaatgatcaatgg

SEQ ID NO: 19273 - DNA, 81 bp, Anaeromyces robustus
  Cellulose docking domain, dockering
agctgtaatttaccatgataacgatggtgactggggtgttgaaaataaccaatggtgtttaattaagagtagtaaatgtaa

SEQ ID NO: 19274 - DNA, 100 bp, Piromyces finnis
  Cellulose docking domain, dockering
ttgttgggccgaagctcttggttacaagtgttgttcagctggtaactacatggttcttcttacagatgaaagtggagcctggggtgccgaaaatggagaa

SEQ ID NO: 19275 - DNA, 82 bp, Piromyces finnis; identical to SEQ ID NO: 16742
  Cellulose docking domain, dockering

SEQ ID NO: 19276 - DNA, 108 bp, Piromyces finnis
  Cellulose docking domain, dockering
aaataataattgttgtacaaagacagatactcatgtttcatttattgatgatgaaaaatctttatggggtattgaatcaggatcatggtgtaaaataaatatcaataa

SEQ ID NO: 19277 - DNA, 109 bp, Piromyces finnis
  Cellulose docking domain, dockering
ttgttggagttcaaaatacggctatggatgctgtttcaatgataatgatgatgttatatatagagatgaaaaaggatcttggggaattgaaaataatcaatggtgtggt

SEQ ID NO: 19278 - DNA, 120 bp, Piromyces finnis
  Cellulose docking domain, dockering
atgctggtcagaaaaattaggtttcaagtgttgtagaattgatatacaaccgatattctctgattatgaagggatttggggagttgaagatgatcaatggtgtggtataataaatagccc

SEQ ID NO: 19279 - DNA, 117 bp, Piromyces finnis
  Cellulose docking domain, dockering
atgttcatttgaagtattaggatatcattgttgttcatctattaatccaaaagttgtcaaagaagattcatatggaaaatggggtgaagaagatggagaattatgtggtattggtga

SEQ ID NO: 19280 - DNA, 91 bp, Piromyces finnis; identical to SEQ ID NO: 16746
  Cellulose docking domain, dockering

SEQ ID NO: 19281 - DNA, 114 bp, Piromyces finnis
  Cellulose docking domain, dockering
ttggtctgaaccagaatatccatgttgtaaggaatcttgtacagtttactacgttgacgatcatcaatggggtattgaaaacggagaatggtgtggtattccagattcatgtgg

SEQ ID NO: 19282 - DNA, 123 bp, Piromyces finnis
  Cellulose docking domain, dockering
atgttggtctgaagaattaggttattcctgctgttctcattgtactgttcttcttaaggatgaatctggtttatggggtgctgaagatggtaagtggtgtggtattccaaatgaatcatgtaa

SEQ ID NO: 19283 - DNA, 121 bp, Piromyces finnis
  Cellulose docking domain, dockering
ttgttggtcctcttactatggttattcttgttgtagccactgtaatattttccttaccgatgaacttggtgactggggtgttgaaaacaaaaaatggtgtggtattaatagtaataaatgc

SEQ ID NO: 19284 - DNA, 123 bp, Piromyces finnis
  Cellulose docking domain, dockering
ttcttctggagtcaaggctcaaggttacccatgctgtaaatcctgtggtcaagttgtatatgttgacgaagatggtaaatggggtgtagaaaacaatgattggtgtggaattccaaccaactg

SEQ ID NO: 19285 - DNA, 114 bp, Piromyces finnis
  Cellulose docking domain, dockering
tgaaaaaatcattaatcaaggctacccatgttgttcaaaagaaactcaagtttattacactgatgaaagtggtgaatggggtgtcgaaaataacaattggtgtggaatattaaa

SEQ ID NO: 19286 - DNA, 123 bp, Piromyces finnis
  Cellulose docking domain, dockering
atgttgggcaacatctttaggatatccatgttgtaaagaagctaatccaataatattctacaaggatgaagacggtgattggggtattgaaaataattcctggtgtggaattattaaaaatga

SEQ ID NO: 19287 - DNA, 111 bp, Piromyces finnis
  Cellulose docking domain, dockering
tggatatccatgttgtgaaaataaaaatactgttgttgaaattaatgattctgaatataatcttcaatttggtattgaaaatggtaaattatgtggtatttcaagtattca

SEQ ID NO: 19288 - DNA, 76 bp, Piromyces finnis
  Cellulose docking domain, dockering
atacaaatgttgtaaaaaatgtaacatttatgtaaatgaactcggtcaagattggggtattgaaaataatgattgg

SEQ ID NO: 19289 - DNA, 108 bp, Piromyces finnis
  Cellulose docking domain, dockering
gaaattaggctatagatgttgtgattcatgtgaaattaaatttattgatgaaaatataaagtacggttatgaaaatggagaatggtgtggcattccagatgaatgtta

SEQ ID NO: 19290 - DNA, 114 bp, Piromyces finnis
  Cellulose docking domain, dockering
cacaagatttggttttccttgttgcaacacatgtgaactccaatatattgatgactttggaaattggggttttgaaaatgataattggtgtggtatttctccaaatatttgcga

SEQ ID NO: 19291 - DNA, 105 bp, Piromyces finnis
  Cellulose docking domain, dockering
tgaaggttatgactgctgtgaaggttgtacaatagaaacagaagaagatggtataaaatggggttacgaaaatagaaattggtgtgtaattccttacacatgtaa

SEQ ID NO: 19292 - DNA, 111 bp, Piromyces finnis
  Cellulose docking domain, dockering
tttttctgtaaaaatgggttatccatgctgtactcaaaattcagagattgtatatacagatagtactggtagttggggtcttcaaaatggtgattggtgtggtgtaaaagg

SEQ ID NO: 19293 - DNA, 106 bp, Piromyces finnis; identical to SEQ ID NO: 16760
  Cellulose docking domain, dockering

SEQ ID NO: 19294 - DNA, 120 bp, Piromyces finnis
  Cellulose docking domain, dockering
atgtttttcaaaagctctcggctatccatgttgctccgtcggtaacagtgatgttgcatttattgataacaatggtaaatggggtatagaaaatggcaattggtgtggaataacttccac

SEQ ID NO: 19295 - DNA, 123 bp, Piromyces finnis
  Cellulose docking domain, dockering
ggcaaattatatagaccaaggctatggatgttgtctaaatgataatggaaaaagagaaataataaatatggatggagaatggggtttagaaaatgataattggtgtggatttaggaatagtac

SEQ ID NO: 19296 - DNA, 120 bp, Piromyces finnis
  Cellulose docking domain, dockering
atgttggtcagaacaatataattttccttgctgttcgccaggagtaaagattgactttactgataatagaggttcttggggtttagaaaattatagctggtgtggtattatatctgaaag

SEQ ID NO: 19297 - DNA, 117 bp, Piromyces finnis
  Cellulose docking domain, dockering
tgccaaaaacaagaataatttaccatgctgttcaacatgtgaaattgcattgattgatggctctggtagatatggttatgaaaatggtcaatggtgtaatatcccattcaattgttc

SEQ ID NO: 19298 - DNA, 120 bp, Piromyces finnis
  Cellulose docking domain, dockering
ttggtctcgtgctattggttttgtatgttgtgataaatgtaatgtactctttgttgatgaacaaggtaaatggagtgtcgaagatggttactggtgtggtattaatccaagtaaatgtaa

SEQ ID NO: 19299 - DNA, 97 bp, Piromyces finnis; identical to SEQ ID NO: 16765
  Cellulose docking domain, dockering

SEQ ID NO: 19300 - DNA, 123 bp, Piromyces finnis
  Cellulose docking domain, dockering
atgcttttctgaggttttaggatatccttgttgtaatgaatgctctattatttattctgatgctgatggcgactggggatatgaaaatggaatgtggtgtggaattaatacttcacaatgtaa

SEQ ID NO: 19301 - DNA, 117 bp, Piromyces finnis
  Cellulose docking domain, dockering
atgttggtctgaaaaatttggaataccttgttgtaaggaggcactaatgccacttcgtactacttacgatggtggatggagtcaagaaaatggtgaatggtgtggtttaggagaaag

SEQ ID NO: 19302 - DNA, 105 bp, Piromyces finnis
  Cellulose docking domain, dockering
ttcttactcttgttgtatctttgatgataccctaatcattacttccgatagcactggaaattggggttttgaaggagatagatggtgtttaattaaaaataataa

SEQ ID NO: 19303 - DNA, 123 bp, Piromyces finnis
  Cellulose docking domain, dockering
gtgttgggctaaagctcaaggttataattgttgtgaaaaacgtactaccgccgttacctacgttgataaaaagactggtgaagaatggggttatgaaggtggaaaatggtgtggtattactga

SEQ ID NO: 19304 - DNA, 117 bp, Piromyces finnis
  Cellulose docking domain, dockering
tttcagtgatgaatatgcttgttgtaaaggatgtgacgtagtatccgtcacttccaatggtaatagtaaatggggtgtagaaaataaaaaatggtgttctattccatattcctgtaa

SEQ ID NO: 19305 - DNA, 120 bp, Piromyces finnis
  Cellulose docking domain, dockering
ttgtttttcacttaaattgggttacccatgttgttctactactacaacagtagttacttcagatagtgatggcgattggggtattgaaaataatagttggtgtggtattgaaaagaaaat

SEQ ID NO: 19306 - DNA, 120 bp, Piromyces finnis
  Cellulose docking domain, dockering
atgctggtcattaaaacaaggttattcatgttgtagaggttgtaaagttcaaactaaagatgaatatggaaagtggggtatagaaaataatgaatggagtggtattccaactagttgtaa

SEQ ID NO: 19307 - DNA, 99 bp, Piromyces finnis
  Cellulose docking domain, dockering
ttcatgctgtgattctggaaacacagatgtttatttttatgatggagatggtgaatggggatttaattttgaaactcaagaatggtgtggactttcccc

SEQ ID NO: 19308 - DNA, 99 bp, Piromyces finnis
  Cellulose docking domain, dockering
atatatgtgctgtgaaggatgtgaagttgttgaagaaaccgctgaaggaaagtggggtattgaaaagaacaattggtgtggtattaaggattcttgctt

SEQ ID NO: 19309 - DNA, 120 bp, Piromyces finnis
  Cellulose docking domain, dockering
ctggtctgaaccattaggtttcccatgctgttctgaatgtgttgaaccagaacgtgttgatgacaatggtgaatggggtattgaaaacaatgaatggtgcggtatttacaaaagctgcga

SEQ ID NO: 19310 - DNA, 129 bp, Piromyces finnis
  Cellulose docking domain, dockering
ctctgcttccattattagccaaggttataagtgttgtaagtctggatgccaagttgtttaccaagatgctgatggtgattggggtgttaactcccaaggatactggtgtggtattccaacttcatgcaa

SEQ ID NO: 19311 - DNA, 126 bp, Piromyces finnis
  Cellulose docking domain, dockering
ttggagtgaagaacttggttacagatgctgtaacaatggtgaaagtattgttgaatacattgatgaaagtggatggtggggtgttactaaggacacaaaggaatggtgtggtattattaagaacaa

SEQ ID NO: 19312 - DNA, 118 bp, Piromyces finnis
  Cellulose docking domain, dockering
ttgtggtgctcaaggttactcatgctgtaaatctagttgtaccgtttactttgaagattctgatggtaaatggagtattgaaaatgacgactggtgtttaattaatagttctaaatgc

SEQ ID NO: 19313 - DNA, 63 bp, Piromyces finnis
  Cellulose docking domain, dockering
tgatgaaagtggtaattggggtattgaaaaggatgattggtgtggtattccaaagagttgtaa

SEQ ID NO: 19314 - DNA, 99 bp, Piromyces finnis
  Cellulose docking domain, dockering
ttattcatgttgtgaaggttgtgaggttatcgaagaaactgaagaaggtaaatggggtatagaaaattacgcatggtgtggtattaaagattcatgttt

SEQ ID NO: 19315 - DNA, 94 bp, Piromyces finnis; identical to SEQ ID NO: 16781
  Cellulose docking domain, dockering

SEQ ID NO: 19316 - DNA, 85 bp, Piromyces finnis; identical to SEQ ID NO: 16782
  Cellulose docking domain, dockering

SEQ ID NO: 19317 - DNA, 108 bp, Piromyces finnis
  Cellulose docking domain, dockering
cgattattatgaatgctgtactggttgtaaaccaattgttgctgatgatgaaggaagatggggagctcaaaatggtgaatggtgtttaattgatgaagaaagatgtaa

SEQ ID NO: 19318 - DNA, 105 bp, Piromyces finnis
  Cellulose docking domain, dockering
agattatgatgtatgtgaaggctgtgaagttttagttactgatttagaaggtaagtggggtgctcaagatggtaaatggtgccatatcgatgaagttaaatgcaa

SEQ ID NO: 19319 - DNA, 100 bp, Piromyces finnis
  Cellulose docking domain, dockering
ttctgcatctattattaagagtggatataaatgttgctcagcttcttgtgaagttatttacacagattccgatggtacttggggtgttgaaaacaatgaa

SEQ ID NO: 19320 - DNA, 111 bp, Piromyces finnis
  Cellulose docking domain, dockering
agaaaaaaaactaggttatccatgttgtaaatattgtactattattgaaagtgattcctatggagactatggtgttgaaaataatgcctggtgtagtatatcctacgcctg

SEQ ID NO: 19321 - DNA, 114 bp, Piromyces finnis
  Cellulose docking domain, dockering
ttcttgttggtcagaatccttaggctatccatgttgtcatcatcaagatatcatctacaccgatgaaagtggaccatggggattagaaaataatcaatggtgtggtattcagac

SEQ ID NO: 19322 - DNA, 114 bp, Piromyces finnis
  Cellulose docking domain, dockering
ctcttccaaaattacccaacaaggttacaaatgttgttcaaagaactgtgtcgtctattacactgatagtgatggtaactggggttatgaaaacgactggtgtggttgtgccaa

SEQ ID NO: 19323 - DNA, 91 bp, Piromyces finnis
  Cellulose docking domain, dockering
tggttatccatgttgtaaaactaataagacagttgtattcactgatgaatacggaaaatggagtgttgaaaataacgattggtgtttaatt

SEQ ID NO: 19324 - DNA, 114 bp, Piromyces finnis; identical to SEQ ID NO: 19322
  Cellulose docking domain, dockering

SEQ ID NO: 19325 - DNA, 91 bp, Piromyces finnis; identical to SEQ ID NO: 19323
  Cellulose docking domain, dockering

SEQ ID NO: 19326 - DNA, 120 bp, Piromyces finnis
  Cellulose docking domain, dockering
atgttggtctgaagcattaggttataaatgttgtaagaaatgtaatgctctctatagagattctaacggtttatggggtattgaaaattttaagagatgtggtattccttcttcctgttc

SEQ ID NO: 19327 - DNA, 123 bp, Piromyces finnis
  Cellulose docking domain, dockering
atgtatgtctgaacttaaaggttatccttgttgttccaaggaaataagcattgttcttaaacatgatcaatacggtgactggggttatgattttaaaaaaggaaaatggtgtggtctcacgcc

SEQ ID NO: 19328 - DNA, 120 bp, Piromyces finnis; identical to SEQ ID NO: 19326
  Cellulose docking domain, dockering

SEQ ID NO: 19329 - DNA, 123 bp, Piromyces finnis; identical to SEQ ID NO: 19327
  Cellulose docking domain, dockering

SEQ ID NO: 19330 - DNA, 126 bp, Piromyces finnis
  Cellulose docking domain, dockering
ctgttgggtatctgttcatggttatccatgttgtgaaggtgaatctctcgaaaaagtctatgctgaagatgttgatggaaaatggggttatgatttcgttaaaaagacatggtgtggtatttccac

SEQ ID NO: 19331 - DNA, 117 bp, Piromyces finnis
  Cellulose docking domain, dockering
atgttggtctcttaaagaaggatataactgttgtataggttgtgctgtctatgctattacagatgaaggttcttggggtgttgaaaatggaaaatggtgtggtattccatcctattg

SEQ ID NO: 19332 - DNA, 132 bp, Piromyces finnis
  Cellulose docking domain, dockering
atgttggtcattatcccaaggctacccatgttgtgatccagatgccgaaactatttactccgatgaatccggtgattggggtcttgcattaaacagtaataatgaattggattggtgtggtattatttctgg

SEQ ID NO: 19333 - DNA, 138 bp, Piromyces finnis
  Cellulose docking domain, dockering
atgttggtctgaaagtcttggattcccatgttgtagcgatgaaaataccattatcgtagaatcagatggagatggcgattggggtattgaactaaatagtaataatgaatgggaatggtgtggtataaaaaagaaggg

SEQ ID NO: 19334 - DNA, 111 bp, Piromyces finnis
  Cellulose docking domain, dockering
ttatagtaagggttcaggatttccatgttgtaaaaagaataccaagattatatatatggatggtgaaggagattggggtgtcaataatggtgaatggtgtatagtaaatag

SEQ ID NO: 19335 - DNA, 91 bp, Piromyces finnis
  Cellulose docking domain, dockering
ggccactttaataaatttatcatacaagtgttgttcacctaatgcatcatactattccgttgatcaagatggtgaatggggtgttgaaaat

SEQ ID NO: 19336 - DNA, 73 bp, Piromyces finnis
  Cellulose docking domain, dockering
ttcttgcttctctgaagccttaggatatgaatgctgtaaaggttgcactgtaatcacaactgatgaaagtggt

SEQ ID NO: 19337 - DNA, 111 bp, Piromyces finnis
  Cellulose docking domain, dockering
ctgtttcgccactaaattaggatacccatgttgtaagaacaaccaaattgtttacactgattcagatggtgactggggatttgaaaacaacgaatggtgtggtattggtgg

SEQ ID NO: 19338 - DNA, 111 bp, Piromyces finnis; identical to SEQ ID NO: 19337
  Cellulose docking domain, dockering

SEQ ID NO: 19339 - DNA, 111 bp, Piromyces finnis; identical to SEQ ID NO: 19337
  Cellulose docking domain, dockering

SEQ ID NO: 19340 - DNA, 120 bp, Piromyces finnis
  Cellulose docking domain, dockering
ttgttgggctgaatcattaggttatccatgttgtaaagaaaaaacaccaaatgttgaatatgttgatgaatccggttcatggggtatagaaaatgacatttggtgtggtataatttcaac

SEQ ID NO: 19341 - DNA, 117 bp, Piromyces finnis
  Cellulose docking domain, dockering
gtgttgggctgaagcacaaggttatccatgctgtgaaatcactaaagaagttgtttatgttgatgattacctatggggtattgaaaatgaagaatggtgtggtataattgaagatga

SEQ ID NO: 19342 - DNA, 103 bp, Piromyces finnis; identical to SEQ ID NO: 16819
  Cellulose docking domain, dockering

SEQ ID NO: 19343 - DNA, 106 bp, Piromyces finnis; identical to SEQ ID NO: 16820
  Cellulose docking domain, dockering

SEQ ID NO: 19344 - DNA, 109 bp, Piromyces finnis; identical to SEQ ID NO: 16821
  Cellulose docking domain, dockering

SEQ ID NO: 19345 - DNA, 73 bp, Piromyces finnis
  Cellulose docking domain, dockering
tgacgttataagactcggttatttatgttgtagtctaccatgtactgttatttatactgatgatgatggtgat

SEQ ID NO: 19346 - DNA, 79 bp, Piromyces finnis; identical to SEQ ID NO: 16824
  Cellulose docking domain, dockering

SEQ ID NO: 19347 - DNA, 117 bp, Piromyces finnis
  Cellulose docking domain, dockering
atgcttttcaattaatttaggctatccatgttgtagtacttgtactttatactttgaaaattctattggaagatggggcattgaaaataatgagtggtgtggtctaaaaagttcttg

SEQ ID NO: 19348 - DNA, 117 bp, Piromyces finnis
  Cellulose docking domain, dockering
atgttgggcagaggaacaagggtatcaatgttgttctgattgtgatgttatctatgaagacaataatggtttgtggggaatagagaatggtacttggtgtggtattaactctacatg

SEQ ID NO: 19349 - DNA, 114 bp, Piromyces finnis
  Cellulose docking domain, dockering
ttgctttgcaaagtctatgggttatgcttgctgtagtgtcggtaccgaagtagtttacactgataatgatggtcaatggggtattgaaaatggccaatggtgtggtattggtgg

SEQ ID NO: 19350 - DNA, 64 bp, Piromyces finnis
  Cellulose docking domain, dockering
ttacgcctgctgtagtggatgtgaatcagtctatgttgacaatgatggtaaatggggtgttgaa

SEQ ID NO: 19351 - DNA, 97 bp, Piromyces finnis; identical to SEQ ID NO: 16829
  Cellulose docking domain, dockering

SEQ ID NO: 19352 - DNA, 123 bp, Piromyces finnis
  Cellulose docking domain, dockering
atgttggtcagaattattaggaagtccatgttgtccaccaaaggttacaattgtttacagtcatgatgaatatggagattggggatatgattttaagcgtaaggaatggtgtggacttactcc

SEQ ID NO: 19353 - DNA, 117 bp, Piromyces finnis
  Cellulose docking domain, dockering
aactaatattgttgaacttggttataaatgttgttctagttttattaagattgatcatacagataaaataggtacttggggatatgaaaatggtgaattgtgtggtattccatttga

SEQ ID NO: 19354 - DNA, 99 bp, Piromyces finnis
  Cellulose docking domain, dockering
atacttatgttgtgatggttgtaatgttgttgaagaaactgctgaaggtaaatggggtgttgaaaacaacaaatggtgtggtattccaagtaactgtaa

SEQ ID NO: 19355 - DNA, 78 bp, Piromyces finnis
  Cellulose docking domain, dockering
tggtgttgtattagaagaagatggtattaaatggggtgttgaaaataatgattggtgtattatcccatctaaatgtag

SEQ ID NO: 19356 - DNA, 123 bp, Piromyces finnis
  Cellulose docking domain, dockering
atgttggtctgaaaatattggttatccatgttgtcaaaataaggataccaaggtaacctatcattccaaatctcttaataaagactatggtactgaaaatggagaatggtgcggtattaatga

SEQ ID NO: 19357 - DNA, 99 bp, Piromyces finnis
  Cellulose docking domain, dockering
tagttacaactgctgtaaaattccagctaacgtcgatacagtagatgatgttggttactgggctattcaaaatggtcaatggtgttttattgatatgac

SEQ ID NO: 19358 - DNA, 93 bp, Piromyces finnis
  Cellulose docking domain, dockering
taaatacaagtgttgtgaaacttgtaaagtttcctacactgattccacaaagtggggtgttgaacatggtaaatggtgttctattccatattc

SEQ ID NO: 19359 - DNA, 85 bp, Piromyces finnis
  Cellulose docking domain, dockering
ttctggatatgattgttgcttatccactaaagccatcgtaacatcagatgtcgttggtgattggggtattgaaaataatgactgg

SEQ ID NO: 19360 - DNA, 93 bp, Piromyces finnis
  Cellulose docking domain, dockering
tcaatgttgtcaatcctgcgatattgtctttaccgatactgaggattggggtttcgaaaatggtaattggtgttctattcctcattcatgtaa

SEQ ID NO: 19361 - DNA, 120 bp, Piromyces finnis
  Cellulose docking domain, dockering
attatcctatggaacaggttatccatgttgtaaagataaaaacaccaaagttaactatgtttctaaatctactggaaaagaatggggtgtagaaaatggtaattggtgtggaataacaga

SEQ ID NO: 19362 - DNA, 94 bp, Piromyces finnis
  Cellulose docking domain, dockering
tcaatctattttaaatcaaggttattcatgctgctccagcggttgtgaagttatctataccgattctgatggtacttggggtgttgaaaataat

SEQ ID NO: 19363 - DNA, 123 bp, Piromyces finnis
  Cellulose docking domain, dockering
ttgctggtctgaaagattaggatacagatgttgtagttttactaatgatgttattttagaggatagtgatggtaagtggggtgtagaaaataatgactggtgtggcattcaaaataataattc

SEQ ID NO: 19364 - DNA, 120 bp, Piromyces finnis
  Cellulose docking domain, dockering
atgttggtcatcaagcctaggttatccatgttgtactaatactaatgaagtaatttatgaagatagtgatggtaagtggggtatcgaaaacaataactggtgtggtataattaataatgc

SEQ ID NO: 19365 - DNA, 88 bp, Piromyces finnis
  Cellulose docking domain, dockering
ttgtgttgctctttatttaggttatccatgttgttcaccagacaacacctatgttgtataccaagatgaaagtggtgattggggtgtt

SEQ ID NO: 19366 - DNA, 88 bp, Piromyces finnis; identical to SEQ ID NO: 16844
  Cellulose docking domain, dockering

SEQ ID NO: 19367 - DNA, 135 bp, Piromyces finnis
  Cellulose docking domain, dockering
ttgttgggcatcatctttaggttataaatgttgtactaaaacaactaaagttgaatatgttgatgctaatggtgaatggggtgctgaacgtgatgaatttggtgtaagaaattggtgtggtattattaagacaga

SEQ ID NO: 19368 - DNA, 111 bp, Piromyces finnis
  Cellulose docking domain, dockering
agatccatatccatgctgttcaagtgaccaagtccaaagaatagactcaacctatgatggtgactggggtaaagaaaatggtaaaaagtgtggtatagtatatgaatgcaa

SEQ ID NO: 19369 - DNA, 120 bp, Piromyces finnis
  Cellulose docking domain, dockering
ttgctggtctgaaaaattcaatattccatgttgtcaaaccactaaggaagttgttagaaccacttatgatggtatctggggtatggaaaatggtgaatggtgtggtcttggaactgaaag

SEQ ID NO: 19370 - DNA, 79 bp, Piromyces finnis
  Cellulose docking domain, dockering
agattatccatgttgccaaccaggagccgaagtagtctatgttgatgaaactggtaattggggtgttgaaaatggtaac

SEQ ID NO: 19371 - DNA, 91 bp, Piromyces finnis
  Cellulose docking domain, dockering
ctcttcaaaggatggttacccagtttgtaagactactactactgttgtatacactgactctgaaaagtggggtgttgaaaatggtaactgg

SEQ ID NO: 19372 - DNA, 117 bp, Piromyces finnis
  Cellulose docking domain, dockering
atgtttcagtgttgctttaggttacccatgttgtagtggaaacaatgttgtttacagtgactctgatggtaagtggggatttgaaaataatagctggtgtggtattgctgaaaagca

SEQ ID NO: 19373 - DNA, 117 bp, Piromyces finnis
  Cellulose docking domain, dockering
ttgtttctcgattaaacttggttatccatgttgtaacagcaatattgtatattatgttgacaatgatggtcaatggggatttgaaaataataattggtgtggtattatatctaataa

SEQ ID NO: 19374 - DNA, 120 bp, Piromyces finnis
  Cellulose docking domain, dockering
ctgtacaggaaaagatcaaggctaccaatgttgtaattcctgttctgtatactatgttgataatgacggtagatggggaatagagaatggcgaatggtgtggaattaaaaacacatgtaa

SEQ ID NO: 19375 - DNA, 99 bp, Piromyces finnis
  Cellulose docking domain, dockering
aaaatacccatgctgtcaaggatgtatagtagtcaccactgataaaaatggtagatggggtgttgaaaacaatgcctggtgctccattagctattcatg

SEQ ID NO: 19376 - DNA, 120 bp, Piromyces finnis
  Cellulose docking domain, dockering
atgttggtctgaaaagttaggttatacctgttgtcaaggatgtaaagtctatgaaaaggattccgatggatcatggggatatgaattaaatcaatggtgtggtattccttctaaatgtca

SEQ ID NO: 19377 - DNA, 120 bp, Piromyces finnis
  Cellulose docking domain, dockering
atgtttctctcttgctttaggtcatccatgttgtgattcctgtgatgttgttagcactgatgaaaatggtctttggggtgtcaaagataatgattggtgtggtattaaatctagttgtga

SEQ ID NO: 19378 - DNA, 102 bp, Piromyces finnis
  Cellulose docking domain, dockering
agatgaaactttcgattgttgtccagatggtactgaagttgcctatgtcgatgaatatggtgaatggggtataattaatggagaatggtgtggttttagttc

SEQ ID NO: 19379 - DNA, 102 bp, Piromyces finnis
  Cellulose docking domain, dockering
tgaatattcatgttgtagttcatgtatagatattgttgagcaagatgatgatagtagctggggtattgaaaatggacaatggtgttcaatcccattctattg

SEQ ID NO: 19380 - DNA, 97 bp, Piromyces finnis
  Cellulose docking domain, dockering
atgtgttggattaaatttaggttatccttgttgttcttcatgcaacattgcgtatagtgacgaaacaggaaattggggaattgaaaataatgaatgg

SEQ ID NO: 19381 - DNA, 117 bp, Piromyces finnis
  Cellulose docking domain, dockering
ttgtttttctatggcattgggtttttcatgttgtgaaggcaacaaaatagtttatactgatgatgatggtgattggggatatgaaaatggcgaatggtgtggtattataaaaggaaa

SEQ ID NO: 19382 - DNA, 123 bp, Piromyces finnis
  Cellulose docking domain, dockering
atgcttttctactaaattaggatataaatgttgttcatcttgtactgatgttatatatattgataatgatggacagtggggattagaaaacgacaattggtgtggaatagctgataaatgtaa

SEQ ID NO: 19383 - DNA, 94 bp, Piromyces finnis
  Cellulose docking domain, dockering
ttgcttctcaattgctcttggattcccatgttgtaagggtaatgacattgtatacactgacaatgatggtccatggggtgttgaaaatggtgaa

SEQ ID NO: 19384 - DNA, 109 bp, Piromyces finnis; identical to SEQ ID NO: 16862
  Cellulose docking domain, dockering

SEQ ID NO: 19385 - DNA, 96 bp, Piromyces finnis
  Cellulose docking domain, dockering
ttacgaatgttgtttcgataatgaagttgtttatgaagatgaaagtggtaaatggggtattaatgaaaagggagaatggtgtggtgttgaacaacc

SEQ ID NO: 19386 - DNA, 102 bp, Piromyces finnis
  Cellulose docking domain, dockering
ttacccatgttgtcaaaacactaatttctcctactacactgattccgctggtaatgaatggggtattgaaaacaacaactggtgtggtattaagccaaagac

SEQ ID NO: 19387 - DNA, 120 bp, Piromyces finnis
  Cellulose docking domain, dockering
ttcttcaaaaattactaagcaaggatataaatgttgttcaaagggatgtgaaatttattatgttgatgctgatggcgattggggttttgaaagtggtgattggtgtggatgtggaaacag

SEQ ID NO: 19388 - DNA, 91 bp, Piromyces finnis
  Cellulose docking domain, dockering
cccatcaaaaattactagtcaaggatacaaatgctgtaaggataattgtattatatattatactgatgcagatggtgattggggtgttgaa

SEQ ID NO: 19389 - DNA, 111 bp, Piromyces finnis
  Cellulose docking domain, dockering
taaagctggttatccatgctgttctcctgaaattactgaagttatatacactgatgatgaaggcaattggggttctgaaaataacaattggtgtcttatggctgaatctac

SEQ ID NO: 19390 - DNA, 132 bp, Piromyces finnis
  Cellulose docking domain, dockering
ttcatctatattttcggaacttggatacaaatgttgttatgatcaaaacactaaagtcgaatatattgatgaatttggtaattggggtatagaaaatggtaaattgtgtggtattggttatgacagatgttc

SEQ ID NO: 19391 - DNA, 114 bp, Piromyces finnis
  Cellulose docking domain, dockering
tttggatgatggttatccatgttgttcttcagtaaatcctgaagttcaatatactgatgataatggtaataaatggggtgttgaagatggcgaatggtgcggtattggtgaagc

SEQ ID NO: 19392 - DNA, 120 bp, Piromyces finnis
  Cellulose docking domain, dockering
cttttctgaggttttaggttatccatgttgctctgatccaaatgctgatgttgttactactgatgaatatggtcaatggggtatcgaaaataatttatggtgtggtatacttggttctga

SEQ ID NO: 19393 - DNA, 120 bp, Piromyces finnis; identical to SEQ ID NO: 19392
  Cellulose docking domain, dockering

SEQ ID NO: 19394 - DNA, 132 bp, Piromyces finnis; identical to SEQ ID NO: 19390
  Cellulose docking domain, dockering

SEQ ID NO: 19395 - DNA, 114 bp, Piromyces finnis; identical to SEQ ID NO: 19391
  Cellulose docking domain, dockering

SEQ ID NO: 19396 - DNA, 111 bp, Piromyces finnis; identical to SEQ ID NO: 19389
  Cellulose docking domain, dockering

SEQ ID NO: 19397 - DNA, 106 bp, Piromyces finnis
  Cellulose docking domain, dockering
ttgctgggctaaatctctcggctataaatgctgtgcaagtaaatgtgcagaagtttatagtaccgacgccagtggaaaatggagtattgaaaataatgaatggtgt

SEQ ID NO: 19398 - DNA, 114 bp, Piromyces finnis
  Cellulose docking domain, dockering
ctgctttagtacttcaatgggttacccttgctgcaaagatactagtagagttgtaactactgattgtgatggtaaatggggtgttgaaaatggagaatggtgtggtattggtgg

SEQ ID NO: 19399 - DNA, 114 bp, Piromyces finnis; identical to SEQ ID NO: 19398
  Cellulose docking domain, dockering

SEQ ID NO: 19400 - DNA, 106 bp, Piromyces finnis; identical to SEQ ID NO: 19397
  Cellulose docking domain, dockering

SEQ ID NO: 19401 - DNA, 132 bp, Piromyces finnis
  Cellulose docking domain, dockering
ccaaactattttagatcaaggttattcttgttgttcctataattgtaaagtcgtacatgaagaaaataagggtgaatctaaatattactggggtgttgaaaaagataattggtgtggatgcccattgaataa

SEQ ID NO: 19402 - DNA, 120 bp, Piromyces finnis
  Cellulose docking domain, dockering
aataactgaaaaaggctacaaatgttgtagtaataaccattgtagatcaaaatatgaagatgaagatggtatttggagtatagaaaatggcgaatggtgtggtgtgtcattagaatgcta

SEQ ID NO: 19403 - DNA, 88 bp, Piromyces finnis
  Cellulose docking domain, dockering
aaaattcattttagaaagaggatataaatgttgttcagataattgtgaagttacccattctgacgaaaatggtgattggggttatgaa

SEQ ID NO: 19404 - DNA, 88 bp, Piromyces finnis
  Cellulose docking domain, dockering
ctgttggtctgatgttcttggttattcatgttgtagtaaatgcctcgaagccgtttatgaagatcaagatggtaaatggggtgttgaa

SEQ ID NO: 19405 - DNA, 108 bp, Piromyces finnis
  Cellulose docking domain, dockering
tggtggattagattatgaatgctgttctagcttaaatgttaaattacaatccattgatgctgatgctaaatggggttttgaaaatggtaaatggtgtattattgaatt

SEQ ID NO: 19406 - DNA, 123 bp, Piromyces finnis
  Cellulose docking domain, dockering
atgttggtctaaaaaatttggttatgattgttgtgttttaccagaaactagagccatctacagtgatgcaaatggaaagtatggtgtagaatttaaacaaaaatgtggtattgttgattctat

SEQ ID NO: 19407 - DNA, 102 bp, Piromyces finnis
  Cellulose docking domain, dockering
taattatccatgttgtgttaaaactgaaaaaggaacatacagtgatggagatggtgactgggctcaagaaaacggtgattggtgtactataagacattctaa

SEQ ID NO: 19408 - DNA, 91 bp, Piromyces finnis; identical to SEQ ID NO: 16885
  Cellulose docking domain, dockering

SEQ ID NO: 19409 - DNA, 55 bp, Piromyces finnis
  Cellulose docking domain, dockering
tggtaaatggagtgttgaaaatggtgattggtgtttaattgatgaatccaaatgt

SEQ ID NO: 19410 - DNA, 88 bp, Piromyces finnis; identical to SEQ ID NO: 16887
  Cellulose docking domain, dockering

SEQ ID NO: 19411 - DNA, 111 bp, Piromyces finnis
  Cellulose docking domain, dockering
tcacccaagttacccatgttgtaacggttgtgatgttacctacgttgataacgaaggtgaatggggtgttcaaaacaacaactggtgtttcatcgacagtggtaagtgtca

SEQ ID NO: 19412 - DNA, 91 bp, Piromyces finnis
  Cellulose docking domain, dockering
ttgcttttctgaaactttaggatactcatgttgtgaaaacacaactgaagttgttcatgttgatgaaaatggtgaatggggtattgaaaat

SEQ ID NO: 19413 - DNA, 117 bp, Piromyces finnis
  Cellulose docking domain, dockering
atgtttctctcttaaatttggtgttccatgttgtaaacaaacaaaggatgttgtttatgttgatagtaatggtgaatggggtgttgaaaataacaactggtgtggtatgaagaaacc

SEQ ID NO: 19414 - DNA, 120 bp, Piromyces finnis
  Cellulose docking domain, dockering
atgctggtctgaagactttggttacccatgttgtaagggttgcattgtttatgaagaagatgaacatggtcaatggggttatgactttactgaagctacctggtgtggtattcaatcctt

SEQ ID NO: 19415 - DNA, 123 bp, Piromyces finnis
  Cellulose docking domain, dockering
atgttgggttgctcaattcggttatccatgctgtgctaaaaacaacaagattgtttatgatgttgatgctgatggtgaatggggttacaactttaaaactaaggaatggtgtggtattactcc

SEQ ID NO: 19416 - DNA, 96 bp, Piromyces finnis
  Cellulose docking domain, dockering
aaattatgaatgttgtaatggatgtgatgtagtctatacagatgccgaaggtaaatggggtgttgaaaacaacaattggtgcataattaataaatg

SEQ ID NO: 19417 - DNA, 105 bp, Piromyces finnis
  Cellulose docking domain, dockering
aactcaatatccatggtgtaatggatgtaaggtctattatacagatgctgaaggtaattggggtgttgaaaacaatgattggtgtttaattaaaagttcatgcaa

SEQ ID NO: 19418 - DNA, 105 bp, Piromyces finnis; identical to SEQ ID NO: 19417
  Cellulose docking domain, dockering

SEQ ID NO: 19419 - DNA, 96 bp, Piromyces finnis; identical to SEQ ID NO: 19416
  Cellulose docking domain, dockering

SEQ ID NO: 19420 - DNA, 103 bp, Piromyces finnis; identical to SEQ ID NO: 16898
  Cellulose docking domain, dockering

SEQ ID NO: 19421 - DNA, 105 bp, Piromyces finnis
  Cellulose docking domain, dockering
acaatctggtttcccatgttgtttagatttaaatggtggtattatttccgttgatggtgctggtgaatggaatattgaaggtagtatttggtgtttatacgatag

SEQ ID NO: 19422 - DNA, 117 bp, Piromyces finnis
  Cellulose docking domain, dockering
cccaggtatcaagtacggttatgaatgctgtgaaaaatgtgatgtagttgaaactgatgaacttggacaatggggtgccattaatggtgaatggtgtagtattaagaagtcttgcaa

SEQ ID NO: 19423 - DNA, 120 bp, Piromyces finnis
  Cellulose docking domain, dockering
atgtccaggtaaaaaatatggatatccatgttgtgaaaaatgtgatgtatttttaactgataaagatggtgcatggggtgtccaaaacagtaattggtgtagtgtaaaagatagttgttt

SEQ ID NO: 19424 - DNA, 114 bp, Piromyces finnis
  Cellulose docking domain, dockering
ttgctggagtcaaggattaggtttccaatgctgttctggatgtaatgttgaatatgtcgacagtgatggtgaatggggtttagaaaacggtgaatggtgtggtattccaacatg

SEQ ID NO: 19425 - DNA, 114 bp, Piromyces finnis; identical to SEQ ID NO: 19424
  Cellulose docking domain, dockering

SEQ ID NO: 19426 - DNA, 120 bp, Piromyces finnis; identical to SEQ ID NO: 19423
  Cellulose docking domain, dockering

SEQ ID NO: 19427 - DNA, 112 bp, Piromyces finnis; identical to SEQ ID NO: 16904
  Cellulose docking domain, dockering

SEQ ID NO: 19428 - DNA, 120 bp, Piromyces finnis
  Cellulose docking domain, dockering
ttgttggtcattatcattaggttataattgctgttctgctggtgctgaagtcattttagtagatgaaaatggagaatggggctttgaaatgaatgaatggtgtggtattatcaaaaatcc

SEQ ID NO: 19429 - DNA, 91 bp, Piromyces finnis; identical to SEQ ID NO: 16906
  Cellulose docking domain, dockering

SEQ ID NO: 19430 - DNA, 114 bp, Piromyces finnis
  Cellulose docking domain, dockering
taaaagtggaggcggtgaatataaatgttgtaaaggttgtcaaattatttacactgataatgaggattggggtgtagaaaatgataattggtgttccattccatattcatgtta

SEQ ID NO: 19431 - DNA, 120 bp, Piromyces finnis
  Cellulose docking domain, dockering
ttgctggtcaaccaatctcggttttccatgttgtcaattaaagacaactaaagttcaatatggtgataatactaatagtcaatttggtattgaaaatggtcaattatgtggtattaatga

SEQ ID NO: 19432 - DNA, 114 bp, Piromyces finnis
  Cellulose docking domain, dockering
ttggtcaagaaaattaggatacccatgttgctcggaaggagctttagttgttaatgttgatgaaaatggaaaatggggtatagataaagataattggtgtggtatattagaacc

SEQ ID NO: 19433 - DNA, 102 bp, Piromyces finnis
  Cellulose docking domain, dockering
gaatactggttatccatgttgtagtgatccaaaggcctctattattaccaatgatatttcaggtgattggggtattgaaggtaatacatggtgtttaattga

SEQ ID NO: 19434 - DNA, 120 bp, Piromyces finnis
  Cellulose docking domain, dockering
atgttggtctttagaaagaggttatccatgttgtgaaactaatactgaagtattctatacttcttctaatggtaaaacttggagtattgaaaataatgactggtgcggtattaatgaata

SEQ ID NO: 19435 - DNA, 105 bp, Piromyces finnis
  Cellulose docking domain, dockering
tgcctacagtgactgtaaaaattgtagagtcgttactgttgaagatggtgtcagttggggtgtagaaaacaacgactggtgtgttatcaaatcttctatttgtaa

SEQ ID NO: 19436 - DNA, 67 bp, Piromyces finnis
  Cellulose docking domain, dockering
agattatccatgctgttctggttgtgatgctatttacgaagacgatgatggtaaatggggtgttgaa

SEQ ID NO: 19437 - DNA, 126 bp, Piromyces finnis
  Cellulose docking domain, dockering
atgttgggcctcttctgaaggttacaaatgctgtcaaaacacttgtgatgctatttactctgaaggtagcaagaagtggggtttcgaaaatggtgactggtgtggtattgttgataacagatgcat

SEQ ID NO: 19438 - DNA, 94 bp, Piromyces finnis; identical to SEQ ID NO: 16917
  Cellulose docking domain, dockering

SEQ ID NO: 19439 - DNA, 126 bp, Piromyces finnis
  Cellulose docking domain, dockering
ctcaagttctttcaaaaatcaaggttattcctgttgtaagggttgctcagttgtcgacactgatgcaactggtgactggggtgttgaaaacggccaatggtgtggtatcgatacccaagcttgtaa

SEQ ID NO: 19440 - DNA, 114 bp, Piromyces finnis
  Cellulose docking domain, dockering
ctcaagttctttcaaaaatcaaggttattcctgttgtaagggttgctcagttgtcgacactgatgcaactggtgactggggtgttgaaaacggccaatggtgtggttgtggcgg

SEQ ID NO: 19441 - DNA, 117 bp, Piromyces finnis
  Cellulose docking domain, dockering
cattaccaaccaaggttacaagtgctgttccggttgttcctacgtttactacgaagaccaagatggtaaatggggtgttgaaaacaatgactggtgtggtatcaaggacagttgctt

SEQ ID NO: 19442 - DNA, 97 bp, Piromyces finnis; identical to SEQ ID NO: 16922
  Cellulose docking domain, dockering

SEQ ID NO: 19443 - DNA, 120 bp, Piromyces finnis
  Cellulose docking domain, dockering
ctgttggtctcttgcagaaggttataaatgttgtagtgaaggtactcctgttgtacttacagatagtaagggtaaatggggtattgaaaataatgattggtgcggtatagttactaagac

SEQ ID NO: 19444 - DNA, 91 bp, Piromyces finnis; identical to SEQ ID NO: 16923
  Cellulose docking domain, dockering

SEQ ID NO: 19445 - DNA, 106 bp, Piromyces finnis
  Cellulose docking domain, dockering
ttgttgggctaatgctgaaggttataattgttgtaaatctactacacaagttgttctcactgatagtaaaggaaaatggggtattgaaaataatcaatggtgtggt

SEQ ID NO: 19446 - DNA, 96 bp, Piromyces finnis
  Cellulose docking domain, dockering
taaatgttgtaaaaattgtaatgttgttttagatgataatactggtaaatggggtgtcgaaaataatcaatggtgtggtattgatacttcatgtac

SEQ ID NO: 19447 - DNA, 82 bp, Piromyces finnis; identical to SEQ ID NO: 16928
  Cellulose docking domain, dockering

SEQ ID NO: 19448 - DNA, 123 bp, Piromyces finnis
  Cellulose docking domain, dockering
ttgttgggccgaagctcttggttacaagtgttgttcagctggtaactacatggttcttcttacagatgaaagtggagcctggggtgccgaaaatggagaatggtgtggtattgttaaggatgc

SEQ ID NO: 19449 - DNA, 117 bp, Piromyces finnis
  Cellulose docking domain, dockering
ctgtttcgccaagtctgatggttacgaatgttgtttcgataatgaagttgtttatgaagatgaaagtggtaaatggggtattaatgaaaagggagaatggtgtggtgttgaacaacc

SEQ ID NO: 19450 - DNA, 123 bp, Piromyces finnis; identical to SEQ ID NO: 19448
  Cellulose docking domain, dockering

SEQ ID NO: 19451 - DNA, 82 bp, Piromyces finnis; identical to SEQ ID NO: 16928
  Cellulose docking domain, dockering

SEQ ID NO: 19452 - DNA, 117 bp, Piromyces finnis; identical to SEQ ID NO: 19449
  Cellulose docking domain, dockering

SEQ ID NO: 19453 - DNA, 103 bp, Piromyces finnis; identical to SEQ ID NO: 16932
  Cellulose docking domain, dockering

SEQ ID NO: 19454 - DNA, 96 bp, Piromyces finnis
  Cellulose docking domain, dockering
ttaccaatgctgtgctgatggtactgaagtaatttatactgacgaatctggagattggggtgttattaatgatgaatggtgtggtattaagaaaac

SEQ ID NO: 19455 - DNA, 123 bp, Piromyces finnis
  Cellulose docking domain, dockering
ttgcttttctacaagtatgggatacccatgttgttcaggatgtgaagatatctatgaagatgatgatggtaaatggggtgtagaaaatgatgattggtgtggtattgatgaagccaaatgtaa

SEQ ID NO: 19456 - DNA, 102 bp, Piromyces finnis
  Cellulose docking domain, dockering
agactacccatgctgtgaaggtgataccgtaatttacagtgatgaaagtggtgactggggtgttgaaaacgacgaatggtgtggtattgtaaaatcatctgc

SEQ ID NO: 19457 - DNA, 106 bp, Piromyces finnis
  Cellulose docking domain, dockering
atgttgggctgaagcattaggatatgaatgttgtagtacttgtcaaccatcacaatataaagatgaaagtggtgaatggggtgttgaaaatggtgaatggtgtggt

SEQ ID NO: 19458 - DNA, 120 bp, Piromyces finnis
  Cellulose docking domain, dockering
ttgctgggccaatgccttaaattacccatgttgtaagaccaccactgaagttgttttaactgataatgatggtaagtggggtattgaaaataatgaatggtgtggtattaactccagctc

SEQ ID NO: 19459 - DNA, 72 bp, Piromyces finnis
  Cellulose docking domain, dockering
agctatatttacagatggtgaaaagaaatggggtgttgaaaatggtcaatggtgtggtatgccaaatggtca

SEQ ID NO: 19460 - DNA, 78 bp, Piromyces finnis
  Cellulose docking domain, dockering
agctatatttacagatggtgaaaagaaatggggtgttgaaaatggtcaatggtgtggtattattgaaagtcaatgtca

SEQ ID NO: 19461 - DNA, 102 bp, Piromyces finnis
  Cellulose docking domain, dockering
tcttggttatccatgttgtcaatcaacttcttctgtagttttcactgataacactggaaaatggggtatagaaaataatgattggtgtgaaataaaagaaaa

SEQ ID NO: 19462 - DNA, 120 bp, Piromyces finnis; identical to SEQ ID NO: 19458
  Cellulose docking domain, dockering

SEQ ID NO: 19463 - DNA, 114 bp, Piromyces finnis; identical to SEQ ID NO: 19281
  Cellulose docking domain, dockering

SEQ ID NO: 19464 - DNA, 108 bp, Piromyces finnis
  Cellulose docking domain, dockering
tgctgctgattacccatgttgtgaacaatgtaatattgtatctgaagaagaaggtgacttctggggtgtcgaaaacaatgaatggtgtagtattaaattcaaatgtta

SEQ ID NO: 19465 - DNA, 108 bp, Piromyces finnis; identical to SEQ ID NO: 19464
  Cellulose docking domain, dockering

SEQ ID NO: 19466 - DNA, 117 bp, Piromyces finnis
  Cellulose docking domain, dockering
ctgttgggcaaataaattaggttacgattgttgcaaaactagtaaggaagtatatgaagatgtagagggaaagtggggtgtagaaaatggaaattggtgtggtatcgttgaagaaga

SEQ ID NO: 19467 - DNA, 114 bp, Piromyces finnis; identical to SEQ ID NO: 19281
  Cellulose docking domain, dockering

SEQ ID NO: 19468 - DNA, 123 bp, Piromyces finnis
  Cellulose docking domain, dockering
atgttggtctcttaagtatggttatgaatgctgttctccaaataacactagagttgttgtcaccgatgaaagtggaaagtggggtgttgaaaacagtgattggtgtggtattgtagacagcaa

SEQ ID NO: 19469 - DNA, 117 bp, Piromyces finnis; identical to SEQ ID NO: 19466
  Cellulose docking domain, dockering

SEQ ID NO: 19470 - DNA, 123 bp, Piromyces finnis
  Cellulose docking domain, dockering
atgctggtctattccattcggttacaaatgctgtgatcactgtaaagtcctcttaactgatgaaagtggtaaatggggtgaattaaacggtgaatggtgtggtattgatactactaaatgtaa

SEQ ID NO: 19471 - DNA, 123 bp, Piromyces finnis; identical to SEQ ID NO: 19470
  Cellulose docking domain, dockering

SEQ ID NO: 19472 - DNA, 123 bp, Piromyces finnis; identical to SEQ ID NO: 19468
  Cellulose docking domain, dockering

SEQ ID NO: 19473 - DNA, 108 bp, Piromyces finnis; identical to SEQ ID NO: 19464
  Cellulose docking domain, dockering

SEQ ID NO: 19474 - DNA, 114 bp, Piromyces finnis; identical to SEQ ID NO: 19281
  Cellulose docking domain, dockering

SEQ ID NO: 19475 - DNA, 100 bp, Piromyces finnis; identical to SEQ ID NO: 16954
  Cellulose docking domain, dockering

SEQ ID NO: 19476 - DNA, 100 bp, Piromyces finnis; identical to SEQ ID NO: 16954
  Cellulose docking domain, dockering

SEQ ID NO: 19477 - DNA, 123 bp, Piromyces finnis
  Cellulose docking domain, dockering
ttctgctaatattttgaaacaaggatacaagtgttgttcctccaccaactgtacaatagttttcactgataatgatggcacttggggtgttgaaaataatcaatggtgtggatgtgctagcaa

SEQ ID NO: 19478 - DNA, 120 bp, Piromyces finnis
  Cellulose docking domain, dockering
ttcaattacctcccaaggatattcatgttgtgctggtaataattgttctgttgttctcacggatgaatctggaagatggggagttgaaaataatcaatggtgtggtatttctaatgactg

SEQ ID NO: 19479 - DNA, 99 bp, Piromyces finnis
  Cellulose docking domain, dockering
atacttatgttgtgatggttgtaatgttgttgaagaaactgctgaaggtaaatggggtattgaaaacaactattggtgtggtattaagaattcatgctt

SEQ ID NO: 19480 - DNA, 102 bp, Piromyces finnis
  Cellulose docking domain, dockering
ggcttatgactactgtaatgcttgtggtgttgttttagaagaagacggagttaaatggggtgttgaaaataacgattggtgtattatcccatctaaatgtag

SEQ ID NO: 19481 - DNA, 123 bp, Piromyces finnis
  Cellulose docking domain, dockering
atgtgaagctgaagaatatggatacatttgttgtccaaattatctgacagaggttctttatcaagatgaagaaggagattgggcatatgattacgtcatggaggattggtgtattatcaattt

SEQ ID NO: 19482 - DNA, 120 bp, Piromyces finnis
  Cellulose docking domain, dockering
atgttggactagccccttaggctatgaatgttgtgattcttgtgatgttatatatgaagataataatggacagtggggtgttaaaaataataaatggtgtggcattttacctaattgtaa

SEQ ID NO: 19483 - DNA, 123 bp, Piromyces finnis
  Cellulose docking domain, dockering
atgttgggctgaattcattggatatcaatgttgttcagctgaaaacaccgatgtctatttacacgacagcaatggtgattggggttatgatttcgatacaaatgaatggtgtggtattactcc

SEQ ID NO: 19484 - DNA, 120 bp, Piromyces finnis
  Cellulose docking domain, dockering
atgctggtcagaagaacttggttatccatgttgtaaagattgtacagtttatgaaactgatgaaagtggagaatggggttatgattttaaaaacatgcaatggtgtggtattcaatccta

SEQ ID NO: 19485 - DNA, 109 bp, Piromyces finnis
  Cellulose docking domain, dockering
ttcttgctgggctcaaagtcaaggttacagttgctgtagcaacccaggtagcaccaaggtcgaattcactgacgccagtggtaactggggtattgaaaacggtaactgg

SEQ ID NO: 19486 - DNA, 109 bp, Piromyces finnis; identical to SEQ ID NO: 19485
  Cellulose docking domain, dockering

SEQ ID NO: 19487 - DNA, 67 bp, Piromyces finnis
  Cellulose docking domain, dockering
cccagcttatccatgctgtaaaggaaacaccgtagtttatactgataacgaaggtagttggggtgta

SEQ ID NO: 19488 - DNA, 67 bp, Piromyces finnis; identical to SEQ ID NO: 19487
  Cellulose docking domain, dockering

SEQ ID NO: 19489 - DNA, 129 bp, Piromyces finnis
  Cellulose docking domain, dockering
atgctgggccgaaaaattaggttataaatgttgtccagacgatgtatgtacaacacttcatagtgacgctaacggagaatggagtattgtaaatgatgaatggtgtggtattatttcttctctatgtaa

SEQ ID NO: 19490 - DNA, 129 bp, Piromyces finnis
  Cellulose docking domain, dockering
atgttgggcaaaaaaattaaattatccatgttgtaaaaaagataattgtatgaaattttatgtaaatgatgatggagcttggggttttgagaattggaaatggtgtggtattgatacagagtattgtga

SEQ ID NO: 19491 - DNA, 117 bp, Piromyces finnis
  Cellulose docking domain, dockering
atgctgggccgaaaaattaggttataaatgttgtccagacgatgtatgtacaacacttcatagtgacgctaacggagaatggagtattgtaaatgatgaatggtgtggtattattga

SEQ ID NO: 19492 - DNA, 129 bp, Piromyces finnis; identical to SEQ ID NO: 19490
  Cellulose docking domain, dockering

SEQ ID NO: 19493 - DNA, 129 bp, Piromyces finnis
  Cellulose docking domain, dockering
atgttggtcaaaaccacttggttatgattgttgtgttgatccatacattcaaatagcatattctgatgatgatggtgattggggttatgaaaatgatgaatggtgtggtattatttcttctctatgtaa

SEQ ID NO: 19494 - DNA, 123 bp, Piromyces finnis
  Cellulose docking domain, dockering
atgttggtcaaaaccacttggttatgattgttgtgttgatccatacattcaaatagcatattctgatgatgatggtgattggggttatgaaaatgatgaatggtgtggtattatagaaaatgg

SEQ ID NO: 19495 - DNA, 108 bp, Piromyces finnis
  Cellulose docking domain, dockering
aggttacccatgctgtaaaagatcctgtattgttgtcgaagaaaatgcatctggtaaatggagtcttgaaaagcatgattggtgtttaattgatcttgaagtttgtcg

SEQ ID NO: 19496 - DNA, 120 bp, Piromyces finnis
  Cellulose docking domain, dockering
atgttggtctgaaaaattaggttataaatgttgtaaatcttgtgatattattcttaaagatgcttcaggaaaatggggtgttgaagatggtaaatggtgtggtattccaagtacatgtac

SEQ ID NO: 19497 - DNA, 129 bp, Piromyces finnis; identical to SEQ ID NO: 19490
  Cellulose docking domain, dockering

SEQ ID NO: 19498 - DNA, 123 bp, Piromyces finnis
  Cellulose docking domain, dockering
atgctgggccgaaaaattaggttataaatgttgtccagacgatgtatgtacaacacttcatagtgacgctaacggagaatggagtattgtaaatgatgaatggtgtggtattatagaaaatgg

SEQ ID NO: 19499 - DNA, 88 bp, Piromyces finnis; identical to SEQ ID NO: 16979
  Cellulose docking domain, dockering

SEQ ID NO: 19500 - DNA, 120 bp, Piromyces finnis
  Cellulose docking domain, dockering
ttgttggtcaataaaacttggttatccatgttgtcctgaagatactactataattaccactgatgatgatggagattggggaatttataatgaaaattggtgtggaatactaaaaaaaga

SEQ ID NO: 19501 - DNA, 135 bp, Piromyces finnis
  Cellulose docking domain, dockering
atgctggtccttagctttatcaattccatgttgtaacaaaaataaagaaatctactccaaggatcaagatggtaactggggtataacaacggatgaaaatggaaattcaatatggtgtggtataagaaaaagtaa

SEQ ID NO: 19502 - DNA, 120 bp, Piromyces finnis
  Cellulose docking domain, dockering
atgttggtccagagctggtggatatccatgttgtgaaggtggtgaatctattgctttaattgatcaagatggtatatggggtcaaaatgctaatggcaattggtgtggatttagagaaag

SEQ ID NO: 19503 - DNA, 132 bp, Piromyces finnis
  Cellulose docking domain, dockering
ctgttggtcagaaaaattaggttacccatgttgtccagaagaaataactcagcctaattataaagatagtgaaggcgattgggtttttaatagtaatggtgaatggtgtggcataagaaatggtagatgttg

SEQ ID NO: 19504 - DNA, 88 bp, Piromyces finnis; identical to SEQ ID NO: 16986
  Cellulose docking domain, dockering

SEQ ID NO: 19505 - DNA, 132 bp, Piromyces finnis; identical to SEQ ID NO: 19503
  Cellulose docking domain, dockering

SEQ ID NO: 19506 - DNA, 120 bp, Piromyces finnis; identical to SEQ ID NO: 19502
  Cellulose docking domain, dockering

SEQ ID NO: 19507 - DNA, 96 bp, Piromyces finnis
  Cellulose docking domain, dockering
ttaccaatgttgtaagggtaatgttgttgttcaatctgatagcaatggtgattggggttacgaagacggtcaatggtgtggtatcatcaagaagac

SEQ ID NO: 19508 - DNA, 123 bp, Piromyces finnis
  Cellulose docking domain, dockering
ttgctggtcttctgctttaggttaccaatgttgtaagggatgctccgtaatttctgaagatgctgatggcaaatggggttttgaagacaaacactggtgtggtattgttgatgatgtttgtaa

SEQ ID NO: 19509 - DNA, 102 bp, Piromyces finnis
  Cellulose docking domain, dockering
agactatccatgttgtaagactaccagcctcgttgtctcatctgatgctgaaggtgactggggttatgaagacaaccaatggtgtggtatcgtaaaggatgc

SEQ ID NO: 19510 - DNA, 123 bp, Piromyces finnis
  Cellulose docking domain, dockering
ttgctggtcttctactatgggataccaatgttgtaaaagttgttcagtcattgctgaagatagtgatggtaaatggggttttgaagacaaacactggtgtggtattgttgatgatgtttgtaa

SEQ ID NO: 19511 - DNA, 96 bp, Piromyces finnis; identical to SEQ ID NO: 19507
  Cellulose docking domain, dockering

SEQ ID NO: 19512 - DNA, 102 bp, Piromyces finnis; identical to SEQ ID NO: 19509
  Cellulose docking domain, dockering

SEQ ID NO: 19513 - DNA, 96 bp, Piromyces finnis
  Cellulose docking domain, dockering
ttaccaatgttgtaagggtaatgaagttgttttcactgatcataacggtgactggggtttcgaaaataaccaatggtgtggtattgttaaaaaagc

SEQ ID NO: 19514 - DNA, 99 bp, Piromyces finnis
  Cellulose docking domain, dockering
ttacccatgttgtaaaaatactagtcttgttgttgcttctgatgcacaaggtgactggggttatgaagataatcaatggtgtggtattgtaaaggatgc

SEQ ID NO: 19515 - DNA, 102 bp, Piromyces finnis
  Cellulose docking domain, dockering
agattatccatgttgcccaacttgcgacgttttcttaactgaagaagatggtaatcgttggggtgttctatatgataactggtgtagtattaagaattcctg

SEQ ID NO: 19516 - DNA, 123 bp, Piromyces finnis
  Cellulose docking domain, dockering
tccatcttctattacaagtcaaggttatgcttgttgtagaggttgtgacgttgtatatactgatgaaaatggtgattggggtatagaaaatgattattggtgtggtatttctcaatcatgtaa

SEQ ID NO: 19517 - DNA, 108 bp, Piromyces finnis
  Cellulose docking domain, dockering
aaaaaaacaaggatatccatgttgttcaagttgtattgtgtatttttctgataaagatggccaatggggtgtagaaaatggtaaatggtgtggtattcaagattattg

SEQ ID NO: 19518 - DNA, 120 bp, Piromyces finnis
  Cellulose docking domain, dockering
ttgtttctctacaaagttaggttacccatgctgtacttcaactactcaagttgttttcaccgataatgatggtaactggggtgttgaaaacaacgactggtgtggtttaactaacaacgg

SEQ ID NO: 19519 - DNA, 120 bp, Piromyces finnis; identical to SEQ ID NO: 19518
  Cellulose docking domain, dockering

SEQ ID NO: 19520 - DNA, 124 bp, Piromyces finnis
  Cellulose docking domain, dockering
ctgctggtcagaaatttatggttatccatgctgtagtggctgtgatgttatctatgaagaatctgaaactatgagatggggtgttgaaaacaatgattggtgtggtatcataaattctaattgt

SEQ ID NO: 19521 - DNA, 124 bp, Piromyces finnis
  Cellulose docking domain, dockering
atgttggtctgaaaaattaggattcccatgttgtagcaaatgtggacaagttgtttacaccgatgaagatggtaactggagtgttgaaaacaatgattggtgtggtatcataaattctaattgt

SEQ ID NO: 19522 - DNA, 120 bp, Piromyces finnis
  Cellulose docking domain, dockering
ctgtgctgccgcttctcaaggttatccatgctgcaaaaaccaaaatgctgaagtttactaccaagatgaaactggtgattggggtattgaaaatggtgaatggtgtggtatcactaaggc

SEQ ID NO: 19523 - DNA, 99 bp, Piromyces finnis
  Cellulose docking domain, dockering
cgaatatccatgttgtgaagactgtgttgttgtttatgaagataatcaaaagtggggcattttaaataatgactggtgtagtactccatattcatgtga

SEQ ID NO: 19524 - DNA, 100 bp, Piromyces finnis; identical to SEQ ID NO: 17007
  Cellulose docking domain, dockering

SEQ ID NO: 19525 - DNA, 103 bp, Piromyces finnis; identical to SEQ ID NO: 17009
  Cellulose docking domain, dockering

SEQ ID NO: 19526 - DNA, 120 bp, Piromyces finnis
  Cellulose docking domain, dockering
atgttggtctgaagctttaggttacaaatgctgttctcactgcgttgctatattagaagatcaagatggtgcatggggttctgaaaatggtgaatggtgtggtattcaaaatgaatgtac

SEQ ID NO: 19527 - DNA, 120 bp, Piromyces finnis
  Cellulose docking domain, dockering
atgttggtcaatgaaatatggttatccatgttgtgaagattgtcaattatacttagaagatgaatctggtgcttggggtgtattaaattatgattggtgtggtattccaagttcatgtaa

SEQ ID NO: 19528 - DNA, 120 bp, Piromyces finnis
  Cellulose docking domain, dockering
atgttggtctgaagctttaggttacaaatgctgttctcactgcgttgctatattagaagatcaagatggtgcatggggttctgaaaatggtgaatggtgtggtattccagatacttgtcc

SEQ ID NO: 19529 - DNA, 123 bp, Piromyces finnis
  Cellulose docking domain, dockering
atgttggtctaaacgtttaggttatgaatgttgtaaacagaaatttgaagttgttgaaaccgatgaaaatggttcatggagtatagaaaataatgaatggtgtggtattccagaaaattgttc

SEQ ID NO: 19530 - DNA, 105 bp, Piromyces finnis
  Cellulose docking domain, dockering
tggaaattatccttgttgtccggaaggaacgccaattcaatattcagatgatgaaggagattggggtgtttatatggataattggtgtggtatcgttaaaaatat

SEQ ID NO: 19531 - DNA, 123 bp, Piromyces finnis
  Cellulose docking domain, dockering
ctggtctatggctggtggttttccatgttgttctccagaaaataccaatgttgtttatcgtgaccaagatggtaaatggggtcttgatgaagatggaaattggtgtggtatgaagaatagtgt

SEQ ID NO: 19532 - DNA, 99 bp, Piromyces finnis
  Cellulose docking domain, dockering
ctatccatgttgtgacagttgtgatgtagtcttctctgatactcttggtgactggggtgttcaaaacgatcaatggtgtggtattaaagcatcatgtaa

SEQ ID NO: 19533 - DNA, 88 bp, Piromyces finnis
  Cellulose docking domain, dockering
ctctgaaccagattacccatgttgtaaatccacatgcaatgttgttgataccgatgctaacggtaaatggggtgttgaaaatggtgaa

SEQ ID NO: 19534 - DNA, 117 bp, Piromyces finnis
  Cellulose docking domain, dockering
atgttggtctaaacgtttaggttatgaatgttgtaaacagaaatttgaagttgttgaaaccgatgaaaatggttcatggagtatagaaaataatgaatggtgtggtattccatttaa

SEQ ID NO: 19535 - DNA, 123 bp, Piromyces finnis; identical to SEQ ID NO: 19531
  Cellulose docking domain, dockering

SEQ ID NO: 19536 - DNA, 105 bp, Piromyces finnis; identical to SEQ ID NO: 19530
  Cellulose docking domain, dockering

SEQ ID NO: 19537 - DNA, 117 bp, Piromyces finnis
  Cellulose docking domain, dockering
ctgttgggctggtgctttaggttatccatgttgtgaaggttgtgatgttgtttataccgataacgatggaaaatggggttatgaagatgattggtgtggtattaaagaatcttgttc

SEQ ID NO: 19538 - DNA, 105 bp, Piromyces finnis
  Cellulose docking domain, dockering
aaattatccatgttgttcttcttttaacactgttgtaacttatacggatcaagatggtaactggggttttgaaaatgatgattggtgtggtatgagagatagtga

SEQ ID NO: 19539 - DNA, 114 bp, Piromyces finnis
  Cellulose docking domain, dockering
ttggtcagaaccaaaatatccttgttgttcagaaggtgttaaagtttattcaaaaactagtagtggtgaatggggtattgaaaatggaaattggtgtggtatacctagagatga

SEQ ID NO: 19540 - DNA, 123 bp, Piromyces finnis
  Cellulose docking domain, dockering
ttgttgggctaaacctttagggtataactgttgtcacggagaaacccaagttatatacacagataatgatggtcaatggggtagtgaagatggtaaatggtgcggtattatatcaaacaattc

SEQ ID NO: 19541 - DNA, 105 bp, Piromyces finnis; identical to SEQ ID NO: 19538
  Cellulose docking domain, dockering

SEQ ID NO: 19542 - DNA, 114 bp, Piromyces finnis
  Cellulose docking domain, dockering
atgctgggcttcttctttaggctacgattgctgtgaaggatgtgatattataactactgatgaatatggtgaatggggtattgaaaatggaaattggtgtggtatacctagaga

SEQ ID NO: 19543 - DNA, 105 bp, Piromyces finnis; identical to SEQ ID NO: 19538
  Cellulose docking domain, dockering

SEQ ID NO: 19544 - DNA, 114 bp, Piromyces finnis; identical to SEQ ID NO: 19542
  Cellulose docking domain, dockering

SEQ ID NO: 19545 - DNA, 123 bp, Piromyces finnis; identical to SEQ ID NO: 19540
  Cellulose docking domain, dockering

SEQ ID NO: 19546 - DNA, 120 bp, Piromyces finnis
  Cellulose docking domain, dockering
tccagttgaaagtaagggatacaagtgctgtaatgatccaaacttacaatcaatgtttgaagatgaagatggtcaatggtactatgaaaatgatgaatggtgtttaattgtatcaagtcc

SEQ ID NO: 19547 - DNA, 123 bp, Piromyces finnis; identical to SEQ ID NO: 19540
  Cellulose docking domain, dockering

SEQ ID NO: 19548 - DNA, 105 bp, Piromyces finnis; identical to SEQ ID NO: 19538
  Cellulose docking domain, dockering

SEQ ID NO: 19549 - DNA, 111 bp, Piromyces finnis
  Cellulose docking domain, dockering
ttggtcagaaccaaaatatccttgttgttcagaaggtgttaaagtttattcaaaaactagtagtggtgaatggggtattgaaaatggaaattggtgtggtatacctagaga

SEQ ID NO: 19550 - DNA, 123 bp, Piromyces finnis; identical to SEQ ID NO: 19540
  Cellulose docking domain, dockering

SEQ ID NO: 19551 - DNA, 111 bp, Piromyces finnis; identical to SEQ ID NO: 19549
  Cellulose docking domain, dockering

SEQ ID NO: 19552 - DNA, 105 bp, Piromyces finnis; identical to SEQ ID NO: 19538
  Cellulose docking domain, dockering

SEQ ID NO: 19553 - DNA, 120 bp, Piromyces finnis; identical to SEQ ID NO: 19546
  Cellulose docking domain, dockering

SEQ ID NO: 19554 - DNA, 114 bp, Piromyces finnis
  Cellulose docking domain, dockering
tccagttgaaagtaagggatacaagtgctgtaatgatccaaacttacaatcaatgtttgaagatgaagatggtcaatggtactatgaaaatgatgaatggtgtttaattgtatc

SEQ ID NO: 19555 - DNA, 111 bp, Piromyces finnis
  Cellulose docking domain, dockering
gaacactggttattcatgctgttctaatccaaatgcctatgtttacactaccgatatcaccggtaattggagtattgaaggtaattattggtgtttaattgttaaggatgt

SEQ ID NO: 19556 - DNA, 123 bp, Piromyces finnis
  Cellulose docking domain, dockering
atgctggtcaactagttttggttatccatgttgtcaatcaaaagatactactatttctttaacagaatttggtacaggaaatcaatatggtattgaaaatggacgtttttgtggtattacaga

SEQ ID NO: 19557 - DNA, 96 bp, Piromyces finnis
  Cellulose docking domain, dockering
atataagtgttgtaaaaaatgtaaagtagtttacactgataactatttatggggagcagaacataatgaatggtgttcaattccatattcatgtaa

SEQ ID NO: 19558 - DNA, 99 bp, Piromyces finnis
  Cellulose docking domain, dockering
ttataagtgttgttcccattgtgatgtttacttaacagatgaagtgggacaatggggtgttgaaaacaattattggtgtggtattccagaatcatgtaa

SEQ ID NO: 19559 - DNA, 123 bp, Piromyces finnis
  Cellulose docking domain, dockering
taatgctgaattcatcaaacaaggttacaagtgctgttcaggatgtagaactgtctactacactgatgatcttggtgactggggtgttgaagatggtgattggtgtggtattccaaccaattg

SEQ ID NO: 19560 - DNA, 102 bp, Piromyces finnis
  Cellulose docking domain, dockering
ttatgaatgttgtaataattgtcaagttatagaaactgatgatgaaggtagatggggtagccttaacggtgaatggtgtttcatcgatgaaagcaaatgtgg

SEQ ID NO: 19561 - DNA, 120 bp, Piromyces finnis
  Cellulose docking domain, dockering
ttgtaaatttgaacaatacggttataagtgttgttcccattgtgatgtttacttaacagatgaaatgggacaatggggtgttgaaaacaattattggtgtggtattccagaatcatgtaa

SEQ ID NO: 19562 - DNA, 123 bp, Piromyces finnis; identical to SEQ ID NO: 19559
  Cellulose docking domain, dockering

SEQ ID NO: 19563 - DNA, 102 bp, Piromyces finnis; identical to SEQ ID NO: 19560
  Cellulose docking domain, dockering

SEQ ID NO: 19564 - DNA, 120 bp, Piromyces finnis; identical to SEQ ID NO: 19561
  Cellulose docking domain, dockering

SEQ ID NO: 19565 - DNA, 123 bp, Piromyces finnis; identical to SEQ ID NO: 19559
  Cellulose docking domain, dockering

SEQ ID NO: 19566 - DNA, 111 bp, Piromyces finnis
  Cellulose docking domain, dockering
caattctggttatccatgttgtgttttcaccactacagttataatgtcagatagatcaggtaattggggtatagaatatggtcaatggtgttacataaaagaggaatgttg

SEQ ID NO: 19567 - DNA, 117 bp, Piromyces finnis
  Cellulose docking domain, dockering
atgttggtctcttaaagaaggttatcaatgttgtcaagatgaaaaaactaccattattccaacaaaagatggaaaagaatggggtatagaaaataacgaatggtgtggtatcactga

SEQ ID NO: 19568 - DNA, 96 bp, Piromyces finnis
  Cellulose docking domain, dockering
atacaaatgttgtgaaaaatgtaaagtagtttacagtgatggtgaagattggggtgttgaacatggaaattggtgttcaattccatacagctgtgc

SEQ ID NO: 19569 - DNA, 117 bp, Piromyces finnis
  Cellulose docking domain, dockering
atgttggtcagaagttttgggctattcttgttgtaaagataagaaaacaaaggtttcctatgttgatgcatcaggtgaatggggtgctgaacatggtcaatggtgtggtattactga

SEQ ID NO: 19570 - DNA, 102 bp, Piromyces finnis
  Cellulose docking domain, dockering
aaattcaggttatccatgttgtgtaaaaactaaaactcttgtttccagtgatgctgttggtgactggggtattgaaaataatgactggtgtctctttgaaac

SEQ ID NO: 19571 - DNA, 105 bp, Piromyces finnis
  Cellulose docking domain, dockering
taatactggctataattgttgtctctctgataaaactccctctagtactaccgataatattggtaagtggggtattgaaggtggtgattggtgtcttattgaagc

SEQ ID NO: 19572 - DNA, 64 bp, Piromyces finnis
  Cellulose docking domain, dockering
atataaatgttgtaaaaaatgtgaagttatcatgacagatgatgatggtgattggggtattgaa

SEQ ID NO: 19573 - DNA, 120 bp, Piromyces finnis
  Cellulose docking domain, dockering
ctgttggtccattaaatatggctattcttgttgtacaaataaaaatactaaagtttcttttgttgaacctactggtgaaaagtatggtattgaacatgatcaatggtgtggtattcatga

SEQ ID NO: 19574 - DNA, 105 bp, Piromyces finnis; identical to SEQ ID NO: 19571
  Cellulose docking domain, dockering

SEQ ID NO: 19575 - DNA, 120 bp, Piromyces finnis; identical to SEQ ID NO: 19573
  Cellulose docking domain, dockering

SEQ ID NO: 19576 - DNA, 64 bp, Piromyces finnis; identical to SEQ ID NO: 19572
  Cellulose docking domain, dockering

SEQ ID NO: 19577 - DNA, 96 bp, Piromyces finnis; identical to SEQ ID NO: 19568
  Cellulose docking domain, dockering

SEQ ID NO: 19578 - DNA, 102 bp, Piromyces finnis; identical to SEQ ID NO: 19570
  Cellulose docking domain, dockering

SEQ ID NO: 19579 - DNA, 117 bp, Piromyces finnis; identical to SEQ ID NO: 19569
  Cellulose docking domain, dockering

SEQ ID NO: 19580 - DNA, 102 bp, Piromyces finnis; identical to SEQ ID NO: 19570
  Cellulose docking domain, dockering

SEQ ID NO: 19581 - DNA, 117 bp, Piromyces finnis; identical to SEQ ID NO: 19569
  Cellulose docking domain, dockering

SEQ ID NO: 19582 - DNA, 96 bp, Piromyces finnis; identical to SEQ ID NO: 19568
  Cellulose docking domain, dockering

SEQ ID NO: 19583 - DNA, 105 bp, Piromyces finnis; identical to SEQ ID NO: 19571
  Cellulose docking domain, dockering

SEQ ID NO: 19584 - DNA, 120 bp, Piromyces finnis; identical to SEQ ID NO: 19573
  Cellulose docking domain, dockering

SEQ ID NO: 19585 - DNA, 64 bp, Piromyces finnis; identical to SEQ ID NO: 19572
  Cellulose docking domain, dockering

SEQ ID NO: 19586 - DNA, 64 bp, Piromyces finnis; identical to SEQ ID NO: 19572
  Cellulose docking domain, dockering

SEQ ID NO: 19587 - DNA, 105 bp, Piromyces finnis; identical to SEQ ID NO: 19571
  Cellulose docking domain, dockering

SEQ ID NO: 19588 - DNA, 120 bp, Piromyces finnis; identical to SEQ ID NO: 19573
  Cellulose docking domain, dockering

SEQ ID NO: 19589 - DNA, 129 bp, Piromyces finnis
  Cellulose docking domain, dockering
atgttggtcagaaaaacttggttattcttgctgtaaaaataagaatacaaaaattagttatatttctagatcgacaggtaaagaattatattatggtgttgaacacggtcaatggtgtggtatcacaga

SEQ ID NO: 19590 - DNA, 111 bp, Piromyces finnis
  Cellulose docking domain, dockering
taattctggttatagttgttgttccctttcaaatactgaagttagaactaccgatgcggtaggtaaatggggtattgaaggtgaagaatggtgtcttattgatgaagaagt

SEQ ID NO: 19591 - DNA, 64 bp, Piromyces finnis; identical to SEQ ID NO: 19572
  Cellulose docking domain, dockering

SEQ ID NO: 19592 - DNA, 105 bp, Piromyces finnis; identical to SEQ ID NO: 19571
  Cellulose docking domain, dockering

SEQ ID NO: 19593 - DNA, 120 bp, Piromyces finnis; identical to SEQ ID NO: 19573
  Cellulose docking domain, dockering

SEQ ID NO: 19594 - DNA, 117 bp, Piromyces finnis; identical to SEQ ID NO: 19569
  Cellulose docking domain, dockering

SEQ ID NO: 19595 - DNA, 102 bp, Piromyces finnis; identical to SEQ ID NO: 19570
  Cellulose docking domain, dockering

SEQ ID NO: 19596 - DNA, 96 bp, Piromyces finnis; identical to SEQ ID NO: 19568
  Cellulose docking domain, dockering

SEQ ID NO: 19597 - DNA, 117 bp, Piromyces finnis; identical to SEQ ID NO: 19569
  Cellulose docking domain, dockering

SEQ ID NO: 19598 - DNA, 96 bp, Piromyces finnis; identical to SEQ ID NO: 19568
  Cellulose docking domain, dockering

SEQ ID NO: 19599 - DNA, 102 bp, Piromyces finnis; identical to SEQ ID NO: 19570
  Cellulose docking domain, dockering

SEQ ID NO: 19600 - DNA, 129 bp, Piromyces finnis
  Cellulose docking domain, dockering
atgttggtctcttgctgaaggttatccatgttgtaagaatcaaaatactccagttaaatatgaatctaaatcaagaggtgttaaatacggtattgaaaacggtgattggtgtggtcttattgaatcaaa

SEQ ID NO: 19601 - DNA, 114 bp, Piromyces finnis
  Cellulose docking domain, dockering
ttgttggtcctctaagattggttatccatgttgtaaggaaaacaacgttatttacgccattgactctcaaggtagttggggttatgaaaatgattcatggtgtggtatttcaaa

SEQ ID NO: 19602 - DNA, 120 bp, Piromyces finnis
  Cellulose docking domain, dockering
ctgttgggcatctgctttaggtttcacttgttgtaaggcaaccaagactgtcgttatggaagatgctgatggtgcttggggtgttgaagatggtttctggtgtggtattgttgaagatac

SEQ ID NO: 19603 - DNA, 105 bp, Piromyces finnis; identical to SEQ ID NO: 17088
  Cellulose docking domain, dockering

SEQ ID NO: 19604 - DNA, 120 bp, Piromyces finnis
  Cellulose docking domain, dockering
ttgctggtcttccgctttaggttacccatgctgtaaatcttgtgatgctatataccaagataacgatggtaagtggggtttcgaaaacaatgactggtgtggtattgcttctagctgcac

SEQ ID NO: 19605 - DNA, 121 bp, Piromyces finnis
  Cellulose docking domain, dockering
atgttctggtgctttaggatacccatgctgtaaatctgcctgcactgtctatgatactgatagtaatggaaaatggagtatcgaaaataatgactggtgtttaattgataacagcaagtgc

SEQ ID NO: 19606 - DNA, 97 bp, Piromyces finnis; identical to SEQ ID NO: 17092
  Cellulose docking domain, dockering

SEQ ID NO: 19607 - DNA, 93 bp, Piromyces finnis
  Cellulose docking domain, dockering
ttatccatgttgtaatgaatgtgaagttatttacactgataacgatggtgactggggtgttgaaaataacgaatggtgtttaattaataagtt

SEQ ID NO: 19608 - DNA, 111 bp, Piromyces finnis
  Cellulose docking domain, dockering
ttgttttgctattgctcaaggttatgaatgttgtaacgataatgaagtcgtatatactgatgaatctggtcaatggggtattaaggatggtcaatggtgtggtattggcgg

SEQ ID NO: 19609 - DNA, 117 bp, Piromyces finnis
  Cellulose docking domain, dockering
ctgtactggtatgaactctggttatcaatgttgtgatacttgtaatgttgtctacactgataatgatggtaaatggggtattatgaatggtgaatggtgtggtattaagagtagctg

SEQ ID NO: 19610 - DNA, 126 bp, Piromyces finnis
  Cellulose docking domain, dockering
ttgttggtctactggtttaggttacaattgctgtaaatcatgtgttgatgttgcttacatcgataatgatggtaaatggggtgttgaaaatggtaattggtgtcttattaaggaatcaaaatgcgg

SEQ ID NO: 19611 - DNA, 117 bp, Piromyces finnis; identical to SEQ ID NO: 19609
  Cellulose docking domain, dockering

SEQ ID NO: 19612 - DNA, 114 bp, Piromyces finnis; identical to SEQ ID NO: 19349
  Cellulose docking domain, dockering

SEQ ID NO: 19613 - DNA, 102 bp, Piromyces finnis
  Cellulose docking domain, dockering
ttacgcctgctgtagtggatgtgaatcagtctatgttgacaatgatggtaaatggggtgttgaaaatggtaattggtgtcttattaaggaatcaaaatgcgg

SEQ ID NO: 19614 - DNA, 97 bp, Piromyces finnis; identical to SEQ ID NO: 17092
  Cellulose docking domain, dockering

SEQ ID NO: 19615 - DNA, 93 bp, Piromyces finnis; identical to SEQ ID NO: 19607
  Cellulose docking domain, dockering

SEQ ID NO: 19616 - DNA, 111 bp, Piromyces finnis; identical to SEQ ID NO: 19608
  Cellulose docking domain, dockering

SEQ ID NO: 19617 - DNA, 114 bp, Piromyces finnis; identical to SEQ ID NO: 19349
  Cellulose docking domain, dockering

SEQ ID NO: 19618 - DNA, 102 bp, Piromyces finnis; identical to SEQ ID NO: 19613
  Cellulose docking domain, dockering

SEQ ID NO: 19619 - DNA, 117 bp, Piromyces finnis; identical to SEQ ID NO: 19609
  Cellulose docking domain, dockering

SEQ ID NO: 19620 - DNA, 111 bp, Piromyces finnis; identical to SEQ ID NO: 19608
  Cellulose docking domain, dockering

SEQ ID NO: 19621 - DNA, 93 bp, Piromyces finnis; identical to SEQ ID NO: 19607
  Cellulose docking domain, dockering

SEQ ID NO: 19622 - DNA, 97 bp, Piromyces finnis; identical to SEQ ID NO: 17092
  Cellulose docking domain, dockering

SEQ ID NO: 19623 - DNA, 114 bp, Piromyces finnis; identical to SEQ ID NO: 19349
  Cellulose docking domain, dockering

SEQ ID NO: 19624 - DNA, 117 bp, Piromyces finnis; identical to SEQ ID NO: 19609
  Cellulose docking domain, dockering

SEQ ID NO: 19625 - DNA, 102 bp, Piromyces finnis; identical to SEQ ID NO: 19613
  Cellulose docking domain, dockering

SEQ ID NO: 19626 - DNA, 121 bp, Piromyces finnis; identical to SEQ ID NO: 19605
  Cellulose docking domain, dockering

SEQ ID NO: 19627 - DNA, 120 bp, Piromyces finnis
  Cellulose docking domain, dockering
ttgtttctctgaaaagttaggttacaaatgctgtaaggcatgtgatactatttacaccgatgaaagtggtgactggggtttcgaaaacaatgactggtgtggtattgcttctagctgcac

SEQ ID NO: 19628 - DNA, 111 bp, Piromyces finnis
  Cellulose docking domain, dockering
tgaaagtggatatccatactgtaagaccaccactgatgttgtttacactgacagtgtcaaatggggtattgaaaacaatgactggtgcggtatcgttgattcttcctgctg

SEQ ID NO: 19629 - DNA, 123 bp, Piromyces finnis
  Cellulose docking domain, dockering
ctgctgggctagtaagcttggatttaaatgttgtacctcccaatgtccacaagaagtttacgttgatactgatggtagttggggtgttgaaaacaacaactggtgtggtatagtttctgaaac

SEQ ID NO: 19630 - DNA, 123 bp, Piromyces finnis
  Cellulose docking domain, dockering
ttgctgggctgaacttctcggttacagttgctgtagtactaaaacttgtagaaatgctgtctacactgatgatgatggccaatgggatgttgaaaatggtaattggtgtggtattacttcagc

SEQ ID NO: 19631 - DNA, 123 bp, Piromyces finnis
  Cellulose docking domain, dockering
ttgctgggctgaacttctcggttacagttgctgtagtactaaaacttgtagaaatgctgtctacactgatgatgatggccaatgggatgttgaaaatggtaattggtgtggtattggtggatc

SEQ ID NO: 19632 - DNA, 120 bp, Piromyces finnis
  Cellulose docking domain, dockering
ttgctggtctgaagaattaggttatccatgttgtacctctactactaaggttgtttacactgatgaaagtggtaattggggtgttgaaaacaacaactggtgtggtatagtttctgaaac

SEQ ID NO: 19633 - DNA, 123 bp, Piromyces finnis; identical to SEQ ID NO: 19631
  Cellulose docking domain, dockering

SEQ ID NO: 19634 - DNA, 63 bp, Piromyces finnis
  Cellulose docking domain, dockering
tgctagtggtcgttggggtattgaaaacaatgactggtgcggtatcgttgattcttcctgctg

SEQ ID NO: 19635 - DNA, 123 bp, Piromyces finnis; identical to SEQ ID NO: 19629
  Cellulose docking domain, dockering

SEQ ID NO: 19636 - DNA, 123 bp, Piromyces finnis; identical to SEQ ID NO: 19629
  Cellulose docking domain, dockering

SEQ ID NO: 19637 - DNA, 123 bp, Piromyces finnis; identical to SEQ ID NO: 19631
  Cellulose docking domain, dockering

SEQ ID NO: 19638 - DNA, 111 bp, Piromyces finnis; identical to SEQ ID NO: 19628
  Cellulose docking domain, dockering

SEQ ID NO: 19639 - DNA, 123 bp, Piromyces finnis; identical to SEQ ID NO: 19630
  Cellulose docking domain, dockering

SEQ ID NO: 19640 - DNA, 123 bp, Piromyces finnis; identical to SEQ ID NO: 19629
  Cellulose docking domain, dockering

SEQ ID NO: 19641 - DNA, 63 bp, Piromyces finnis; identical to SEQ ID NO: 19634
  Cellulose docking domain, dockering

SEQ ID NO: 19642 - DNA, 114 bp, Piromyces finnis
  Cellulose docking domain, dockering
ttgctggtctgaagaattaggttatccatgttgtacctctactactaaggttgtttacactgatgaaagtggttcctggggtattgaaaacggtgactggtgcggtattaagaa

SEQ ID NO: 19643 - DNA, 123 bp, Piromyces finnis; identical to SEQ ID NO: 19630
  Cellulose docking domain, dockering

SEQ ID NO: 19644 - DNA, 120 bp, Piromyces finnis; identical to SEQ ID NO: 19632
  Cellulose docking domain, dockering

SEQ ID NO: 19645 - DNA, 118 bp, Piromyces finnis
  Cellulose docking domain, dockering
taagggagctcaaggttatccatgttgtcaattctcctgtgatgtttattctactgatagtgatggtaaatggagtgttgaaaacaataactggtgtttaattgataattccaagtgt

SEQ ID NO: 19646 - DNA, 120 bp, Piromyces finnis
  Cellulose docking domain, dockering
ttgttttgcccttaaattaggtttcccatgttgtaataacaatgaaatatattataccgatgaaaatggaaattggggtttaacaaacactacaccagtcaattggtgtggtattggtgg

SEQ ID NO: 19647 - DNA, 102 bp, Piromyces finnis
  Cellulose docking domain, dockering
aatgggttacccatgttgtaccaatccatcaactaccgttttctatgttgatgaagatggtaactggggtttagaaaatgataactggtgtattatgaaaaa

SEQ ID NO: 19648 - DNA, 99 bp, Piromyces finnis
  Cellulose docking domain, dockering
tccatattgtagtggatgtgaatccaattatcaagatgctgatggtgaatggtattttgttgataacaaatggtgtaaggtaaatgaaaagaaatgtaa

SEQ ID NO: 19649 - DNA, 93 bp, Piromyces finnis
  Cellulose docking domain, dockering
atgttggtcaaaagaacttggttttgaatgttgcaaatcctgtgtaactcaatatactgatgaagatggtcaatggggttatgaagatgattg

SEQ ID NO: 19650 - DNA, 120 bp, Piromyces finnis
  Cellulose docking domain, dockering
atgtttctctgaaaagcaaggttatccatgctgttcaggatgtgatgttgcctacattgactctgatggtgactggggatatgaaaatgatagctggtgtggtattaaatccacttgtag

SEQ ID NO: 19651 - DNA, 117 bp, Piromyces finnis
  Cellulose docking domain, dockering
ttgtttcgctactaaacttggttacaagtgctgttctgaatgtgatgttacctacactgattctgatggtgattggggctttgaaggtgactggtgtggtattaaggacagttgtaa

SEQ ID NO: 19652 - DNA, 79 bp, Piromyces finnis
  Cellulose docking domain, dockering
ctatccatgttgttcctctggtactagtgtagtttacactgacgctagtggttcatggggtgttgaaaataatgaatgg

SEQ ID NO: 19653 - DNA, 120 bp, Piromyces finnis; identical to SEQ ID NO: 19650
  Cellulose docking domain, dockering

SEQ ID NO: 19654 - DNA, 79 bp, Piromyces finnis
  Cellulose docking domain, dockering
ctatccatgttgttcctctggtactagtgtagcctacactgatgctagtggttcatggggtgttgaaaataatgaatgg

SEQ ID NO: 19655 - DNA, 117 bp, Piromyces finnis
  Cellulose docking domain, dockering
ttgtttcgctactaagcttggttacaagtgctgttcaggatgtgatgtcacctacactgattctgatggtgactggggctttgaaggtgactggtgtggtattaaggacagctgtaa

SEQ ID NO: 19656 - DNA, 99 bp, Piromyces finnis
  Cellulose docking domain, dockering
atatccatgttgctcaaaatgtaatattgtattcacagatgaagaaggagattggggttacgaaaaaggagattggtgtggtattagagataattgtaa

SEQ ID NO: 19657 - DNA, 123 bp, Piromyces finnis
  Cellulose docking domain, dockering
ttgttgggcagaagaatttggatacaattgctgtaaacattgtacagttacttatagtgacgaaaatggggattggggtagagaagaagatgatgcatggtgtggtattataaaaaactgtaa

SEQ ID NO: 19658 - DNA, 120 bp, Piromyces finnis
  Cellulose docking domain, dockering
ctgctgggctgaaaaattaggatataagtgttgtaatgaatgcactgttacttataatgatgaaaatggtgattggggatttgaaaacggggaatggtgtggtattttaagaacttgcag

SEQ ID NO: 19659 - DNA, 97 bp, Piromyces finnis; identical to SEQ ID NO: 17145
  Cellulose docking domain, dockering

SEQ ID NO: 19660 - DNA, 97 bp, Piromyces finnis; identical to SEQ ID NO: 17146
  Cellulose docking domain, dockering

SEQ ID NO: 19661 - DNA, 117 bp, Piromyces finnis
  Cellulose docking domain, dockering
ctgctggtctcaaagtttaggttacccatgttgttcctctgctagtgctaaggttgaatacactgatgccgatggtaagtggggtattgaaaacggtaactggtgtggtattccagc

SEQ ID NO: 19662 - DNA, 117 bp, Piromyces finnis
  Cellulose docking domain, dockering
ttgctgggctaagccattaggttacaactgttgtacttcaactactcaagctgtctacactgatagcgatggtaagtggggtgttgaaaacggtgactggtgtggtattgttactgg

SEQ ID NO: 19663 - DNA, 120 bp, Piromyces finnis
  Cellulose docking domain, dockering
ttgctggtcccaaaaattaggttacccatgctgttcttccagctctgctcaagtttggttcaccgataatgatggtgaatggggtgttgaaaacggtgactggtgtggtattgttgctgg

SEQ ID NO: 19664 - DNA, 120 bp, Piromyces finnis
  Cellulose docking domain, dockering
ttgctggtcccaaaaattaggttacccatgctgttcttccagctctgctcaagtttggttcaccgataatgatggtgaatggggtgttgaaaacggtgactggtgtggtattgttactgg

SEQ ID NO: 19665 - DNA, 120 bp, Piromyces finnis
  Cellulose docking domain, dockering
ctgctggtctcaaccattaggttacccatgctgtacttctacctctactgctgtttacactgatggtgatggtgcttggggtattgaaaacggcgattggtgtggtatcaacggtaattc

SEQ ID NO: 19666 - DNA, 117 bp, Piromyces finnis; identical to SEQ ID NO: 19661
  Cellulose docking domain, dockering

SEQ ID NO: 19667 - DNA, 117 bp, Piromyces finnis
  Cellulose docking domain, dockering
ttgctgggctaagccattaggttacaactgttgtacttcaactactcaagctgtctacactgatagcgatggtaagtggggtgttgaaaacggtgactggtgtggtattccaaaggc

SEQ ID NO: 19668 - DNA, 120 bp, Piromyces finnis; identical to SEQ ID NO: 19665
  Cellulose docking domain, dockering

SEQ ID NO: 19669 - DNA, 120 bp, Piromyces finnis
  Cellulose docking domain, dockering
ttgctggtcccaaaaattaggttacccatgctgttcttccagctctgctcaagtttggttcaccgataatgatggtgaatggggtgttgaaaacggtgactggtgtggtattccaaaggc

SEQ ID NO: 19670 - DNA, 117 bp, Piromyces finnis; identical to SEQ ID NO: 19661
  Cellulose docking domain, dockering

SEQ ID NO: 19671 - DNA, 117 bp, Piromyces finnis; identical to SEQ ID NO: 19662
  Cellulose docking domain, dockering

SEQ ID NO: 19672 - DNA, 120 bp, Piromyces finnis; identical to SEQ ID NO: 19669
  Cellulose docking domain, dockering

SEQ ID NO: 19673 - DNA, 120 bp, Piromyces finnis; identical to SEQ ID NO: 19665
  Cellulose docking domain, dockering

SEQ ID NO: 19674 - DNA, 120 bp, Piromyces finnis; identical to SEQ ID NO: 19663
  Cellulose docking domain, dockering

SEQ ID NO: 19675 - DNA, 117 bp, Piromyces finnis
  Cellulose docking domain, dockering
ttgctgggctaagccattaggttacaactgttgtacttcaactactcaagctgtctacactgatagcgatggtaagtggggtgttgaaaacggtgactggtgtggtattgttgctgg

SEQ ID NO: 19676 - DNA, 117 bp, Piromyces finnis; identical to SEQ ID NO: 19661
  Cellulose docking domain, dockering

SEQ ID NO: 19677 - DNA, 120 bp, Piromyces finnis; identical to SEQ ID NO: 19663
  Cellulose docking domain, dockering

SEQ ID NO: 19678 - DNA, 117 bp, Piromyces finnis; identical to SEQ ID NO: 19661
  Cellulose docking domain, dockering

SEQ ID NO: 19679 - DNA, 117 bp, Piromyces finnis; identical to SEQ ID NO: 19662
  Cellulose docking domain, dockering

SEQ ID NO: 19680 - DNA, 117 bp, Piromyces finnis; identical to SEQ ID NO: 19675
  Cellulose docking domain, dockering

SEQ ID NO: 19681 - DNA, 117 bp, Piromyces finnis; identical to SEQ ID NO: 19661
  Cellulose docking domain, dockering

SEQ ID NO: 19682 - DNA, 117 bp, Piromyces finnis; identical to SEQ ID NO: 19667
  Cellulose docking domain, dockering

SEQ ID NO: 19683 - DNA, 120 bp, Piromyces finnis; identical to SEQ ID NO: 19665
  Cellulose docking domain, dockering

SEQ ID NO: 19684 - DNA, 117 bp, Piromyces finnis; identical to SEQ ID NO: 19661
  Cellulose docking domain, dockering

SEQ ID NO: 19685 - DNA, 120 bp, Piromyces finnis; identical to SEQ ID NO: 19664
  Cellulose docking domain, dockering

SEQ ID NO: 19686 - DNA, 120 bp, Piromyces finnis; identical to SEQ ID NO: 19665
  Cellulose docking domain, dockering

SEQ ID NO: 19687 - DNA, 117 bp, Piromyces finnis; identical to SEQ ID NO: 19667
  Cellulose docking domain, dockering

SEQ ID NO: 19688 - DNA, 117 bp, Piromyces finnis; identical to SEQ ID NO: 19661
  Cellulose docking domain, dockering

SEQ ID NO: 19689 - DNA, 117 bp, Piromyces finnis; identical to SEQ ID NO: 19675
  Cellulose docking domain, dockering

SEQ ID NO: 19690 - DNA, 117 bp, Piromyces finnis; identical to SEQ ID NO: 19661
  Cellulose docking domain, dockering

SEQ ID NO: 19691 - DNA, 120 bp, Piromyces finnis; identical to SEQ ID NO: 19664
  Cellulose docking domain, dockering

SEQ ID NO: 19692 - DNA, 120 bp, Piromyces finnis; identical to SEQ ID NO: 19669
  Cellulose docking domain, dockering

SEQ ID NO: 19693 - DNA, 120 bp, Piromyces finnis; identical to SEQ ID NO: 19665
  Cellulose docking domain, dockering

SEQ ID NO: 19694 - DNA, 123 bp, Piromyces finnis
  Cellulose docking domain, dockering
ttgttggtctactgctttcggttacagctgttgtaagtcatgtggtccagtttacttcactgacgaaagtggtaactggggtattgaaaatggtgactggtgtggtcttttaagttcatgttc

SEQ ID NO: 19695 - DNA, 120 bp, Piromyces finnis; identical to SEQ ID NO: 19309
  Cellulose docking domain, dockering

SEQ ID NO: 19696 - DNA, 123 bp, Piromyces finnis; identical to SEQ ID NO: 19694
  Cellulose docking domain, dockering

SEQ ID NO: 19697 - DNA, 85 bp, Piromyces finnis; identical to SEQ ID NO: 17183
  Cellulose docking domain, dockering

SEQ ID NO: 19698 - DNA, 123 bp, Piromyces finnis; identical to SEQ ID NO: 19694
  Cellulose docking domain, dockering

SEQ ID NO: 19699 - DNA, 85 bp, Piromyces finnis; identical to SEQ ID NO: 17183
  Cellulose docking domain, dockering

SEQ ID NO: 19700 - DNA, 85 bp, Piromyces finnis; identical to SEQ ID NO: 17183
  Cellulose docking domain, dockering

SEQ ID NO: 19701 - DNA, 123 bp, Piromyces finnis; identical to SEQ ID NO: 19694
  Cellulose docking domain, dockering

SEQ ID NO: 19702 - DNA, 123 bp, Piromyces finnis
  Cellulose docking domain, dockering
ctgttgggcaaaggctttaggttactcttgctgtgattcttgtgctccagtttactatttcgataatgatggagaatggggtattgttgatggacaatggtgtggtattccaaagaattgtga

SEQ ID NO: 19703 - DNA, 108 bp, Piromyces finnis
  Cellulose docking domain, dockering
aggctatccatgctgtaaatcctcttgtatcgtatacaccaaagaaaacggtgttaactggggtgtagaaaataataattggtgtgtaatcaatgattccttatgttc

SEQ ID NO: 19704 - DNA, 85 bp, Piromyces finnis; identical to SEQ ID NO: 17183
  Cellulose docking domain, dockering

SEQ ID NO: 19705 - DNA, 120 bp, Piromyces finnis; identical to SEQ ID NO: 19309
  Cellulose docking domain, dockering

SEQ ID NO: 19706 - DNA, 120 bp, Piromyces finnis; identical to SEQ ID NO: 19309
  Cellulose docking domain, dockering

SEQ ID NO: 19707 - DNA, 108 bp, Piromyces finnis; identical to SEQ ID NO: 19703
  Cellulose docking domain, dockering

SEQ ID NO: 19708 - DNA, 123 bp, Piromyces finnis; identical to SEQ ID NO: 19702
  Cellulose docking domain, dockering

SEQ ID NO: 19709 - DNA, 88 bp, Piromyces finnis
  Cellulose docking domain, dockering
cccagctacctttacttctctaggttattcatgttgtaaaagtgaaaattgtatggtttattatcaagatgaatctggtgattggggt

SEQ ID NO: 19710 - DNA, 109 bp, Piromyces finnis; identical to SEQ ID NO: 17196
  Cellulose docking domain, dockering

SEQ ID NO: 19711 - DNA, 109 bp, Piromyces finnis; identical to SEQ ID NO: 17197
  Cellulose docking domain, dockering

SEQ ID NO: 19712 - DNA, 114 bp, Piromyces finnis
  Cellulose docking domain, dockering
atgttggtctgaaaaattaggattcccatgttgtagcaaatgtggacaagttgtttacaccgatgaagatggtaactggagtgttgaaaacaatgattggtgtatcattagaaa

SEQ ID NO: 19713 - DNA, 120 bp, Piromyces finnis
  Cellulose docking domain, dockering
ctcagctaagattactagccaaggttacaagtgctgttcttctagctgtgtcccatcttataccgatggtgatggtgattgggctattgaaaatggtgaatggtgtggtatcactaaggc

SEQ ID NO: 19714 - DNA, 120 bp, Piromyces finnis
  Cellulose docking domain, dockering
ttcttctaagattactagccaaggttacaagtgctgttcttctagctgtgtcccatcttataccgatggtgatggtgattgggctattgaaaatggtgaatggtgtggtatcactaaggc

SEQ ID NO: 19715 - DNA, 114 bp, Piromyces finnis; identical to SEQ ID NO: 19712
  Cellulose docking domain, dockering

SEQ ID NO: 19716 - DNA, 120 bp, Piromyces finnis
  Cellulose docking domain, dockering
ctgtgctgccgcttctcaaggttatccatgctgcaaaaaccaaaatgctgaagtttactaccaagatgaaactggtgattggggtattgaaaatggtgaatggtgtggatgtggtaatgg

SEQ ID NO: 19717 - DNA, 123 bp, Piromyces finnis
  Cellulose docking domain, dockering
ctctgccaatattcttgctcaaggttacaagtgctgttctgctggttgtcaagtcatttacactgataatgatggtacctggggtgctgaaaatggtgaatggtgtggttgtggttcttctac

SEQ ID NO: 19718 - DNA, 114 bp, Piromyces finnis; identical to SEQ ID NO: 19712
  Cellulose docking domain, dockering

SEQ ID NO: 19719 - DNA, 120 bp, Piromyces finnis; identical to SEQ ID NO: 19522
  Cellulose docking domain, dockering

SEQ ID NO: 19720 - DNA, 123 bp, Piromyces finnis; identical to SEQ ID NO: 19717
  Cellulose docking domain, dockering

SEQ ID NO: 19721 - DNA, 120 bp, Piromyces finnis
  Cellulose docking domain, dockering
ctcagctaagattactagccaaggttacaagtgctgttcttctagctgtgtcccatcttataccgatggtgatggtgattgggctattgaaaatggtgaatggtgtggatgtggtaatgg

SEQ ID NO: 19722 - DNA, 126 bp, Piromyces finnis
  Cellulose docking domain, dockering
ctctgccaatattcttgctcaaggttacaagtgctgttctgctggttgtcaagtagtttacaccgataatgacggtacttggggtgttgaaaataatgaatggtgtggttgtaacgctaaccaagc

SEQ ID NO: 19723 - DNA, 120 bp, Piromyces finnis
  Cellulose docking domain, dockering
ttcttctaagattactagccaaggttacaagtgctgttcttctagctgtgtcccatcttataccgatggtgatggtgattgggctattgaaaatggtgaatggtgtggatgtggtaatgg

SEQ ID NO: 19724 - DNA, 123 bp, Piromyces finnis; identical to SEQ ID NO: 19717
  Cellulose docking domain, dockering

SEQ ID NO: 19725 - DNA, 117 bp, Piromyces finnis
  Cellulose docking domain, dockering
agtcttagctttaggatatccatgttgttctaaaactaattgtgttgctgtttacactgatgaaactggtgattgggatgttgaaaacaatgattggtgttggtgtagaggcaataa

SEQ ID NO: 19726 - DNA, 120 bp, Piromyces finnis
  Cellulose docking domain, dockering
tacttcaattactaatcaaggttataagtgttgttctgctgaaaagtgtgaagttgtatacactgatgaatccggtgattggggtgttgaagatggtgactggtgtggttgtactgtcga

SEQ ID NO: 19727 - DNA, 117 bp, Piromyces finnis; identical to SEQ ID NO: 19725
  Cellulose docking domain, dockering

SEQ ID NO: 19728 - DNA, 120 bp, Piromyces finnis; identical to SEQ ID NO: 19726
  Cellulose docking domain, dockering

SEQ ID NO: 19729 - DNA, 94 bp, Piromyces finnis; identical to SEQ ID NO: 16781
  Cellulose docking domain, dockering

SEQ ID NO: 19730 - DNA, 94 bp, Piromyces finnis; identical to SEQ ID NO: 16781
  Cellulose docking domain, dockering

SEQ ID NO: 19731 - DNA, 94 bp, Piromyces finnis; identical to SEQ ID NO: 16781
  Cellulose docking domain, dockering

SEQ ID NO: 19732 - DNA, 94 bp, Piromyces finnis; identical to SEQ ID NO: 16781
  Cellulose docking domain, dockering

SEQ ID NO: 19733 - DNA, 105 bp, Piromyces finnis
  Cellulose docking domain, dockering
atactacaattgctgtaataattgtgatgtttattacactgataacgaaggtaagtggggtgttcaaaacaacgactggtgtttcattgataacaaccgttgtgg

SEQ ID NO: 19734 - DNA, 120 bp, Piromyces finnis
  Cellulose docking domain, dockering
ctgcaagttcgaaagtttaggttaccgttgctgtaacggttgtgacgttgtttacaccgatagtgatggtaactggggtgttgaaaatggtaactggtgtggtattagagacaactgtaa

SEQ ID NO: 19735 - DNA, 117 bp, Piromyces finnis
  Cellulose docking domain, dockering
ctcagcttctatcatgagccaaggttacaagtgctgttccaagaactgccaagttgtttacactgatgctgatggtgactggggtgttgaaaacggtcaatggtgtggttgtggtgg

SEQ ID NO: 19736 - DNA, 114 bp, Piromyces finnis
  Cellulose docking domain, dockering
ctgcaagttcgaaagtttaggttaccgttgctgtaacggttgtgacgttgtttacaccgatagtgatggtaactggggtgttgaaaatggtaactggtgtggtattcaaaaggg

SEQ ID NO: 19737 - DNA, 108 bp, Piromyces finnis
  Cellulose docking domain, dockering
cccatactacaattgctgtaataattgtgatgtttattacactgataacgaaggtaagtggggtgttcaaaacaacgactggtgtttcattgataacaaccgttgtgg

SEQ ID NO: 19738 - DNA, 117 bp, Piromyces finnis; identical to SEQ ID NO: 19735
  Cellulose docking domain, dockering

SEQ ID NO: 19739 - DNA, 120 bp, Piromyces finnis
  Cellulose docking domain, dockering
agttgctattactaaccaaggatatccatgctgtaagtcctgcggtaccgtctattacaccgatgctgatggtgaatggggtgtcgaaaacggtgactggtgtggtatgccaaccaaatg

SEQ ID NO: 19740 - DNA, 117 bp, Piromyces finnis
  Cellulose docking domain, dockering
ctctgcttctattactaaccaaggttacaagtgttgtaaggttggatgtcaaaccatttacaccgatgctgacggtaactggggtgttgaaaacaaccaatggtgtggatgtggtac

SEQ ID NO: 19741 - DNA, 120 bp, Piromyces finnis; identical to SEQ ID NO: 19739
  Cellulose docking domain, dockering

SEQ ID NO: 19742 - DNA, 117 bp, Piromyces finnis; identical to SEQ ID NO: 19740
  Cellulose docking domain, dockering

SEQ ID NO: 19743 - DNA, 120 bp, Piromyces finnis
  Cellulose docking domain, dockering
ttcttctaagatcacttcccaaggttaccaatgctgttctgataactgtgaagttatttacactgatgctgatggtaactggggtgttgaaaatggtaactggtgtggtattcaaaaggg

SEQ ID NO: 19744 - DNA, 117 bp, Piromyces finnis
  Cellulose docking domain, dockering
ttctgctgctattactagacaaggttacaagtgctgttctaagaattgccaagttgtttacactgatggtgatggtgactggggtgttgaaaacggtcaatggtgtggttgtggtgg

SEQ ID NO: 19745 - DNA, 117 bp, Piromyces finnis; identical to SEQ ID NO: 19744
  Cellulose docking domain, dockering

SEQ ID NO: 19746 - DNA, 117 bp, Piromyces finnis
  Cellulose docking domain, dockering
tccatcttctattacctcacaaggttatccatgctgttcatcttgtggtaccgtctactaccaagatgctgatggtgactggggtgttgaaaacggtcaatggtgtggttgtggtgg

SEQ ID NO: 19747 - DNA, 102 bp, Piromyces finnis
  Cellulose docking domain, dockering
ccaaggattcccatgttgtcaaaatacttgtgaagtctatactactgattccgatggtgattggggtttagaaaatggtaactggtgtggtattcaaaaggg

SEQ ID NO: 19748 - DNA, 123 bp, Piromyces finnis
  Cellulose docking domain, dockering
ttgctggtctacttcattaggttattcatgttgtaaatcatgtatcaatgttgcctacaaggataatgatggtgaatggggtattgaaaataacaattggtgtggtattccaaaaacttgtca

SEQ ID NO: 19749 - DNA, 120 bp, Piromyces finnis
  Cellulose docking domain, dockering
ctgcaagttcgaaagtttaggttaccgttgctgtaacggttgtgacgttgtttacaccgatagtgatggtaactggggtgttgaaaatggtaactggtgtggtattaaaccatcctgtag

SEQ ID NO: 19750 - DNA, 108 bp, Piromyces finnis; identical to SEQ ID NO: 19737
  Cellulose docking domain, dockering

SEQ ID NO: 19751 - DNA, 117 bp, Piromyces finnis; identical to SEQ ID NO: 19740
  Cellulose docking domain, dockering

SEQ ID NO: 19752 - DNA, 120 bp, Piromyces finnis; identical to SEQ ID NO: 19739
  Cellulose docking domain, dockering

SEQ ID NO: 19753 - DNA, 117 bp, Piromyces finnis; identical to SEQ ID NO: 19740
  Cellulose docking domain, dockering

SEQ ID NO: 19754 - DNA, 120 bp, Piromyces finnis; identical to SEQ ID NO: 19739
  Cellulose docking domain, dockering

SEQ ID NO: 19755 - DNA, 102 bp, Piromyces finnis
  Cellulose docking domain, dockering
ttctgcaaagattactagtcaaggttacaagtgttgtagtgctggatgtgtaatttactacactgatgctgatggtgattggggtgttgaaaacaaccaatc

SEQ ID NO: 19756 - DNA, 120 bp, Piromyces finnis
  Cellulose docking domain, dockering
ttctgcaaagattactagtcaaggttacaagtgttgtagtgctggatgtgtaatttactacactgatgctgatggtgattggggtgttgaaaacaatgaatggtgtggttgtggtaacag

SEQ ID NO: 19757 - DNA, 120 bp, Piromyces finnis
  Cellulose docking domain, dockering
ttgtttctccactaagttaggttacccatgctgtaaagctggtacccaagctgtttacaccgatgctgacggtgattggggtgttgaaaatggtgattggtgtggtattaaggattccaa

SEQ ID NO: 19758 - DNA, 109 bp, Piromyces finnis
  Cellulose docking domain, dockering
atgttgggctaaatcttctggatattcatgctgttctaccaacaaatgtagagaagttgtttactttgacaaagaaggtcaatgggatgttgaaaatggtcaatggtgt

SEQ ID NO: 19759 - DNA, 117 bp, Piromyces finnis
  Cellulose docking domain, dockering
ttgttggtccaagtcattaggtttcgaatgttgtaccggttcagcttacgttctctacaccgatgaaaatggtcaatggggtgttgaaaatggtgattggtgtggtattggcggatc

SEQ ID NO: 19760 - DNA, 97 bp, Piromyces finnis; identical to SEQ ID NO: 17246
  Cellulose docking domain, dockering

SEQ ID NO: 19761 - DNA, 114 bp, Piromyces finnis
  Cellulose docking domain, dockering
ttgtttctccactaagttaggttacccatgctgtaaagctggtacccaagctgtttacaccgatgctgacggtgattggggtgttgaaaatggtgattggtgtggtattttaag

SEQ ID NO: 19762 - DNA, 105 bp, Piromyces finnis
  Cellulose docking domain, dockering
cttattaggttatcctttatgtaaggaaaagcatgaagatgatttagttagagatgaagatggctactgggccattgaagatggtaattggtgtggtgttcaagt

SEQ ID NO: 19763 - DNA, 97 bp, Piromyces finnis; identical to SEQ ID NO: 17248
  Cellulose docking domain, dockering

SEQ ID NO: 19764 - DNA, 100 bp, Piromyces finnis
  Cellulose docking domain, dockering
ctcatgctgggctcaagctttaggttacccatgctgtaagaatactaaggatgttgttaccactgattctgatggtgactggggtattgaaaatggtgac

SEQ ID NO: 19765 - DNA, 117 bp, Piromyces finnis
  Cellulose docking domain, dockering
ttgtttctccactaagttaggttacccatgctgtaaagctggtacccaagctgtttacaccgatgctgacggtgattggggtgttgaaaatggtgattggtgtggtattggcggatc

SEQ ID NO: 19766 - DNA, 109 bp, Piromyces finnis; identical to SEQ ID NO: 19758
  Cellulose docking domain, dockering

SEQ ID NO: 19767 - DNA, 120 bp, Piromyces finnis
  Cellulose docking domain, dockering
ttgttggtccaagtcattaggtttcgaatgttgtaccggttcagcttacgttctctacaccgatgaaaatggtcaatggggtgttgaaaatggtgattggtgtggtattaaggattccaa

SEQ ID NO: 19768 - DNA, 120 bp, Piromyces finnis
  Cellulose docking domain, dockering
ttcttgctgggctaagccattaggttacaactgttgtacttcaactactcaagctgtctacactgatagcgatggtaagtggggtgttgaaaacggtgactggtgtggtattgttactgg

SEQ ID NO: 19769 - DNA, 117 bp, Piromyces finnis
  Cellulose docking domain, dockering
ttgctgggctaaggctttaggttacaactgttgtacttccactactcaagctatttacactgatagtgatggtaagtggggtgttgaaaacggtgactggtgtggtattgttactgg

SEQ ID NO: 19770 - DNA, 120 bp, Piromyces finnis
  Cellulose docking domain, dockering
ttcttgctgggctaaggctttaggttacaactgttgtacttccactactcaagctatttacactgatagtgatggtaagtggggtgttgaaaacggtgactggtgtggtattgttactgg

SEQ ID NO: 19771 - DNA, 117 bp, Piromyces finnis
  Cellulose docking domain, dockering
ttgctgggctaaggctttaggttacaactgttgtacttccactactcaagctatttacactgatagtgatggtaagtggggtgttgaaaacggtgactggtgtggtattgttgctgg

SEQ ID NO: 19772 - DNA, 117 bp, Piromyces finnis; identical to SEQ ID NO: 19771
  Cellulose docking domain, dockering

SEQ ID NO: 19773 - DNA, 117 bp, Piromyces finnis; identical to SEQ ID NO: 19769
  Cellulose docking domain, dockering

SEQ ID NO: 19774 - DNA, 120 bp, Piromyces finnis
  Cellulose docking domain, dockering
ctgctttgccgaaaagttaggttacagttgctgtccagatggtactactgtctcttacactgatggtgatggtaaatggggtgttgtcaatggtgactggtgtggtattgctgaagaaca

SEQ ID NO: 19775 - DNA, 117 bp, Piromyces finnis
  Cellulose docking domain, dockering
ttgctgggctgaagctttaggttacaagtgttgtcaaactaccagtaatgttgaattcattgatactgatggtaagtggggtttcgaaaacggtgattggtgtggtattaacggtaa

SEQ ID NO: 19776 - DNA, 117 bp, Piromyces finnis; identical to SEQ ID NO: 19675
  Cellulose docking domain, dockering

SEQ ID NO: 19777 - DNA, 129 bp, Piromyces finnis
  Cellulose docking domain, dockering
ctcatgctgggctcaagctttaggttacccatgctgtaagaatactaaggatgttgttaccactgattctgatggtgactggggtattgaaaatggtgactggtgtggtattgttgataacagatgcat

SEQ ID NO: 19778 - DNA, 117 bp, Piromyces finnis; identical to SEQ ID NO: 19662
  Cellulose docking domain, dockering

SEQ ID NO: 19779 - DNA, 117 bp, Piromyces finnis; identical to SEQ ID NO: 19769
  Cellulose docking domain, dockering

SEQ ID NO: 19780 - DNA, 117 bp, Piromyces finnis; identical to SEQ ID NO: 19675
  Cellulose docking domain, dockering

SEQ ID NO: 19781 - DNA, 117 bp, Piromyces finnis; identical to SEQ ID NO: 19675
  Cellulose docking domain, dockering

SEQ ID NO: 19782 - DNA, 120 bp, Piromyces finnis; identical to SEQ ID NO: 19665
  Cellulose docking domain, dockering

SEQ ID NO: 19783 - DNA, 120 bp, Piromyces finnis
  Cellulose docking domain, dockering
ttcttgctgggctaagccattaggttacaactgttgtacttcaactactcaagctgtctacactgatagcgatggtaagtggggtgttgaaaacggtgactggtgtggtattgttgctgg

SEQ ID NO: 19784 - DNA, 117 bp, Piromyces finnis; identical to SEQ ID NO: 19662
  Cellulose docking domain, dockering

SEQ ID NO: 19785 - DNA, 117 bp, Piromyces finnis; identical to SEQ ID NO: 19662
  Cellulose docking domain, dockering

SEQ ID NO: 19786 - DNA, 120 bp, Piromyces finnis
  Cellulose docking domain, dockering
ttcttgctgggctaaggctttaggttacaactgttgtacttccactactcaagctatttacactgatagtgatggtaagtggggtgttgaaaacggtgactggtgtggtattgttgctgg

SEQ ID NO: 19787 - DNA, 117 bp, Piromyces finnis; identical to SEQ ID NO: 19771
  Cellulose docking domain, dockering

SEQ ID NO: 19788 - DNA, 94 bp, Piromyces finnis; identical to SEQ ID NO: 17274
  Cellulose docking domain, dockering

SEQ ID NO: 19789 - DNA, 120 bp, Piromyces finnis
  Cellulose docking domain, dockering
ttcttctaagattactagccaaggttacaagtgctgtgctagcaattgtgacgtggtttacgttgataatgatggtaactggggtgttgaaaacgatgaatggtgtggatgtggaactga

SEQ ID NO: 19790 - DNA, 99 bp, Piromyces finnis
  Cellulose docking domain, dockering
aaagggttacaaatgctgtaagactacctcccaagtttatgaagttgattctgacggtaaatggggtattgaaaacaatgattggtgtttcattaaaaa

SEQ ID NO: 19791 - DNA, 102 bp, Piromyces finnis
  Cellulose docking domain, dockering
gttacttggttacaactgttgtagaaacacttgtgatattcaatacaaggatgacgatggtaactggggtgttgaaaacaacgactggtgtggattaaacag

SEQ ID NO: 19792 - DNA, 117 bp, Piromyces finnis
  Cellulose docking domain, dockering
ttcttctaagattactagccaaggttacaagtgctgtgctagcaattgtgacgtggtttacgttgataatgatggtaactggggtgttgaaaacaacgactggtgtggattaaacag

SEQ ID NO: 19793 - DNA, 123 bp, Piromyces finnis
  Cellulose docking domain, dockering
ttcttctaagattactagccaaggttacaagtgctgtgctagcaattgtgacgtggtttacgttgataatgatggtaactggggtgttgaaaacaacgactggtgtggtttaactaacaacgg

SEQ ID NO: 19794 - DNA, 108 bp, Piromyces finnis
  Cellulose docking domain, dockering
gttacttggttacaactgttgtagaaacacttgtgatattcaatacaaggatgacgatggtaactggggtgttgaaaacaacgactggtgtggtttaactaacaacgg

SEQ ID NO: 19795 - DNA, 114 bp, Piromyces finnis
  Cellulose docking domain, dockering
atgctggtctgaagctttaggttacccatgttgtgaaggcaatgttgttataacatccgatgaaaatggtgattggggtgttgaaaacaatgaatggtgtggttgtggtaacag

SEQ ID NO: 19796 - DNA, 120 bp, Piromyces finnis; identical to SEQ ID NO: 19756
  Cellulose docking domain, dockering

SEQ ID NO: 19797 - DNA, 63 bp, Piromyces finnis
  Cellulose docking domain, dockering
catttacaccgatgctgacggtaactggggtgttgaaaacaaccaatggtgtggatgtggtac

SEQ ID NO: 19798 - DNA, 126 bp, Piromyces finnis
  Cellulose docking domain, dockering
ttcttctaagatcacttcccaaggttaccaatgctgttctgataactgtgaagttatttacactgatgctgatggtaactggggtgttgaaaatggtaactggtgtggtattagagacaactgtaa

SEQ ID NO: 19799 - DNA, 126 bp, Piromyces finnis; identical to SEQ ID NO: 19798
  Cellulose docking domain, dockering

SEQ ID NO: 19800 - DNA, 126 bp, Piromyces finnis
  Cellulose docking domain, dockering
ctctgcttctattactaaccaaggttacaagtgttgtaaggttggatgccaaactgtttacactgatgctgatggtaactggggtgttgaaaatggtaactggtgtggtattagagacaactgtaa

SEQ ID NO: 19801 - DNA, 126 bp, Piromyces finnis; identical to SEQ ID NO: 19800
  Cellulose docking domain, dockering

SEQ ID NO: 19802 - DNA, 108 bp, Piromyces finnis
  Cellulose docking domain, dockering
agaaggttacgaatgctgttcttcttgtaatgttatttacactgacgacgatggtaattggggtgttgaaaacgatcaatggtgtggtattgatgaagaaaagtgtag

SEQ ID NO: 19803 - DNA, 96 bp, Piromyces finnis
  Cellulose docking domain, dockering
tggatgctgtgctcattgtaatgccatctacgaagatgaagatggtttatggggtgtttctaatggtgaatggtgtaaaattaagaagaactgtag

SEQ ID NO: 19804 - DNA, 120 bp, Piromyces finnis
  Cellulose docking domain, dockering
atgtttcagtagtaaattaggttacccatgttgtacttctactactgacgttattaccgaagatgaagatggtaagtggggtttagaaaatggtgattggtgcggtattcaagaaacttc

SEQ ID NO: 19805 - DNA, 88 bp, Piromyces finnis; identical to SEQ ID NO: 17293
  Cellulose docking domain, dockering

SEQ ID NO: 19806 - DNA, 120 bp, Piromyces finnis; identical to SEQ ID NO: 19774
  Cellulose docking domain, dockering

SEQ ID NO: 19807 - DNA, 82 bp, Piromyces finnis; identical to SEQ ID NO: 17294
  Cellulose docking domain, dockering

SEQ ID NO: 19808 - DNA, 94 bp, Piromyces finnis; identical to SEQ ID NO: 17295
  Cellulose docking domain, dockering

SEQ ID NO: 19809 - DNA, 117 bp, Piromyces finnis
  Cellulose docking domain, dockering
ttgctggtcaactaaattaggttacaaatgctgtaagggttgtgatgtttcttatactgatagtgatggtgattggggttatgaaagtgactggtgtggtatcccaacttcatgcaa

SEQ ID NO: 19810 - DNA, 96 bp, Piromyces finnis
  Cellulose docking domain, dockering
atacgaatgctgtaatggatgtaatgttgttgaccaatctgatggtcttaagtggggtgttgaaaataataattggtgcatcatcaagagttcttg

SEQ ID NO: 19811 - DNA, 108 bp, Piromyces finnis
  Cellulose docking domain, dockering
tacttctggttacccatgctgtaaggattgtaatgtagtttacactgatgaaacaggtaaatggggtattgccaataatgaatggtgtgctatttctgatacttgttc

SEQ ID NO: 19812 - DNA, 103 bp, Piromyces finnis
  Cellulose docking domain, dockering
ttcttcaaaaattactgctcaaggttattcatgttgttcctcttcaaattgttccattatttacactgatgaagatggtacctggggtgttgaaaatggtcaa

SEQ ID NO: 19813 - DNA, 120 bp, Piromyces finnis; identical to SEQ ID NO: 19646
  Cellulose docking domain, dockering

SEQ ID NO: 19814 - DNA, 102 bp, Piromyces finnis; identical to SEQ ID NO: 19647
  Cellulose docking domain, dockering

SEQ ID NO: 19815 - DNA, 99 bp, Piromyces finnis; identical to SEQ ID NO: 19648
  Cellulose docking domain, dockering

SEQ ID NO: 19816 - DNA, 97 bp, Piromyces finnis; identical to SEQ ID NO: 17303
  Cellulose docking domain, dockering

SEQ ID NO: 19817 - DNA, 102 bp, Piromyces finnis
  Cellulose docking domain, dockering
atatccatgttgttcttctgaaaatgctgaaatcgtttatactgattctgaaggtgattggggtttagaaaaaggagattggtgtcttattaaaaaaaatga

SEQ ID NO: 19818 - DNA, 94 bp, Piromyces finnis
  Cellulose docking domain, dockering
ttgtttttctttaaaacttggttatagatgttgtgaaagatcaaaggttgtttattctgatgctgatggtttatggggtgttgaaaatggtcaa

SEQ ID NO: 19819 - DNA, 79 bp, Piromyces finnis; identical to SEQ ID NO: 16824
  Cellulose docking domain, dockering

SEQ ID NO: 19820 - DNA, 105 bp, Piromyces finnis; identical to SEQ ID NO: 19318
  Cellulose docking domain, dockering

SEQ ID NO: 19821 - DNA, 111 bp, Piromyces finnis
  Cellulose docking domain, dockering
tcacgattattatgaatgctgtactggttgtaaaccaattgttgctgatgatgaaggaagatggggagctcaaaatggtgaatggtgtttaattgatgaagaaagatgtaa

SEQ ID NO: 19822 - DNA, 105 bp, Piromyces finnis; identical to SEQ ID NO: 19318
  Cellulose docking domain, dockering

SEQ ID NO: 19823 - DNA, 111 bp, Piromyces finnis; identical to SEQ ID NO: 19821
  Cellulose docking domain, dockering

SEQ ID NO: 19824 - DNA, 94 bp, Piromyces finnis
  Cellulose docking domain, dockering
tcaaggttattcatgttgtaataaagaatgtactgtatactatgatgatgaagatggtgattggagtatagaaaatggtgaatggtgtttaatt

SEQ ID NO: 19825 - DNA, 123 bp, Piromyces finnis
  Cellulose docking domain, dockering
atgttggtctgaaagcttaggttacccatgttgtgaaactacatgtgatattgttgaaaaagatagtgatggaagttggggtgtagaatataatgaatggtgtggtattccaaagagctgtaa

SEQ ID NO: 19826 - DNA, 88 bp, Piromyces finnis
  Cellulose docking domain, dockering
ttgtatagccaaaagtttgggttatcaatgctgtcctaaaaatatatcagaagtatattatcacgatgaaaatggtgattggggattt

SEQ ID NO: 19827 - DNA, 123 bp, Piromyces finnis
  Cellulose docking domain, dockering
aattttaagacaaggctatagttgttgtgaacaaaataattgtaatatttattacaaggatgatgatggtgattggggtcttaccagtagcttaaaatggtgtggtattagatatagctgtcc

SEQ ID NO: 19828 - DNA, 120 bp, Piromyces finnis
  Cellulose docking domain, dockering
tagtgtattcaatcaaatgggttataaatgttgtagatcttgtaatgttgttttaactgactccactggtaaatggggtgttgaagataatgaatggtgtggtattcgtaaagattgtaa

SEQ ID NO: 19829 - DNA, 117 bp, Piromyces finnis
  Cellulose docking domain, dockering
tataattagaataggttatgtgtgttgcgatcattgtcaatctaattatgaagatgaatttggtaaatggtaccacacaaataaccatgattggtgtgctcttaaaccatcttgtaa

SEQ ID NO: 19830 - DNA, 108 bp, Piromyces finnis
  Cellulose docking domain, dockering
agttaaagatttaggttataaatgttgtaaagaaccttgtgatgttatttacactgatgttgatggtgactggggagctgaaaataacgaatggtgtggctgtggtgg

SEQ ID NO: 19831 - DNA, 120 bp, Piromyces finnis
  Cellulose docking domain, dockering
atgctggtccgaagaattcggttacaagtgttgtaagaagtcttgtactgttttcgaaattgataatgatggtaaatggggttacgaagatggtaattggtgtggtattccatctagttg

SEQ ID NO: 19832 - DNA, 123 bp, Piromyces finnis
  Cellulose docking domain, dockering
atgtattgctgaaaccattggatacagatgttgtagttcaaagaataagactgtatactacacagatagttatggtgactggggttatgacttcaagttaaacgactggtgtggtattacacc

SEQ ID NO: 19833 - DNA, 100 bp, Piromyces finnis; identical to SEQ ID NO: 17320
  Cellulose docking domain, dockering

SEQ ID NO: 19834 - DNA, 126 bp, Piromyces finnis
  Cellulose docking domain, dockering
ttgttggtctcataagtatggttatccatgctgtagtgaaggtacatgtcatatttttacttcagatgaaaatggtgattggggttatgaaaatggtcgttggtgtggtattttaccttcttgcag

SEQ ID NO: 19835 - DNA, 103 bp, Piromyces finnis; identical to SEQ ID NO: 17321
  Cellulose docking domain, dockering

SEQ ID NO: 19836 - DNA, 94 bp, Piromyces finnis; identical to SEQ ID NO: 17324
  Cellulose docking domain, dockering

SEQ ID NO: 19837 - DNA, 120 bp, Piromyces finnis
  Cellulose docking domain, dockering
ttgcttttcgagaaatcttggatttaattgttgtgaaaatgaaagcacttctgtattttttgttgatgataatggttcttggggtgttgaaaatgatgaatggtgtggtctttcttcaac

SEQ ID NO: 19838 - DNA, 108 bp, Piromyces finnis
  Cellulose docking domain, dockering
ttgttggtcagaacctctcggttatccatgttgtagtattgaagctaaaccatcagatgaagctagtatttggggttgggaaaatgaagaatggtgtggtatgaccag

SEQ ID NO: 19839 - DNA, 114 bp, Piromyces finnis
  Cellulose docking domain, dockering
atgttttgctgaaaaattgggtaaaccatgttgtacggaaactttagatgttgtacgtgttgatgaaaatggccaatggggtatggaaaatggacaattctgtggtttacaatc

SEQ ID NO: 19840 - DNA, 63 bp, Piromyces finnis
  Cellulose docking domain, dockering
agatgaatctggtaaatggggaattgaaaataaccagtggtgtggtattaaatattcatgttt

SEQ ID NO: 19841 - DNA, 120 bp, Piromyces finnis
  Cellulose docking domain, dockering
ctgttggtctgaagagttaggttacgcgtgttgtaagaagacttgtactatctttgaaatcgatgaaaatggtgaatggggtttcgaagatgataaatggtgtggtattccatctagttg

SEQ ID NO: 19842 - DNA, 111 bp, Piromyces finnis
  Cellulose docking domain, dockering
aaccattggatacaattgttgtcctttagaagtaagcacagtattctatactgattcctatggtaattggagttataattacaagttaaaggaatggtgtggtcttacacc

SEQ ID NO: 19843 - DNA, 123 bp, Piromyces finnis
  Cellulose docking domain, dockering
atgcttttctgaaaatttaggatattcttgttgtgaagaatgtaatgtggtttataccgataatgatggtaagtggggatatgaaaataatgaatggtgtggtataattaaatcaatttgctc

SEQ ID NO: 19844 - DNA, 123 bp, Piromyces finnis; identical to SEQ ID NO: 19843
  Cellulose docking domain, dockering

SEQ ID NO: 19845 - DNA, 123 bp, Piromyces finnis; identical to SEQ ID NO: 19300
  Cellulose docking domain, dockering

SEQ ID NO: 19846 - DNA, 108 bp, Piromyces finnis; identical to SEQ ID NO: 19838
  Cellulose docking domain, dockering

SEQ ID NO: 19847 - DNA, 114 bp, Piromyces finnis
  Cellulose docking domain, dockering
atgctggtcagaagtttatggatattcatgttgtagagaaactactacagtcattacttctgattcaaaaggtaattggggtgctgaaaatggtgaatggtgtggtcttacttt

SEQ ID NO: 19848 - DNA, 111 bp, Piromyces finnis
  Cellulose docking domain, dockering
ctggtcagaagtttatgattattcatgttgtaaaaaaacaacccaagtcatgtatattgactccaaaggtacttggggtattgaaaatggagaatggtgtggtcttgaccc

SEQ ID NO: 19849 - DNA, 120 bp, Piromyces finnis; identical to SEQ ID NO: 19837
  Cellulose docking domain, dockering

SEQ ID NO: 19850 - DNA, 120 bp, Piromyces finnis; identical to SEQ ID NO: 19376
  Cellulose docking domain, dockering

SEQ ID NO: 19851 - DNA, 123 bp, Piromyces finnis; identical to SEQ ID NO: 19352
  Cellulose docking domain, dockering

SEQ ID NO: 19852 - DNA, 96 bp, Piromyces finnis; identical to SEQ ID NO: 19803
  Cellulose docking domain, dockering

SEQ ID NO: 19853 - DNA, 72 bp, Piromyces finnis
  Cellulose docking domain, dockering
ttacactgaggacgatggtaattggggtcttgaaaacgatcaatggtgtggtattgatgaagaaaagtgtag

SEQ ID NO: 19854 - DNA, 120 bp, Piromyces finnis; identical to SEQ ID NO: 19804
  Cellulose docking domain, dockering

SEQ ID NO: 19855 - DNA, 120 bp, Piromyces finnis
  Cellulose docking domain, dockering
ctgctggtcttctagtttaggtttcccatgctgttccggtaaggtcgttgttgaatacactgatgctagtggtcgttggggtatccaaaacaacaactggtgtggtattgttaactctaa

SEQ ID NO: 19856 - DNA, 123 bp, Piromyces finnis
  Cellulose docking domain, dockering
ctgctgggctaaggctcttggttacaattgttgttctaccaacacttgtagaaatgctgtttacaacgacactgatggtcaatgggatattgaaaacaaccaatggtgtggtatttctactgc

SEQ ID NO: 19857 - DNA, 88 bp, Piromyces finnis; identical to SEQ ID NO: 19404
  Cellulose docking domain, dockering

SEQ ID NO: 19858 - DNA, 114 bp, Piromyces finnis
  Cellulose docking domain, dockering
ttgttgggcattagcctatggttacccatgttgtaaagaaactactactgtattaagtactgatgaatctggtacttggggttatgaaaacaatacctggtgtggtattgaaga

SEQ ID NO: 19859 - DNA, 117 bp, Piromyces finnis
  Cellulose docking domain, dockering
ttgttgggcttcattattaggttatccatgttgtgaaagtaatatagtttatgaagttgatgaatatggtacatggggttatgaatttggtcattggtgtggtattaaaactgaaat

SEQ ID NO: 19860 - DNA, 114 bp, Piromyces finnis
  Cellulose docking domain, dockering
ctgttggtctgttgaatatggttttccatgctgttttggtagtaaggttattgcaactgattataatggtgattggggttatgaaaataatcaatggtgtggtatgccaagaac

SEQ ID NO: 19861 - DNA, 79 bp, Piromyces finnis; identical to SEQ ID NO: 17348
  Cellulose docking domain, dockering

SEQ ID NO: 19862 - DNA, 102 bp, Piromyces finnis; identical to SEQ ID NO: 19456
  Cellulose docking domain, dockering

SEQ ID NO: 19863 - DNA, 91 bp, Piromyces finnis; identical to SEQ ID NO: 16906
  Cellulose docking domain, dockering

SEQ ID NO: 19864 - DNA, 91 bp, Piromyces finnis; identical to SEQ ID NO: 17352
  Cellulose docking domain, dockering

SEQ ID NO: 19865 - DNA, 102 bp, Piromyces finnis; identical to SEQ ID NO: 19570
  Cellulose docking domain, dockering

SEQ ID NO: 19866 - DNA, 112 bp, Piromyces finnis; identical to SEQ ID NO: 17354
  Cellulose docking domain, dockering

SEQ ID NO: 19867 - DNA, 117 bp, Piromyces finnis; identical to SEQ ID NO: 19859
  Cellulose docking domain, dockering

SEQ ID NO: 19868 - DNA, 114 bp, Piromyces finnis; identical to SEQ ID NO: 19858
  Cellulose docking domain, dockering

SEQ ID NO: 19869 - DNA, 99 bp, Piromyces finnis
  Cellulose docking domain, dockering
tttcccttgttgttctgataatactgaaatcatatatactgatgaagaaggtaattggggacttgaaaatgatgagtggtgttttataaataaatcaac

SEQ ID NO: 19870 - DNA, 117 bp, Piromyces finnis; identical to SEQ ID NO: 17358
  Cellulose docking domain, dockering

SEQ ID NO: 19871 - DNA, 126 bp, Piromyces finnis
  Cellulose docking domain, dockering
atgctattttgaaactttaggttattcatgttgtccttctgaaattacagaagtagcttatactgatgaagatggtaataaatggggtattattaataatgaatggtgtggtattgttgatcaaac

SEQ ID NO: 19872 - DNA, 99 bp, Piromyces finnis; identical to SEQ ID NO: 19869
  Cellulose docking domain, dockering

SEQ ID NO: 19873 - DNA, 123 bp, Piromyces finnis
  Cellulose docking domain, dockering
atgttggtcaagaagttatggtttcccatgttgtaatggttgtaaagtttattatattgataaatccggagaatggggtattgagaatggtaattggtgtggtattgttgatgacaattgtag

SEQ ID NO: 19874 - DNA, 72 bp, Piromyces finnis; identical to SEQ ID NO: 17363
  Cellulose docking domain, dockering

SEQ ID NO: 19875 - DNA, 111 bp, Piromyces finnis; identical to SEQ ID NO: 19608
  Cellulose docking domain, dockering

SEQ ID NO: 19876 - DNA, 123 bp, Piromyces finnis; identical to SEQ ID NO: 19470
  Cellulose docking domain, dockering

SEQ ID NO: 19877 - DNA, 48 bp, Piromyces finnis
  Cellulose docking domain, dockering
aaagtggggtgttgaaaacagtgattggtgtggtattgtagacagcaa

SEQ ID NO: 19878 - DNA, 123 bp, Piromyces finnis
  Cellulose docking domain, dockering
atgttggtctgaactcataggttatccatgttgtgatccaaagaataatgttgtctattcacatgatagctatggtgaatggggatataattttaaaacacaaatgtggtgtggacttacagc

SEQ ID NO: 19879 - DNA, 102 bp, Piromyces finnis
  Cellulose docking domain, dockering
agattattcatgttgtgaaggttgtgaggttatcgaagaaactgaagaaggtaaatggggtatagaaaattacgcatggtgtggtattaaagattcatgttt

SEQ ID NO: 19880 - DNA, 99 bp, Neocallimastix californiae
  Cellulose-binding domain
aatatggcaacaatgtggtggtcaaaattataatggaccaacttgttgtgaagcaggtactacttgtgtaaaattaagtgattactactaccaatgtca

SEQ ID NO: 19881 - DNA, 99 bp, Neocallimastix californiae
  Cellulose-binding domain
tgctttatatgatcaatgtggtggtgaaggttacttcggtccaactaaatgctgtaagggaaaatgtatttctcaaggaccatactattcacaatgtgc

SEQ ID NO: 19882 - DNA, 99 bp, Neocallimastix californiae
  Cellulose-binding domain
agcttatgctcaatgtggtggtttaggttatgaaggatcaacttgttgtcaagctggtaccatttgtactgttgttaatgaacactattctcactgtga

SEQ ID NO: 19883 - DNA, 99 bp, Neocallimastix californiae
  Cellulose-binding domain
tgctttatacgatcaatgtggtggtgatggttacttcggtccaactgaatgttgtaagggaaaatgtatttctcaaggaccatactattctcaatgtgc

SEQ ID NO: 19884 - DNA, 99 bp, Neocallimastix californiae
  Cellulose-binding domain
agcttatggtaaatgtggaggtaatgattggactggttcaacttgttgtatggttggtactagttgtcaaaaaattaatgaatgggtttcattatgtca

SEQ ID NO: 19885 - DNA, 99 bp, Neocallimastix californiae
  Cellulose-binding domain
cgatcaatgtggtggtgttggttacaatggtccaactaattgttgtaatccagattataaatgtaaggaatacggtacttactatttccaatgtgtacc

SEQ ID NO: 19886 - DNA, 99 bp, Neocallimastix californiae
  Cellulose-binding domain
agcttacgctcaatgtggtggtattggttatgaaggtccaaattgttgtcaagccggtactgtttgtacagaaattaatgagcattattcacattgtga

SEQ ID NO: 19887 - DNA, 102 bp, Neocallimastix californiae
  Cellulose-binding domain
aaatgtatggggtcaatgtggtggtgaaggatggaatggtccaacctgttgtaattcaggtagtgtttgtgttgtaacaaatcaatactatcatcaatgtaa

SEQ ID NO: 19888 - DNA, 105 bp, Neocallimastix californiae
  Cellulose-binding domain
taattgggcacaatgtggaggtattgatttcaatggtcctacaacttgttgtgatccttccgctgtatgcaaatatttaaatgattattattatcaatgtgtttt

SEQ ID NO: 19889 - DNA, 100 bp, Neocallimastix californiae
  Cellulose-binding domain
taaatgggatcaatgtggtggtatgaattgggctggaccgaattgctgtgttgaaggaacatattgtacctttgttaatccatattattcacaatgttta

SEQ ID NO: 19890 - DNA, 100 bp, Neocallimastix californiae
  Cellulose-binding domain
aaaatggactcaatgtggtggacaaggatatacaggaccaacttgttgtaaatcaggatcaacttgtcatgaaattaataaatattattctcaatgtatt

SEQ ID NO: 19891 - DNA, 105 bp, Neocallimastix californiae
  Cellulose-binding domain
agcttatcaaccatgtggtggtaatgattatccaaatgctccaacttgttgtgaagctggatttgcttgtttaatgaagaatccaaattaccatcaatgtattcc

SEQ ID NO: 19892 - DNA, 102 bp, Neocallimastix californiae
  Cellulose-binding domain
tgctcgctatgcccaatgtggtggtgtcaattatcatggttcaacaaagtgttgtggtaatttaacatgtgtatatcgtggtgaatattattctcaatgtga

SEQ ID NO: 19893 - DNA, 99 bp, Neocallimastix californiae
  Cellulose-binding domain
accatatggacaatgtggtggtataaattataatggtccaacatgttgtccaagcggttacacttgtaaatttattagtgattattattatcaatgtac

SEQ ID NO: 19894 - DNA, 96 bp, Neocallimastix californiae
  Cellulose-binding domain
agaatttgatcaatgtgatggtattaattataatggtccaaaatgttgttctgtaggtaaatgcgttagacttaatgattattattatcaatgtca

SEQ ID NO: 19895 - DNA, 96 bp, Neocallimastix californiae
  Cellulose-binding domain
tcaatgggctcaatgtggtggtatcggttttaacggtccaacctgttgttcctctggaaaatgtgttaaactcaatgattggtattctcaatgtca

SEQ ID NO: 19896 - DNA, 103 bp, Neocallimastix californiae
  Cellulose-binding domain
caaacattgggatcaatgtggtggtgtaaatcaccggggtccattctgttgtgaatcaggtttaacttgtgtatttgtgaatgattattattctcaatgctta

SEQ ID NO: 19897 - DNA, 91 bp, Neocallimastix californiae
  Cellulose-binding domain
tcctgcttttggacaatgtggcggtaccgactaccgtggttcaaccaagtgttgtgaaaatttaagatgtgtttatttaaatgattactat

SEQ ID NO: 19898 - DNA, 105 bp, Neocallimastix californiae
  Cellulose-binding domain
tgtttatgaatattgtggaggtattaattatccaaaagcaccaaagtgttgtaagccaggttcaaaatgtgttaaatttaatgaatatcatcatcaatgtatgcc

SEQ ID NO: 19899 - DNA, 99 bp, Anaeromyces robustus
  Cellulose-binding domain
agcttatgcccaatgtggtggtaaagaatacacaggtccaaactgttgtcaagctggtactatttgtactgaaattaatgaacactactctcactgtga

SEQ ID NO: 19900 - DNA, 99 bp, Anaeromyces robustus
  Cellulose-binding domain
agctttatatgatcaatgtggtggtgaaggttacttcggtccaactgaatgttgtaagggaaaatgtactagccaaggaccatactattctcaatgtgc

SEQ ID NO: 19901 - DNA, 102 bp, Anaeromyces robustus
  Cellulose-binding domain
attatggaatcaatgtgatgaaaatggaattcttggaccatcttgttgtgaaaagggttcaatatgtaaaaaatatagtgactattattctcaatgtgtacc

SEQ ID NO: 19902 - DNA, 99 bp, Anaeromyces robustus
  Cellulose-binding domain
agtttgggatcaatgtggtggtgctacttattatggtccaacttgctgtgaaagcaatagtagatgtatcgtacataatgaatattattcacaatgtga

SEQ ID NO: 19903 - DNA, 99 bp, Anaeromyces robustus
  Cellulose-binding domain
aaattggaaccaatgtggtggtaaagaatatactggaccaacatgttgtaatgaaaattatcattgtatttatgttaatgagtattactctcaatgtaa

SEQ ID NO: 19904 - DNA, 102 bp, Anaeromyces robustus
  Cellulose-binding domain
ggtatatgatcaatgtggtggtattggtttccgtggtccaacatgttgtgaaccaggtactacttgtgaatttgttgtagattattattcacaatgtattcc

SEQ ID NO: 19905 - DNA, 96 bp, Anaeromyces robustus
  Cellulose-binding domain
atatggtcaatgtggtggtattaattatacaggtccaacatgttgtccatctggatattcatgtaaaaaacataatgattattattcacaatgtga

SEQ ID NO: 19906 - DNA, 102 bp, Anaeromyces robustus
  Cellulose-binding domain
agattatgaaaaatgtggtggtataggttataatggaccaacatgttgtgaaaaccctaactttaaatgtgaagtcattaacgaatatttccatcaatgtac

SEQ ID NO: 19907 - DNA, 102 bp, Anaeromyces robustus
  Cellulose-binding domain
tgtctggcaacaatgtggtggtgttggatacaacggtccaacatgttgtaaaggtgattactattgtaaatcatatagtgattactactcacaatgtgttcc

SEQ ID NO: 19908 - DNA, 114 bp, Anaeromyces robustus
  Cellulose-binding domain
agcatggggtcaatgtggtggtaccgttaatggaaagaaatataatggttcaacttgttgtgtaagtggttataaatgtaaagaatacaataccaattatgctcaatgtgtacc

SEQ ID NO: 19909 - DNA, 105 bp, Anaeromyces robustus
  Cellulose-binding domain
ggcttatcaacaatgtggaggtcttaattataaaggtacaattagttgttgtgaagaaggttatttctgtcataaaaatgatgaacattaccatcaatgtattcc

SEQ ID NO: 19910 - DNA, 91 bp, Anaeromyces robustus
  Cellulose-binding domain
actttttgcacaatgtgatggtgatggttataatggtccaaaatgttgtcaatctggtcaatgtgttaaagttaataattggtattctcaa

SEQ ID NO: 19911 - DNA, 100 bp, Anaeromyces robustus
  Cellulose-binding domain
aatatatgaacaatgtggtggtttttacttttccggtccaaattgctgtgaagagggtagtagatgtatttatcaaaatgattattattctcaatgttta

SEQ ID NO: 19912 - DNA, 103 bp, Piromyces finnis
  Cellulose-binding domain
aaagaaatggcaacaatgtggtggtattggctacagtggtccaacacaatgtgaatcaggtagtgaatgtgttgctaccaatgaattttattcccaatgtcta

SEQ ID NO: 19913 - DNA, 99 bp, Piromyces finnis
  Cellulose-binding domain
agcttatgctcaatgtggtggtcttggttatgaaggttcaacctgttgtcaagctggtactatctgtactgtagttaatgaacattactctcattgtgc

SEQ ID NO: 19914 - DNA, 99 bp, Piromyces finnis
  Cellulose-binding domain
agcctatggtaagtgtggtggtaaggattggactggttctacctgttgtatggttggtactagttgtaaggaagttaacgaatgggtttccttatgtga

SEQ ID NO: 19915 - DNA, 99 bp, Piromyces finnis
  Cellulose-binding domain
tgctttatatgatcaatgtggtggtgatggctactttggtccaactgaatgttgtaagggaaaatgtatttctcaaggaccatactattcccaatgtgc

SEQ ID NO: 19916 - DNA, 99 bp, Piromyces finnis; identical to SEQ ID NO: 19914
  Cellulose-binding domain

SEQ ID NO: 19917 - DNA, 339 bp, Neocallimastix californiae
  CHB_HEX_C
tccaaagttctccatggaatctggttattatgaagccactgaggatttaaaattagccatatcatcctcctcttcctccggtaccatttactatactttggatagctctgatccaactacttcttccactgcaaaggtttacagtgatgaaattaaaatgtatgataaatcaatagatgaaaatgtttacagtatgtatcaacatgaagataatagcccgtactctattaatttacaaactaactataaagccagtacattaaaacatgataaggtgaccgttgtacgtgctgctactaaattagaagatggaagcttcagtccagtagttactaagac

SEQ ID NO: 19918 - DNA, 339 bp, Neocallimastix californiae; identical to SEQ ID NO: 19917
  CHB_HEX_C

SEQ ID NO: 19919 - DNA, 234 bp, Neocallimastix californiae
  CHB_HEX_C
cccaatcttttctatggagtctggctattatgaggcttcagataatttaaatttaactttatcttcttccggtacgatttactatactcttgatagttcagatccaactacttcttctacggctaaggtttatgaaggtgaaattaaaatgtatgataaatcggtggataataatgtttatagtatgtatcaacatgaagaaaatagtccttactctattactattcataccgg

SEQ ID NO: 19920 - DNA, 153 bp, Neocallimastix californiae
  CHB_HEX_C
aaaattctctatggaagcaggtttctatgaagctaaagatggtttatctttaactttaagttcttcagaaggtacagtttattatactcttgatagttcagatccaactacttcatctactgctaaagcctacaatggtgctatcagaatgta

SEQ ID NO: 19921 - DNA, 153 bp, Anaeromyces robustus; identical to SEQ ID NO: 19920
  CHB_HEX_C

SEQ ID NO: 19922 - DNA, 150 bp, Piromyces finnis
  CHB_HEX_C
acaattctctatggaatctggattctatgaaaatgttgaaggattaaacttaaccttaaactctgaaggtactattttatatactcttgatagtactgacccaaccacttcctcaactgctaaggtttacgaaggtccaattaagatgta

SEQ ID NO: 19923 - DNA, 150 bp, Piromyces finnis; identical to SEQ ID NO: 19922
  CHB_HEX_C

SEQ ID NO: 19924 - DNA, 333 bp, Piromyces finnis
  CHB_HEX_C
tccacaattctctatggaatctggttactatgaaaatgttgatggtttaagtttaaccttaaatactgaagaaggtactgtcttatatactcttgatggtactgatccaacaacttcatccactgctaaggtctttggagatccaataaaaatgtacgatagaactattgatgaaaatgttttaagtaaatatcaacatgaagataagagtccatacaccattcaattaaagaaccaatataaggctaataaattaaacaacgataaagctactattgttcgtgctgttacaaagttagctgatggttctttcagtccagttgtttctaaaac

SEQ ID NO: 19925 - DNA, 60 bp, Neocallimastix californiae
  CHIT_BIND_I_1
tcctgatggtttatgctgttcacaatatggttggtgtggcgtaacaagtgattattgtga

SEQ ID NO: 19926 - DNA, 60 bp, Neocallimastix californiae
  CHIT_BIND_I_1
tcctgatgatgaatgctgttctcggtatggttggtgtggtacaacaagtgaatattgtgg

SEQ ID NO: 19927 - DNA, 60 bp, Neocallimastix californiae
  CHIT_BIND_I_1
cccaaataatgaatgctgttcacagtatggttggtgtggtacaactagtgaatattgtga

SEQ ID NO: 19928 - DNA, 129 bp, Neocallimastix californiae
  CHIT_BIND_I_2
tcagttatgtggaagagattatggaaaatgtcctgatggtttatgctgttcacaatatggttggtgtggcgtaacaagtgattattgtgataataattgtcaacctgaatttggtagatgtaataatat

SEQ ID NO: 19929 - DNA, 138 bp, Neocallimastix californiae
  CHIT_BIND_I_2
taaaggttgtggaatcttttccggtaaaagatcttgttctaataatgaatgttgttcttcctctactggttattgtggtcgtaacgatgactactgtggctctgactgtcaaagtgaatttggctattgtacctccag

SEQ ID NO: 19930 - DNA, 129 bp, Neocallimastix californiae
  CHIT_BIND_I_2
taataaatgtggcaaaggatatggaacttgtcctgatgatgaatgctgttctcggtatggttggtgtggtacaacaagtgaatattgtggttataaatgtcaatctgattatggaagatgtgataatat

SEQ ID NO: 19931 - DNA, 129 bp, Neocallimastix californiae
  CHIT_BIND_I_2
taataaatgtggtaaaggttatggttcatgcccaaataatgaatgctgttcacagtatggttggtgtggtacaactagtgaatattgtgattataagtgtcaattggattacggtagatgtaataatat

SEQ ID NO: 19932 - DNA, 129 bp, Anaeromyces robustus
  CHIT_BIND_I_2
taaccgatgtggtaaaggttatggttcatgtcccgataatgcatgttgttcacaatggggttggtgtggttttacatcagatcattgtggtgcaggatgtaataaagaatatggtagatgtgataatgt

SEQ ID NO: 19933 - DNA, 504 bp, Anaeromyces robustus
  CHITIN DEACETYLASE 1-RELATED
cactcaatgtaataatccaaaacattgggctatgacttatgatgatggaccaaccgaatttgctgatgcaattttagatcttttaaaggaaaaaggtattaaagcaacattcttcattgttggacatatgtatatggataataatagttctgattggtctagaattattaagagaatggatagtgaaggtcatattgttggtaaccatacttatgatcaccaagatttaactggactttcatcagatcaaattattagtcaaatgaaacaagttgaagatcgtatcttcaaaattattggtaagagaccagcatttatgcgtccaccatatggttcaggtaatggtaaccaaaatgttatgaatgcacttcaacaagctggttacacagctgctattaattggaatgttgatccacaagattacagtaatggtggtgatgctaattatgctagacaagttattaatcaagctaaaggtcaaccaatcattaccttaaatcactt

SEQ ID NO: 19934 - DNA, 105 bp, Neocallimastix californiae
  Chitin_bind_1
tcagttatgtggaagagattatggaaaatgtcctgatggtttatgctgttcacaatatggttggtgtggcgtaacaagtgattattgtgataataattgtcaacc

SEQ ID NO: 19935 - DNA, 108 bp, Neocallimastix californiae
  Chitin_bind_1
taataaatgtggcaaaggatatggaacttgtcctgatgatgaatgctgttctcggtatggttggtgtggtacaacaagtgaatattgtggttataaatgtcaatctga

SEQ ID NO: 19936 - DNA, 105 bp, Neocallimastix californiae
  Chitin_bind_1
taataaatgtggtaaaggttatggttcatgcccaaataatgaatgctgttcacagtatggttggtgtggtacaactagtgaatattgtgattataagtgtcaatt

SEQ ID NO: 19937 - DNA, 105 bp, Anaeromyces robustus
  Chitin_bind_1
taaccgatgtggtaaaggttatggttcatgtcccgataatgcatgttgttcacaatggggttggtgtggttttacatcagatcattgtggtgcaggatgtaataa

SEQ ID NO: 19938 - DNA, 138 bp, Neocallimastix californiae
  Chitin-bd_1
tggtattctttctggtaaaagaacttgtcccggtgataattgctgttcagcttcaaccggttattgtggccgtaatttttgtgacattgattgtcaaagtgaatttggttactgtaacaacaaaaataacaatagtta

SEQ ID NO: 19939 - DNA, 138 bp, Neocallimastix californiae; identical to SEQ ID NO: 19938
  Chitin-bd_1

SEQ ID NO: 19940 - DNA, 141 bp, Neocallimastix californiae
  Chitin-bd_1
gttatgtggaagagattatggaaaatgtcctgatggtttatgctgttcacaatatggttggtgtggcgtaacaagtgattattgtgataataattgtcaacctgaatttggtagatgtaataatatggctgctcctgttat

SEQ ID NO: 19941 - DNA, 141 bp, Neocallimastix californiae
  Chitin-bd_1
tggaatcttttccggtaaaagatcttgttctaataatgaatgttgttcttcctctactggttattgtggtcgtaacgatgactactgtggctctgactgtcaaagtgaatttggctattgtacctccagtaacagcaataa

SEQ ID NO: 19942 - DNA, 135 bp, Neocallimastix californiae
  Chitin-bd_1
taaatgtggcaaaggatatggaacttgtcctgatgatgaatgctgttctcggtatggttggtgtggtacaacaagtgaatattgtggttataaatgtcaatctgattatggaagatgtgataatataagtcttaa

SEQ ID NO: 19943 - DNA, 141 bp, Neocallimastix californiae
  Chitin-bd_1
taaatgtggtaaaggttatggttcatgcccaaataatgaatgctgttcacagtatggttggtgtggtacaactagtgaatattgtgattataagtgtcaattggattacggtagatgtaataatataagttttgatactcc

SEQ ID NO: 19944 - DNA, 138 bp, Anaeromyces robustus
  Chitin-bd_1
ccgatgtggtaaaggttatggttcatgtcccgataatgcatgttgttcacaatggggttggtgtggttttacatcagatcattgtggtgcaggatgtaataaagaatatggtagatgtgataatgtagaaacaaacgt

SEQ ID NO: 19945 - DNA, 1356 bp, Neocallimastix californiae
  CHITINASE
aataattgttggttatttcagtgaatggaaaaatgcgaactatcctattagtcgtgtagatttatcaaaaattacacatcttaattatgcatttggtgtaattgatccaaattcatatgctgtaactggatatgatagtaatattttaagtcaagttgtcactgctgcacacagtcaaggagtaaaagttcttatgtctgtaggtggatggtatggaagtcgttactttactcagatgacttcttcaaaaagtaacatagaaaagtttgttgacagttgtcaaagtcttatcagtaattatggtgttgatggtattgatattgattgggaatacccaggaagagaaggcgcatgtaatagcccagatatggcaaatgatgcagaaaattatttaactcttttaaagatcttacgtgaaaagatcggaaatgctctaatttctgctgctgtcagtgttataccgtttgaaaagaatggtcaaccaatttcagacctttctgaatatgaaaaatactttgattatattaatgttatggcatatgattttgctggtagttggacacctactgtttctcatcactctgctttatatgacccagaagctggtgaaaagttgtctctatcttcaggtgtaaagaattggttaagtcgtggttttccagctaataaaattgttgttggtgtaccagcttatggaaagagttggattgctgcatcttcaaatagaaatggtttatatcaatctgttgctaatggaaatccaaaaggtgatcatgaagatagtaattcaccatggactaactattgtggagttcttgaaagtgcttacagtggaaattggaaatataaaaatattcgtagtgaaatcttaaaatctgattacacaactgcttcaggtagttgggttcgttcatgggatgataaagttaagggtccatatttatttaataaggaaactaaacaaatcattacatacgatgatccagaaactattcaatataaagctaaatatattattgataacaactttggtggtatgatgatttgggaattagaaaatgatactgatgatttcgaaattttaactgctataaatgataacttaggatgtaaggattctaacaaatcatctaacagttctcctaaaacaaaaacaattataaaatctacaactatcgtaaaacaaactactactattgctgaaatacctactgtttcaaataacgacaatcctgtttcaaataacgtcactcctgtttcttcaaataacgactctctaaacgctgaatatccatattgtaataattgtgtgactgtttacgaagacgatcaaaaatggggtattttaaataatca

SEQ ID NO: 19946 - DNA, 1113 bp, Neocallimastix californiae
  CHITINASE
tattatttattatccagaatggaagtactataactatccaccaaggaatcttccatttaacaaacttactcatataaattatgcctttggtgaaattgatccaactaattattcattaaaatatgactctactaagtttttagaattgattgaaactgctcgtagtagaaataaaaatgttaaaattataatgtctgttggtggttggactggaagtagatatttctcagttatgtcatcaaatcctgcaaacagatccaaatttataagtagtgttaaatcgatgttagaaagtactggtgctgatggtattgatattgattgggaacacccaggagtacctggtgctttttatgatagttttgatgcccaaaatgatacctataatttattaaaattgatgcaagaattacgtgaagctattggtaaatcaaaaattatttcaactgctgtaacgttcaatttatttgttgtgaactatcaaccattacaagacttatctaaatttgccgaaatattagattatattaatcttatgtgttatgattttaatggaagttggtcaaatattatatcacatcaatcttcactatacccaactggaggaaatgatagtggattttctgtagaaggtgctgttaaaaattggatgaatgctaaatttccatctaacaaaattgttattggtattccttcttatggtatatcatggatttcaagtacatctaataataatggtttacttcaaataccatccaattctttcccaaaaggtgatgaagaagatgtcatgaatgcagaatcaggaagatacagtggtatttggaaatataaaaatcttcgtaaacagattttacaatctagtttcaaagatgcaactggtgattggattcgtgtatgggattcaaaatctagtgttccttacttatataataaagtttcaagacaatttattacttatgatgatccagaatcagtgaaaattaaagctgattatgtaatcgaaagaaatttaggaggtatgatgatgtgggaaattgaagaagatacaaaggatggtgaattaatttccaccgtttacgacaactttattggtttaacttgtgatgatgt

SEQ ID NO: 19947 - DNA, 1314 bp, Neocallimastix californiae
  CHITINASE
tcctgatgatgaatgctgttctcggtatggttggtgtggtacaacaagtgaatattgtggttataaatgtcaatctgattatggaagatgtgataatataagtcttaatacatccaatcttggaaaaaatatggtagaaatatccacttcccaatcgggtattgaaggtttatgtaaaaattcaaaattatcaaaatcaatcattgtttactatccagaatggaagtattacgatttcccaccaaagaatattccatttaataagcttactcatataaattatgcgtttgccgaaattgattcaaatgattattcattagattatgattcaagtagatttttagaattagttgaaactgctcatgaaaaaaataaaaatattaaagttttaatgtccattggtggctggacaggtagtaagtattactcaaaaatggcatcttcttcttctcgacgatcaaaatttgttaagagtgtgaaaagaatgttggaagcaagtgatgcagatggtattgatattgattgggaatatccaggtacaagtggtgcttatgatgataattttgatgctgaaaatgatacaaataatttattgaaattgttaaaggaattacgtgaagctattggttcttcaaaaattatttctgctgctgttccatttaatacatttgaagtggactctcgtccattaaaagatatgtctgaatttgctgaattgtttgactatgttaatattatggcttacgattttgctggaagttggtcaaccgttacatctcatcaatcttcactgtattcaatttcagaagatgataatggctattctttatctggtgcggtaagtaactggataaatgctaatttcccttcaagtaaaattgttgttggtattcctgcttatggaagatcatggatttctggtagttcctcaaacaacggttatcttcaaagaccatctaattctcatccaaagggagatgaagaggattacattgattctagttcaaaaagatatagctctacctggaaatataaaaatattcgtaaagcaattgtaaaatctacttataaaaattcgtcaggggattggattcgtatatgggattcaaagtcgagtgttccatttctttttaatacgaatactagacaatttattacctatgatgatccggaatcagtatctcttaaagccgattacgttataaataaaaatttaggtggaatgatgatgtgggaaattgaagaagatacacaagatagtgaattaatttcaactatttatgaaaagtttatcagtttgacttgtaatgaagc

SEQ ID NO: 19948 - DNA, 1365 bp, Neocallimastix californiae
  CHITINASE
aattgtgtattatccagaatggaagtattataattttccaccaaagaatattccatttaataaacttactcatataaattatgcatttgctgaaattaattcaagtgattattccttagaatatgattcaagtaaatttttagaattagttgaaactgcacatgaatataataaaaatattaaggtattaatgtcaattggtggttggacaggtagtagatattattcaaaaatggcatcctcttcttctaatagatcaaaatttgttaaaagtgtaaaaagaatgctagaagctagtggtgctgatggtatagatattgattgggaatatccaggaacaagtggtgcttatgatgataacttcgatgctaaaaatgatacaaataatttattaaaattattgcaagaattacgtgcctcaattggttattcaaaaattatttctgctgctgtaccatacaacacatttgaagttaattataaaccattagaagatatgtctgaatttgctgaattatttgactatattaatattatggcttatgatttcgctggtagttggtcatctgttacatcacatcattcttcactttattcaactgttgaagatgacagtggatattcattagcaggtgctgttaaaaattggatgaacgcaagattcccagctactaaaattgttgttggtattcctgcttatggtagatcgtggatttcaggtagttcttcaaataatggttatcttcaaagaccatctaactctcatccaaagggtgatgaagaagattacattgatccaaattcaaaaagatacagctctacctggaaatataaaaatattcgtaaagcaatcatgaaatcaacttataaagattcaactggaaattggattcgtgtatgggattcaaagtctagtgttccatttctgttcaacaagaacaccagacaatttattacgtatgatgatccagaatcagtatcaattaaagctgattatgttataaaatataacttaggtggaatgatgatgtgggaaatcgaagaggatacaaaagatagtgaattaatttcaactattcataaaaaatttaaaagctttagttgtactaatttaaagaacaatttaactggaaataaaaatattgttaaccctggattaaatattgatttaaatggagaatcatctgaatcaagtaaatattcttcttcaactagaaaaattacatcaatcagaacttcaacaagaaccacattaagaagtactagtacttatactttatgtccaaattcttcaaaatataaatgttgcgaatcttgcaatgtttcctacgatgatggaaataaatggggtgtattaaatggaga

SEQ ID NO: 19949 - DNA, 1269 bp, Anaeromyces robustus
  CHITINASE
aaaaattgttggttatttcagtgaatggagaaattccaattatccaattagtcgtgtagatttatcaaaaattactcaccttaattatgcatttggtcttattgatccaagtacatatgctgtaaccggttatgaaagttggattttaactcaagttgttgaagctgctcataaacaaggtgttaaagttcttatgtcaattggtggttggtatggaagtcgttacttcactaaaatgacctcttctaagagtaatatggaaagatttgctgatagttgtaaaaatcttattgatacatataaaatcgatggtattgatattgattgggaatatcctggaagagaaggtgcttgtaacacccctgaccttgccaatgatacagataattatttaacacttttagaaattttacgtaagaagattggtaatgattcattaattactgctgctgttagtgcaattccatttgaaaagaatggtcaaccagtttcaaatctttcagcttatgctaaatactttgattttattaaccttatggcatatgattttgctggtagttggtcatcagttacttcacatcattcaggtttatatgatccagaagctggtgataaattatctgtttccactggtgttaaaaattggttaaatgctcaattcccagctagtaagattgttgttggtgttccagcttacggaaagagttggattgctgcttcatctgataaaaatggtttatatcaatctattgctaacaaaagtccaaaaggtgatcaagatgatagtaatgatgcatggacaaattattgtggtgttgttgaaagtacttatagttcaaattggaaatataaaaaccttcgtaaagaaattttaacttctgattatacttctgcatctggtagttgggttcgcacttgggatgatactgttatggctccatatttatttaataaggatactaaacaaattatttcttatgatgatccaaaagctattgaaaacaaagctaaatatgttcttagtaataattttgctggtatgatggtttgggaattagaaaatgatacggaagattttgaaatcttaagtgccattaataagcatttaggttgtgatggttcttttaatggtgattcaaacaaacctactactactactactaaaaaaactactacggttactaaaaaaagtactactactactactaaaaagagtacaccaactgatacaaactgtccaaatcttggatacccatgttgtaatgattg

SEQ ID NO: 19950 - DNA, 1362 bp, Anaeromyces robustus
  CHITINASE
tattgtttattacccagaatggaaatattatgatttcccaccaaaagatatcccattttcaaagttaactcatattaattatgcttttgctgaaattaatcctgatgatttctcattagaatatgattcaaataaatttttagaattaatagatactgctcataaaaaaaataaaagtattaaagttttaatgtcaataggtggttggactggtagtagatatttctcaaaaatggcttcatcttcttcaaatcgtacaaaatttgttaaaagtgtaaaaagaatgattgatgctagtaatgctgatggtattgatattgattgggaatatccaggttcaagtggtgcttatgatgacaattatgattcagaaaatgataccaataatttattaaaattattaaaagaattacgtgaaactataggaacttcaaaacttattactgctgctgtaccatttaacacttttgaagttgatcataaacctttaagtgatatgacagaatttgctaaactttttgattttattaatattatggcttatgatttctctggaagttggtcttccgttactgcacatcaatccgctctttattcaactcatgaagatgatagtggttattccctttcaggtgcagttaaaaattggatgaatgctaatttccctgctaaaaaaattgttgtaggtattccagcttatggtagatcatggattgctggtagttctaccaatcatggttatcttcaaagaccttctaattcttatccaaaaggtgatgaagaagattatattgattcagattctaaaagatattcttcaacttggaaatataaaaatatacgtaaacaagttttaaaatcagattattctaaatctactggtagttgggaacgtatatgggattctaaatcaagtgcaccatttttatttaataaagatactaaacaatttattacttatgatgatccaaaatcagtaggtcttaaagctgattatgttattgaaaataatttaggtggtatgatgatgtgggaaattgaagaagattcaaaagatagtgaattaatttcatctatgtatcaaaaattcatttctttaacttgtagtggtgctaaaggtatggtaggaagtattgattttaatttagatggtatatcaaatgattcctcatcaccttctaaaactactacaataagaagaaccactactacatcaaaaagaatttcaacaataacaacatcttctaaaaaatcaacttctacttcatgtccaaattctccagcttataaatgttgttcatcatgtattgtttatttcgaagataattataaatggggaactatgaatggtgaatggtgtag

SEQ ID NO: 19951 - DNA, 399 bp, Piromyces finnis
  CHITINASE
ttattataggagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatgatgatccagagagtattggatacaaagctaaatttgttcttgaaaatggctttgctggtatgatggtttgggaattagaaaatgatactgatgatttcgaaatattgactgg

SEQ ID NO: 19952 - DNA, 399 bp, Piromyces finnis; identical to SEQ ID NO: 19951
  CHITINASE

SEQ ID NO: 19953 - DNA, 1149 bp, Piromyces finnis
  CHITINASE
ttttagtgaatggagatattcaagttacccagttagccgtatagacttttcaaaatttacccatcttaactatgcttttgctgtcattgacccaaatacatatgcattaactggttatgaaggttggattttaaatgaagtagttacagctgctcataatcaagatgtaaaagttcttatgtcagttggtggttggtatggaagtcgttattttactaaaatgacatcttctgaaaataatatgaaaaaatttgctgaaagttgtaaaaatcttattgatacctatcacattgatggtatcgatattgattgggaatatccaggaagagaaggtgcttgcaataacccggattatgccaatgataccgataattatttaaaacttttaaaaatattacgtgaatatattggtaatgaaaatataatttctgcagctgtcagtattactccatttgaaaaaaatggtcagccaataacaaatcttgctccatatgctgaatattttgattttattaacattatgggctatgacttcgcaggtagttggtcgtctgttacttctcatcatgctgctttatatgacccagaagctggtgatatattgtctatttcctcaggagttaataattggttaaatggtcaatttcctgcagacaaaattgttattggtgttccaacttatggaaagagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatgatgatccagagagtattggatacaaagctaaatttgttcttgaaaatggctttgctggtatgatggtttgggaattagaaaatgatactgatgatttcgaaatattgactgctataaataaccaattaggttgtgatggttcttctattaatgataatacttgtccaaaatccgaatatccatg

SEQ ID NO: 19954 - DNA, 285 bp, Neocallimastix californiae
  Chitinase insertion domain
tggaaagagttggattgctgcatcttcaaatagaaatggtttatatcaatctgttgctaatggaaatccaaaaggtgatcatgaagatagtaattcaccatggactaactattgtggagttcttgaaagtgcttacagtggaaattggaaatataaaaatattcgtagtgaaatcttaaaatctgattacacaactgcttcaggtagttgggttcgttcatgggatgataaagttaagggtccatatttatttaataaggaaactaaacaaatcattacatacga

SEQ ID NO: 19955 - DNA, 264 bp, Neocallimastix californiae
  Chitinase insertion domain
tggtatatcatggatttcaagtacatctaataataatggtttacttcaaataccatccaattctttcccaaaaggtgatgaagaagatgtcatgaatgcagaatcaggaagatacagtggtatttggaaatataaaaatcttcgtaaacagattttacaatctagtttcaaagatgcaactggtgattggattcgtgtatgggattcaaaatctagtgttccttacttatataataaagtttcaagacaatttattacttatga

SEQ ID NO: 19956 - DNA, 264 bp, Neocallimastix californiae
  Chitinase insertion domain
tggaagatcatggatttctggtagttcctcaaacaacggttatcttcaaagaccatctaattctcatccaaagggagatgaagaggattacattgattctagttcaaaaagatatagctctacctggaaatataaaaatattcgtaaagcaattgtaaaatctacttataaaaattcgtcaggggattggattcgtatatgggattcaaagtcgagtgttccatttctttttaatacgaatactagacaatttattacctatga

SEQ ID NO: 19957 - DNA, 264 bp, Neocallimastix californiae
  Chitinase insertion domain
tggtagatcgtggatttcaggtagttcttcaaataatggttatcttcaaagaccatctaactctcatccaaagggtgatgaagaagattacattgatccaaattcaaaaagatacagctctacctggaaatataaaaatattcgtaaagcaatcatgaaatcaacttataaagattcaactggaaattggattcgtgtatgggattcaaagtctagtgttccatttctgttcaacaagaacaccagacaatttattacgtatga

SEQ ID NO: 19958 - DNA, 285 bp, Anaeromyces robustus
  Chitinase insertion domain
cggaaagagttggattgctgcttcatctgataaaaatggtttatatcaatctattgctaacaaaagtccaaaaggtgatcaagatgatagtaatgatgcatggacaaattattgtggtgttgttgaaagtacttatagttcaaattggaaatataaaaaccttcgtaaagaaattttaacttctgattatacttctgcatctggtagttgggttcgcacttgggatgatactgttatggctccatatttatttaataaggatactaaacaaattatttcttatga

SEQ ID NO: 19959 - DNA, 264 bp, Anaeromyces robustus
  Chitinase insertion domain
tggtagatcatggattgctggtagttctaccaatcatggttatcttcaaagaccttctaattcttatccaaaaggtgatgaagaagattatattgattcagattctaaaagatattcttcaacttggaaatataaaaatatacgtaaacaagttttaaaatcagattattctaaatctactggtagttgggaacgtatatgggattctaaatcaagtgcaccatttttatttaataaagatactaaacaatttattacttatga

SEQ ID NO: 19960 - DNA, 285 bp, Piromyces finnis
  Chitinase insertion domain
ttataggagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatga

SEQ ID NO: 19961 - DNA, 285 bp, Piromyces finnis; identical to SEQ ID NO: 19960
  Chitinase insertion domain

SEQ ID NO: 19962 - DNA, 285 bp, Piromyces finnis
  Chitinase insertion domain
tggaaagagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatga

SEQ ID NO: 19963 - DNA, 27 bp, Neocallimastix californiae
  CHITINASE_18
tgatggtattgatattgattgggaata

SEQ ID NO: 19964 - DNA, 27 bp, Anaeromyces robustus
  CHITINASE_18
cgatggtattgatattgattgggaata

SEQ ID NO: 19965 - DNA, 27 bp, Piromyces finnis
  CHITINASE_18
tgatggtatcgatattgattgggaata

SEQ ID NO: 19966 - DNA, 276 bp, Neocallimastix californiae
  Chitinase_insertion
ttggattgctgcatcttcaaatagaaatggtttatatcaatctgttgctaatggaaatccaaaaggtgatcatgaagatagtaattcaccatggactaactattgtggagttcttgaaagtgcttacagtggaaattggaaatataaaaatattcgtagtgaaatcttaaaatctgattacacaactgcttcaggtagttgggttcgttcatgggatgataaagttaagggtccatatttatttaataaggaaactaaacaaatcattacatacga

SEQ ID NO: 19967 - DNA, 264 bp, Neocallimastix californiae
  Chitinase_insertion
atggatttcaagtacatctaataataatggtttacttcaaataccatccaattctttcccaaaaggtgatgaagaagatgtcatgaatgcagaatcaggaagatacagtggtatttggaaatataaaaatcttcgtaaacagattttacaatctagtttcaaagatgcaactggtgattggattcgtgtatgggattcaaaatctagtgttccttacttatataataaagtttcaagacaatttattacttatgatgatccaga

SEQ ID NO: 19968 - DNA, 264 bp, Neocallimastix californiae
  Chitinase_insertion
atggatttctggtagttcctcaaacaacggttatcttcaaagaccatctaattctcatccaaagggagatgaagaggattacattgattctagttcaaaaagatatagctctacctggaaatataaaaatattcgtaaagcaattgtaaaatctacttataaaaattcgtcaggggattggattcgtatatgggattcaaagtcgagtgttccatttctttttaatacgaatactagacaatttattacctatgatgatccgga

SEQ ID NO: 19969 - DNA, 264 bp, Neocallimastix californiae
  Chitinase_insertion
gtggatttcaggtagttcttcaaataatggttatcttcaaagaccatctaactctcatccaaagggtgatgaagaagattacattgatccaaattcaaaaagatacagctctacctggaaatataaaaatattcgtaaagcaatcatgaaatcaacttataaagattcaactggaaattggattcgtgtatgggattcaaagtctagtgttccatttctgttcaacaagaacaccagacaatttattacgtatgatgatccaga

SEQ ID NO: 19970 - DNA, 246 bp, Anaeromyces robustus
  Chitinase_insertion
atctgataaaaatggtttatatcaatctattgctaacaaaagtccaaaaggtgatcaagatgatagtaatgatgcatggacaaattattgtggtgttgttgaaagtacttatagttcaaattggaaatataaaaaccttcgtaaagaaattttaacttctgattatacttctgcatctggtagttgggttcgcacttgggatgatactgttatggctccatatttatttaataaggatactaaaca

SEQ ID NO: 19971 - DNA, 255 bp, Anaeromyces robustus
  Chitinase_insertion
atggattgctggtagttctaccaatcatggttatcttcaaagaccttctaattcttatccaaaaggtgatgaagaagattatattgattcagattctaaaagatattcttcaacttggaaatataaaaatatacgtaaacaagttttaaaatcagattattctaaatctactggtagttgggaacgtatatgggattctaaatcaagtgcaccatttttatttaataaagatactaaacaatttattacttatga

SEQ ID NO: 19972 - DNA, 297 bp, Piromyces finnis
  Chitinase_insertion
ttattataggagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatgatgatccaga

SEQ ID NO: 19973 - DNA, 297 bp, Piromyces finnis; identical to SEQ ID NO: 19972
  Chitinase_insertion

SEQ ID NO: 19974 - DNA, 279 bp, Piromyces finnis
  Chitinase_insertion
gagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatga

SEQ ID NO: 19975 - DNA, 330 bp, Neocallimastix californiae
  Chitobiase/Hex_dom_2-like
tgaagaattttctggtgtaaagaaaattgctgatatggttagaaatgatgtaaaacttgttactggtgccttaccagaattcaattactctcttaacactactattggtgaagaagctgcagttattttcggtactgttggaaaatctaatttatttgaaggtgttgatgtttctgctattaaagacaagtatgaatcttacgtattcaatgttcaaggaaatagaatttacattgctggtagtgataagcgtggtactatctatggtcttttccatctttctgaattaatgggtgtttctccatttgttgattggctcgacttaaagcc

SEQ ID NO: 19976 - DNA, 402 bp, Neocallimastix californiae
  Chitobiase/Hex_dom_2-like
atatgatggtatcagtatcattgctgaagctcttaaagctgatattgctagagttaccggtgaatcagttgataaagaaggtaaggcttcaaattcctctaatggattaaaaattataaccaatagttctcaattatcaggtaagatgattattgctggtacttttggtgctaaaggtaatgatgtcattaatcaacttattgataatggaaaaattgatgtcagtaatcttaaaggacgttgggaaagttatcaaatgcaagttattaaaaatccaataaacggtgttagtgaagcacttgttattgttggtagtgataaaagaggtaccctttatggtatgttccatatttccgaaatgatgggagtttcaccatgggtatggtggagcgatgtcactcc

SEQ ID NO: 19977 - DNA, 105 bp, Neocallimastix californiae
  ChtBD1
atgtggaagagattatggaaaatgtcctgatggtttatgctgttcacaatatggttggtgtggcgtaacaagtgattattgtgataataattgtcaacctgaatt

SEQ ID NO: 19978 - DNA, 117 bp, Neocallimastix californiae
  ChtBD1
atgtggcaaaggatatggaacttgtcctgatgatgaatgctgttctcggtatggttggtgtggtacaacaagtgaatattgtggttataaatgtcaatctgattatggaagatgtga

SEQ ID NO: 19979 - DNA, 117 bp, Neocallimastix californiae
  ChtBD1
atgtggtaaaggttatggttcatgcccaaataatgaatgctgttcacagtatggttggtgtggtacaactagtgaatattgtgattataagtgtcaattggattacggtagatgtaa

SEQ ID NO: 19980 - DNA, 105 bp, Anaeromyces robustus
  ChtBD1
atgtggtaaaggttatggttcatgtcccgataatgcatgttgttcacaatggggttggtgtggttttacatcagatcattgtggtgcaggatgtaataaagaata

SEQ ID NO: 19981 - DNA, 1014 bp, Neocallimastix californiae; identical to SEQ ID NO: 14514
  CINNAMYL ALCOHOL DEHYDROGENASE 2-RELATED

SEQ ID NO: 19982 - DNA, 1029 bp, Neocallimastix californiae; identical to SEQ ID NO: 14518
  CINNAMYL ALCOHOL DEHYDROGENASE 2-RELATED

SEQ ID NO: 19983 - DNA, 990 bp, Neocallimastix californiae; identical to SEQ ID NO: 14519
  CINNAMYL ALCOHOL DEHYDROGENASE 2-RELATED

SEQ ID NO: 19984 - DNA, 723 bp, Neocallimastix californiae
  ClpP/crotonase
gtatgatcttgaggaaggtattgccgtaattgaaatgtgttctccccaaaactttaatggtatgaatctagatatatcacgtcaacttcatgctcatgtcaatacccttaagatgagaaaggacgtaaaatgtgttatcgtacgtggctatcgacgtcatttctgtactggtgctgatccatcttgggtagcaaatattgagggtaaaacccatttacgtatggctttagaagtttatgagatttatagagattacgcttccattttagaattaaatgtacccgtaattggtatgttaaatggacgtattgttggtggtggtttagcgctttccttgaattgtgattggagagtcgccttaaaaacatctacgattgattttggtaatttaccaagaggagtatgtccaggaatgatgctttcagtgaatatggaatcatatgtcaaacgtggccgtagttttaatatgtatttacaaccaggatcttatggtatgacgatggaagaagctctttcgataggtatcattcaagaaattgcagactcttttgaagatttacaagagaaagcaattagaaaagctagagaaattgttcaagcttcaaaacagttccaaggtattgatcgttccatactactcatgcgtactcctttaaataaagaattaattatgaaagaagcttatcttttagcagaatgtgcagtctatacggatatggctaa

SEQ ID NO: 19985 - DNA, 558 bp, Neocallimastix californiae
  ClpP/crotonase
tattgtaatagaaagtacagatcgtttagttcatgttatctttaatcgaccagaagctaataatagttttactgaagatatgctaattcgattaatggaagcatatgatccaaataaaatactattcattgaaagtaaaggtaaaaacttttcaactggatgggatttgaatggtggtgatttcggtagtgaagcttttgaacaatctattgaaaaatatagtcaatttgttaagcaattagaaggtgccattcaacctattgtagtagtttgtcaaggtagttgtagaggaggtagtatgcttttcccattgatggcagattatgttattgcctatgaagatgccaattttggattcccagaagttagacgtggaggtattcctgctttagtttctgtagccgccttaaagaaattttcaagaacaatagcaaaacgtatgatgcttctcggtgaacctattcaagtggaagaagctaaaaaatgtaatttagtagattatatttgtcatactaaagaacaatgtaatgaattaataaagaaattattccaacaatt

SEQ ID NO: 19986 - DNA, 612 bp, Neocallimastix californiae
  ClpP/crotonase
tgatgttatagttaaatcaactgataaaattgttatccttactttaaatagaccagaaagtatgaatgacttacatactggtatgatcaaaaagatcattcaagccattgatgttcaaaaatcccttattattgaaaatgctggagataatttctgcatgggttggagtagtcttaatgcagaaactgaaactattgaaagtgtttatcattactacagtgagttaattaataaaatgaatagtgtcacacagccaatcatttctatttgtaagggtattgttttcggtggtggtatgattttcccatgtatgtctgatattgttattgctgataataatactacctttagtttctatgaaagtactttcaaacaaatgccatttattcttactaaagctgctcaaaatagaatcaaaagtagtcatataaaaaagatgttcttaattgaaaaggaagctaatattgaagaagctattaacatggaattggttgatattgctgtagcttcaaataagttggaaatggagaaaaaaagtgtcataagacgtataaatactctcgacccatctgttttaaagatcactaaagaaaatattaatgataccgaatt

SEQ ID NO: 19987 - DNA, 669 bp, Neocallimastix californiae
  ClpP/crotonase
ggatcttgtttctcttaagttagttgaacctaaaatttatcttcttgaaatcaaaactaatattataaaccttgaagtagcaagtcaaattggtaattcatttgaacaaatgaaggaaaaaaatgatgctcatgtcttaataataaagaatgcttcaaatgatttctgtcaaggatttgatgctgaattccttaatagtatttctggtaagagtaagagtcaattagccaatgaaatatatcatatttataaaaattacagtaaaacttatgaattaacaattccagttctttgttgtctgagtggttcagtaatgaatgctggtttgaatttagctttaacttcggattggagagttgcctccagagaaagttgcttatctttcattaataagagtaacactgttgactcatcagtaatgatgagtcactctttacaagattttgttggccgtggaaagagttttaatatacttttcaattatgataacaaaactagtaatgcagttgaagcttacaagcaaggcattgttcaagaattagtcgctaacccaaaccagttaatggatattgctttaactaaagcaagagttattgcctctgccccattaaagggtattaatcattctctaaacttaatgagaataccatatgaaaactcgttgttaat

SEQ ID NO: 19988 - DNA, 570 bp, Neocallimastix californiae
  ClpP/crotonase
agaggatggaatttacagtcttaccatgacgaatgattatatgaccttggagtatgcagaagaatttggacaggctataacgaagctttcacagctgaaaaagatgaaagctctgatcattgaatatgaagaccaactttcgaaaggattagaaccctccctaaaggaagagcttaataagacgaagccatccaagacgaagattaatgaaatttataaaatttatttccattgtatgaaattagccaatgttaatgtaccggtgatttgctgtctcaatggagagattacagatctcaatatacttttagccattctctccaactggaggctcatcactcgtcgttcctacctctcctcccataataatcccattaacattaattggattacggagttagtgaatgccaaaaatgatacccaatccttgaatttaattgaaaaaattgaaaaggaaaaaataagtgccattcaagcctataaattaaaatatgttaatgatattgcctctaatgccgaaaatatgaagaagatggcactcgaaatggccaagagtataatacaaaatga

SEQ ID NO: 19989 - DNA, 585 bp, Neocallimastix californiae
  ClpP/crotonase
tcatgtttactatcaaccgttagaggacggaatctattgtctgacattgaagaacgactacatgactttagaatatgctgaagaattaggacaagctattactgagctttctcaactgaagaaaatgaaaattttaattattgagtttgagaaaaacttttcgaaaggtttagaaccatcattaaaagaggaactttgtaaggagaaaccatccaagtcaaaaataaatgaaatttttaaaatatatttccattgtatgaaattagctaatattaatatacctgtaatctgttgtcttaatggtgagattactgacctttctatactcataggtcatttatccaattggagactcattactcgtcaatccgtctattattcccataataatccaattaacattaaatggatgacagatatagctataagcaatgatgagactcattatcttaagttgataaaacaattagaagaagaaaatattagtgcaatttatgcctacaaattaaaatacattaatgatatagccttcaatgttgaaaaaatgaaaataatggctctaaaaatggcaaaaattttaatacg

SEQ ID NO: 19990 - DNA, 582 bp, Anaeromyces robustus
  ClpP/crotonase
tgatattattattgaaagtacagatcgtttagttcatgtagtttttaatcgtccagaagctaataatagttttaatggtgatatgttaattaaattaatggatgcctacgatccaaataaaatacttttaatagaaagtcaaggtaaaaatttctctacgggatgggatttaaataatggtggctttaatagtcaagcatttgaagattctataaataaatatagtgaatttgttgaacgtttagagaatgcagttcaacctattgtagttatttgtcaaggtagttgtagaggtggcagtatgttattcccattaatggcagattatgttattgcttataaggatgcaagttttggattcccagaagttagacgtggtggtataccagcattagtttcagttgctgctatgaaaaaactttctagaactatggctaaacgtatgatgcttttaggtgaaccaattcaagtagaagaagctaaaaatacaaatttagttgattatatttgtaatacaaaagaagaatgtaatcaaatagttaaaaatctttttaatcaatttattacaaatcatattcatct

SEQ ID NO: 19991 - DNA, 723 bp, Anaeromyces robustus
  ClpP/crotonase
atatgatcttgaagaaggtatagccgtattagaaatgtgttccttaaaaaattttaatggtatgaatttagatatttcacgtcaacttcatgcacatgtaaatacattgaaaacaagaaaagatattaaatgtgttatattacgtggttataaacgtcatttctgtacaggtgcagatccatcttgggttgctaatattgaaggtaaaagtcatttacgtatggcattagaagtttatgaaatatatagagattatgcctccatacttgaattaaatgtacctgtaattggtatgttaaatggacgtattgttggtggaggattagctctttcacttaattgtgattggagagtagctttaaaaacttctacaatagattttggtaatttaccaagaggtgtatgtccaggtatgatgctttcagctaatatggaatcttttgttaaacgtggttatagttttaatatgtatttacaaccaggttcttatggtatgagtatggaagaagcattagaacttggtattatacaagaaattgctgaatcttttgaagatttacaagaaaaagctttattaaaagcaagagaaatcgtaaaagcttcaaaacaatatcaaggtattgatcgttcaatattattaatgcgtactccattaaatacagaacttattatgaaagaagcttatttattagcagaatgtgcagtatatacagatatggcaaa

SEQ ID NO: 19992 - DNA, 684 bp, Anaeromyces robustus
  ClpP/crotonase
ggatcttgtttcacttcaattagtagaaccaaaaatttatgttcttgaaatgaatactaatattattaatcttgaagttgcagctcaaattggtcatgctattgatattatgaaacaaaaaaatgatgctcatgttttaattattaagagtgctgcaccagatttctgtcaaggatttgatgctgaataccttaatagtatttctggaaagagtaaaagtcaactcgctaatgaaatttataatatatataagaattataataaaaattctgaattaaccattccagttctttgttgtcttagtggttctgttatgaatgctggtttgaatttagctttatcttctgattggagagtagcttccagagaaagttgtttatcttttattaataagaataatactgttgattcatctgttatgatgagtcatagtttacaagaatttattggtcgaggtaaaagttttaacatgatctttaattatgataataaaaaaagtaatgttttagaagcttataaacaaggtattgttcaagaattagtagctaatcctggacaattaatggatattgctttagctaaagcaagaataattgcatcggctccattaaagggtattaatcattctcttaatttaatgagaattccatatgataattctactttaatgaaagaagcttatat

SEQ ID NO: 19993 - DNA, 600 bp, Anaeromyces robustus
  ClpP/crotonase
tgttattattagaaatactgataaaattgtttttattaccttaaatagatcagaaagtatgaatgatttaaataataaaatgattgaaaaaattattgaagctattgatccacaaaagtcacttattattgatagtacaggtgatcatttaagtatgggttggacttctaatgaatctaaatcagatacaatagaaaatgtttaccatatttatggtaaattaatggataaaatgagtgaggtaactcaaccaatagttactatttgtaaaggtgctgtttttggtggaggtatgattttcccatgtatgtctgatattgttattgctgataataatgctacttttagtttttatgaaactaattttaaacaaattccatttattcttactaaagctgctcaaaatagaataaagaatagtcaaattatgaaaatgttcttaattgaaaaggaagctgaagttaatgaagcacgtaatatggagttagtagatattattgttaatagtgataaattagataatgaaaagaagagtgttattagacgtattaatactcttgattcatctgttttaaaaataactaaagaaaatattaaaga

SEQ ID NO: 19994 - DNA, 612 bp, Piromyces finnis
  ClpP/crotonase
tatcatcatcagaccaactgaaaaagttgttttccttacattaaacagaccaggtagtatgaatgatttacatgctaatatgatgagaaaaatcatttctgctattgatacccaaaaagctcttgttattgaaggatctggtgataacttctgtatgggatggacttcttccagtatgaataaacacgaaacaaccgaaaacatatatcaactttatggtgaattaataaagaagatgaataaggttacccaaccaattgttactatctgtaagggtgttgtctttggtggtggtatgatcttcccatgtatgtcagatattgtcattgctgaaaacaacgctgtctttagtttctatgaaaaccgcttaaagcaaataccattcattctttctaaagctgctcaaaacagaataaagcacagtcaaataaagaagatgttcttaattgaaaaagaagctgatattgaagaggctattaatatggaattagtagatatttcagttccagctgataaattagaaatggaaaagaagagtgttcttagacgtattaatacacttgatccaactgttttaaagattaccaaggaaaatattaaggatgcagaatt

SEQ ID NO: 19995 - DNA, 666 bp, Piromyces finnis
  ClpP/crotonase
ggatcttgttagtttagaattattagaaccaaaaatctatcttcttgaaattaaaactaacatcattaatccagaaatcgcagctcaaattggaaatgctttcgaacaaatgaaagaaaaggatgatgctcatgtcttaattgttaagtgcaatggtgatgacttctgtcaaggttttgatgctgaattccttaatagcatatccaataaaacaaagggtcaattagccaatgaaatttataatatttacaagaactacagtaagagttctgaattaaccattccagttctttgctgtcttaatggatctgttatgaatgctggtttgaactttgccttaacctctgattggagagtcgccaccagagaaacttgtctttccttcattaataaaaccaaaactgttgactcttcagtcatgatgagtcacagtttacaagattttataggtcgtggtaagagttttaatatgatcttcaactatgataatactaccaacaatgctattgaagcccataaacaaggtatcattcaagaattagttgctaaccaaagccaattattagatgctgctttagttaaggctagaattattgcttctgctccattaaagggtattaatcattctctcaatttaatgagaattccatatgataattcctcttt

SEQ ID NO: 19996 - DNA, 561 bp, Neocallimastix californiae
  ClpP/crotonase-like_dom
taatattgtaatagaaagtacagatcgtttagttcatgttatctttaatcgaccagaagctaataatagttttactgaagatatgctaattcgattaatggaagcatatgatccaaataaaatactattcattgaaagtaaaggtaaaaacttttcaactggatgggatttgaatggtggtgatttcggtagtgaagcttttgaacaatctattgaaaaatatagtcaatttgttaagcaattagaaggtgccattcaacctattgtagtagtttgtcaaggtagttgtagaggaggtagtatgcttttcccattgatggcagattatgttattgcctatgaagatgccaattttggattcccagaagttagacgtggaggtattcctgctttagtttctgtagccgccttaaagaaattttcaagaacaatagcaaaacgtatgatgcttctcggtgaacctattcaagtggaagaagctaaaaaatgtaatttagtagattatatttgtcatactaaagaacaatgtaatgaattaataaagaaattattccaacaatt

SEQ ID NO: 19997 - DNA, 609 bp, Neocallimastix californiae
  ClpP/crotonase-like_dom
tgatcttgaggaaggtattgccgtaattgaaatgtgttctccccaaaactttaatggtatgaatctagatatatcacgtcaacttcatgctcatgtcaatacccttaagatgagaaaggacgtaaaatgtgttatcgtacgtggctatcgacgtcatttctgtactggtgctgatccatcttgggtagcaaatattgagggtaaaacccatttacgtatggctttagaagtttatgagatttatagagattacgcttccattttagaattaaatgtacccgtaattggtatgttaaatggacgtattgttggtggtggtttagcgctttccttgaattgtgattggagagtcgccttaaaaacatctacgattgattttggtaatttaccaagaggagtatgtccaggaatgatgctttcagtgaatatggaatcatatgtcaaacgtggccgtagttttaatatgtatttacaaccaggatcttatggtatgacgatggaagaagctctttcgataggtatcattcaagaaattgcagactcttttgaagatttacaagagaaagcaattagaaaagctagagaaattgttcaagcttcaaaacagtt

SEQ ID NO: 19998 - DNA, 621 bp, Neocallimastix californiae
  ClpP/crotonase-like_dom
cgatgatgttatagttaaatcaactgataaaattgttatccttactttaaatagaccagaaagtatgaatgacttacatactggtatgatcaaaaagatcattcaagccattgatgttcaaaaatcccttattattgaaaatgctggagataatttctgcatgggttggagtagtcttaatgcagaaactgaaactattgaaagtgtttatcattactacagtgagttaattaataaaatgaatagtgtcacacagccaatcatttctatttgtaagggtattgttttcggtggtggtatgattttcccatgtatgtctgatattgttattgctgataataatactacctttagtttctatgaaagtactttcaaacaaatgccatttattcttactaaagctgctcaaaatagaatcaaaagtagtcatataaaaaagatgttcttaattgaaaaggaagctaatattgaagaagctattaacatggaattggttgatattgctgtagcttcaaataagttggaaatggagaaaaaaagtgtcataagacgtataaatactctcgacccatctgttttaaagatcactaaagaaaatattaatgataccgaattatcttt

SEQ ID NO: 19999 - DNA, 546 bp, Neocallimastix californiae
  ClpP/crotonase-like_dom
taatattataaaccttgaagtagcaagtcaaattggtaattcatttgaacaaatgaaggaaaaaaatgatgctcatgtcttaataataaagaatgcttcaaatgatttctgtcaaggatttgatgctgaattccttaatagtatttctggtaagagtaagagtcaattagccaatgaaatatatcatatttataaaaattacagtaaaacttatgaattaacaattccagttctttgttgtctgagtggttcagtaatgaatgctggtttgaatttagctttaacttcggattggagagttgcctccagagaaagttgcttatctttcattaataagagtaacactgttgactcatcagtaatgatgagtcactctttacaagattttgttggccgtggaaagagttttaatatacttttcaattatgataacaaaactagtaatgcagttgaagcttacaagcaaggcattgttcaagaattagtcgctaacccaaaccagttaatggatattgctttaactaaagcaagagttattgcctctgc

SEQ ID NO: 20000 - DNA, 588 bp, Neocallimastix californiae
  ClpP/crotonase-like_dom
atatgttcattatcaacccatagaggatggaatttacagtcttaccatgacgaatgattatatgaccttggagtatgcagaagaatttggacaggctataacgaagctttcacagctgaaaaagatgaaagctctgatcattgaatatgaagaccaactttcgaaaggattagaaccctccctaaaggaagagcttaataagacgaagccatccaagacgaagattaatgaaatttataaaatttatttccattgtatgaaattagccaatgttaatgtaccggtgatttgctgtctcaatggagagattacagatctcaatatacttttagccattctctccaactggaggctcatcactcgtcgttcctacctctcctcccataataatcccattaacattaattggattacggagttagtgaatgccaaaaatgatacccaatccttgaatttaattgaaaaaattgaaaaggaaaaaataagtgccattcaagcctataaattaaaatatgttaatgatattgcctctaatgccgaaaatatgaagaagatggcactcgaaatggccaagagtataatacaaaa

SEQ ID NO: 20001 - DNA, 612 bp, Anaeromyces robustus
  ClpP/crotonase-like_dom
atatgatcttgaagaaggtatagccgtattagaaatgtgttccttaaaaaattttaatggtatgaatttagatatttcacgtcaacttcatgcacatgtaaatacattgaaaacaagaaaagatattaaatgtgttatattacgtggttataaacgtcatttctgtacaggtgcagatccatcttgggttgctaatattgaaggtaaaagtcatttacgtatggcattagaagtttatgaaatatatagagattatgcctccatacttgaattaaatgtacctgtaattggtatgttaaatggacgtattgttggtggaggattagctctttcacttaattgtgattggagagtagctttaaaaacttctacaatagattttggtaatttaccaagaggtgtatgtccaggtatgatgctttcagctaatatggaatcttttgttaaacgtggttatagttttaatatgtatttacaaccaggttcttatggtatgagtatggaagaagcattagaacttggtattatacaagaaattgctgaatcttttgaagatttacaagaaaaagctttattaaaagcaagagaaatcgtaaaagcttcaaaacaata

SEQ ID NO: 20002 - DNA, 582 bp, Anaeromyces robustus
  ClpP/crotonase-like_dom
tgataaatctgatattattattgaaagtacagatcgtttagttcatgtagtttttaatcgtccagaagctaataatagttttaatggtgatatgttaattaaattaatggatgcctacgatccaaataaaatacttttaatagaaagtcaaggtaaaaatttctctacgggatgggatttaaataatggtggctttaatagtcaagcatttgaagattctataaataaatatagtgaatttgttgaacgtttagagaatgcagttcaacctattgtagttatttgtcaaggtagttgtagaggtggcagtatgttattcccattaatggcagattatgttattgcttataaggatgcaagttttggattcccagaagttagacgtggtggtataccagcattagtttcagttgctgctatgaaaaaactttctagaactatggctaaacgtatgatgcttttaggtgaaccaattcaagtagaagaagctaaaaatacaaatttagttgattatatttgtaatacaaaagaagaatgtaatcaaatagttaaaaatctttttaatcaatttattacaaatca

SEQ ID NO: 20003 - DNA, 624 bp, Anaeromyces robustus
  ClpP/crotonase-like_dom
attaccatttagtgaaaatgatgttattattagaaatactgataaaattgtttttattaccttaaatagatcagaaagtatgaatgatttaaataataaaatgattgaaaaaattattgaagctattgatccacaaaagtcacttattattgatagtacaggtgatcatttaagtatgggttggacttctaatgaatctaaatcagatacaatagaaaatgtttaccatatttatggtaaattaatggataaaatgagtgaggtaactcaaccaatagttactatttgtaaaggtgctgtttttggtggaggtatgattttcccatgtatgtctgatattgttattgctgataataatgctacttttagtttttatgaaactaattttaaacaaattccatttattcttactaaagctgctcaaaatagaataaagaatagtcaaattatgaaaatgttcttaattgaaaaggaagctgaagttaatgaagcacgtaatatggagttagtagatattattgttaatagtgataaattagataatgaaaagaagagtgttattagacgtattaatactcttgattcatctgttttaaaaataactaaagaaaatattaaagataa

SEQ ID NO: 20004 - DNA, 612 bp, Anaeromyces robustus
  ClpP/crotonase-like_dom
aatgaatactaatattattaatcttgaagttgcagctcaaattggtcatgctattgatattatgaaacaaaaaaatgatgctcatgttttaattattaagagtgctgcaccagatttctgtcaaggatttgatgctgaataccttaatagtatttctggaaagagtaaaagtcaactcgctaatgaaatttataatatatataagaattataataaaaattctgaattaaccattccagttctttgttgtcttagtggttctgttatgaatgctggtttgaatttagctttatcttctgattggagagtagcttccagagaaagttgtttatcttttattaataagaataatactgttgattcatctgttatgatgagtcatagtttacaagaatttattggtcgaggtaaaagttttaacatgatctttaattatgataataaaaaaagtaatgttttagaagcttataaacaaggtattgttcaagaattagtagctaatcctggacaattaatggatattgctttagctaaagcaagaataattgcatcggctccattaaagggtattaatcattctcttaatttaatgagaattccatatgataattc

SEQ ID NO: 20005 - DNA, 645 bp, Piromyces finnis
  ClpP/crotonase-like_dom
aaaggttaaaccacaagcctttgctgaagatgatatcatcatcagaccaactgaaaaagttgttttccttacattaaacagaccaggtagtatgaatgatttacatgctaatatgatgagaaaaatcatttctgctattgatacccaaaaagctcttgttattgaaggatctggtgataacttctgtatgggatggacttcttccagtatgaataaacacgaaacaaccgaaaacatatatcaactttatggtgaattaataaagaagatgaataaggttacccaaccaattgttactatctgtaagggtgttgtctttggtggtggtatgatcttcccatgtatgtcagatattgtcattgctgaaaacaacgctgtctttagtttctatgaaaaccgcttaaagcaaataccattcattctttctaaagctgctcaaaacagaataaagcacagtcaaataaagaagatgttcttaattgaaaaagaagctgatattgaagaggctattaatatggaattagtagatatttcagttccagctgataaattagaaatggaaaagaagagtgttcttagacgtattaatacacttgatccaactgttttaaagattaccaaggaaaatattaaggatgcagaatt

SEQ ID NO: 20006 - DNA, 609 bp, Piromyces finnis
  ClpP/crotonase-like_dom
aactaacatcattaatccagaaatcgcagctcaaattggaaatgctttcgaacaaatgaaagaaaaggatgatgctcatgtcttaattgttaagtgcaatggtgatgacttctgtcaaggttttgatgctgaattccttaatagcatatccaataaaacaaagggtcaattagccaatgaaatttataatatttacaagaactacagtaagagttctgaattaaccattccagttctttgctgtcttaatggatctgttatgaatgctggtttgaactttgccttaacctctgattggagagtcgccaccagagaaacttgtctttccttcattaataaaaccaaaactgttgactcttcagtcatgatgagtcacagtttacaagattttataggtcgtggtaagagttttaatatgatcttcaactatgataatactaccaacaatgctattgaagcccataaacaaggtatcattcaagaattagttgctaaccaaagccaattattagatgctgctttagttaaggctagaattattgcttctgctccattaaagggtattaatcattctctcaatttaatgagaattccatatgataattcctc

SEQ ID NO: 20007 - DNA, 336 bp, Anaeromyces robustus
  CoA-dependent acyltransferases
agatgaatttacgagtgaaaaaattaatgaatatgttaaaaataataaaattagtaaaacagcgtttttccttagtatatatggatatattttatcaaaatacagtagacaagatataatctatagttcagttatgagtactaatcgtaataataattatattcaagacatgattggaatgtttgttagtacacaaccaatattacttaaatattctaacaaagaaatgaactcatttacagatatcataaaacaaataatgtctgttttatatgatatatataattatcaggatatttcattctctgaattatcaaatatattaaatttgaaaaa

SEQ ID NO: 20008 - DNA, 633 bp, Anaeromyces robustus
  CoA-dependent acyltransferases
gaactgctataaaagtattgataaatctactacgagtttaataaatgaatatattaaaaagcatggaataagtaaagcagcattcttcattactatatatggatatgtcttatccaaatatagtggacaaaatatagtttatagttcaatagttaatgccaatagaaataatcattatacagaaaatatgattggtatgtttgttagtacccaaccaattttattgaaatatgacgatgaagaaagttcattacttgaaattataaagcaaaatatgaataatttaatggaaatgtataataatcaagatatttcattttcagaattattgaaattattgaagttaaagaaaataaacaactcatttgtttttcaaccaaaagtaatgtttaataataataattcagagaattcaatattttcggatgataataatgaaaatatgtttacattgtatgaaagttctaatgaattgcttaataaagagaattcaaaatttgatattacttttaatgttgttgaaaacgaagaaaactatttaatttcaatcatctataatgaccatctttatgaatcaaaaattattaataatataattgatagttacctggaagtagccaaaaatattaatga

SEQ ID NO: 20009 - DNA, 471 bp, Anaeromyces robustus
  CoA-dependent acyltransferases
tactcaacaattaggtgtttatgttgatactattaaaaacccagatgctatagtatataatacaccattaatatttaaattaactaaaaatattgatattaataaaattaaagaagcttttaataaattatttaaaaatcaagaaatattaagaagtaaatattatgaaaaggaaattaatggaaaaacggaaatttatggatttattgatgatgagtgtttattacttttcgaagaatatacatatgaaaatgctaaaacatttgttcgaccatttgaattatccaaagcaccattaataagagttggttttattaaaaatgaaatattattaattgatatgcatcatattatttccgatggatccactatgcttataattaagaaggaattaaataattattataataataatgaaataaaagaattggaaattcaatttagtgattatgctattgatttaaatgaaaa

SEQ ID NO: 20010 - DNA, 474 bp, Anaeromyces robustus
  CoA-dependent acyltransferases
ttcacaacaattgggtgtttatattgactcaattaaaaatccagatagtattatgtataatattccaagtgtatttaaattgaaaaaagatattgatattaataaaattaaaatggcattaaataaaatatttaaatgtcaagaaatcttaagaagcaaatattatgaaaaggaagttaatggaaagacagaaatatttggatatattgatgatgaatgcttattattatttgaagaatatacttatgaaaatgcaaaatcatttattagaccatttaaattatcagaagctccattaataagaattggttttattaaaaatgaaatattgttaattgatatgcatcatatcatttctgatggttcttcaatgttaattattaaaaatgaattaaatagttatttctataataatgaaataattcaagaattagaaatccaatttagtgattatagtatatatatgaatgaaaa

SEQ ID NO: 20011 - DNA, 213 bp, Anaeromyces robustus
  CoA-dependent acyltransferases
aaaaattattgatagttcattgagtaaaagaatcaatgaatacatcagggtcaacagaattagtaagacagcattctttattagtatctatggatatatattgagtaaatatagtggacaagacaatatatatacttcaatgatgagtgccaatagaaataatcattatgtagaaaatatgattggtatgtttgtaagtactcagccaattct

SEQ ID NO: 20012 - DNA, 558 bp, Neocallimastix californiae
  ConA-like_subgrp
tcgttggaatttaaatagtggtggtgagtgcattaaggtaaaggatggtatgttcattgattctgttagtcaatcttgtccaggttctggtaatggtggtcgtatgagaactaatgttcgttacaagtctggtaagttcgaagttcgtgctaagatgccaattgctagtggtttagttccagctatttactttgcctctactccagataacactaacggtaaccaagatgaatttgatttcgaattaattggaagcaaccgtatgcaaactaatttattcatttatggtaatggtggtcgtgaacaagtttggaacccaccaaccgatttatctaaagatttccacctttacacctttgaatggaattcaaattccattgttttaaaggttgataaccaagttattcgtaccttcaataatccaatgccacaacaaccatgttactttattttaactaattggatgtgcgttggttgcgatggttggactggtccagctgattggtctagacaaccttatgacttcattgttgattacgttaagatttctgatgctac

SEQ ID NO: 20013 - DNA, 642 bp, Neocallimastix californiae
  ConA-like_subgrp
aagtgatgactttaattacgacagtaatcatttagatttagtatggcaatggaatcacaatccagataattctgcttggtctgttactgaacgtccaggttggttacgtcttaaaaataaacatgttgcttctgaaatacttaaagctagaaatactcttaccatgcgtacggagggtccagcatgtagcagtgttgttaagttagatgtaactaatttaaaggttggtgattacgctggtctttctgcttttcaatataattacggtaatgttggtgtttatgttgctgataacggtgaaaaacgtatatacatggctagtaacggtaataccaatggagatgtcatcaaggatagtagaaacaatattgttcaagaaacaaaattaaatggtaatgaagtctaccttaaattagatttccgttttagtaatgttgaacgtgatggaagtgcttcatggaatattgataaggtaaacttttattattcttacgatggtagtaaatggactaaaattggtaaggaaattggtatgacctatgatcttaaactcttcaccggttacagaagtggtctttttagttacccaactaaaaatactggtggttatgctgactttgacttctttaaatatgaacgtga

SEQ ID NO: 20014 - DNA, 321 bp, Neocallimastix californiae
  ConA-like_subgrp
aaaatattggaattataaatatccatggggttcagatcacaatggttcagctcgtatgtatggtactagtactgatcatacacacgtttatttaaaggaaaatacagttgttctttttgctaaaagaattaactgggatgaaggaaaaagtacttctaacccacatccagcaattcattatcattctggtgcaatccactcaaagcaaactttcacggtaaatgatcaatatccaaactatgaaattaaaggtgaattcatggttccaactaattcaggtacatggccagcgttctggttaaatggtgcaaaaacatggcc

SEQ ID NO: 20015 - DNA, 429 bp, Neocallimastix californiae
  ConA-like_subgrp
accagaaattgatattgttgaatttaagggtagtaacgttaattggtttaatactttccgtacttcaagtgatgtttcaacttacaagaccactattaataataaaggtgcctggcatgaataccgtatttggataactaaagtttcaaatactaacatagatattcacttttacattgatggtgtttggaaagcaaagcatactgctaatcacgttggaaagccattccatttaattatgaatttacaaatggaaggtagttctggtggtaatggtccaagttcaaatacttacttcagaggtaaaaatatttacgttggtagaaccagagaatgtgttggtgatgagtgctctaatcaatctaatgcatcaccaacaactactaccaatgaaaaaactacaactaaagcaactcaaccagcacaaac

SEQ ID NO: 20016 - DNA, 639 bp, Neocallimastix californiae
  ConA-like_subgrp
ttgggaaactcttattaatgattctctcaaggattatggaacatttgaaaaatattgggcttacttatatccatggggttcagatcataatggttctgcccgtatgtacggtgctccagatgaccacaaccatgtttatttagaaaataattcagttgttcttcaggcctgtagaattaattgggatgaaggtaaaagtactgctaatccacacccagtaattcattatcactctggtgcaattcactcaattcaaacttttactattaatgaccaatatccaaattacgaaattagaggtgaattcatagctccaactactggaggtacatggccagccttttggttgaatggtgcatggacttggccaccagaaattgatattcttgaattcaagggtaccactaccaattggtttaatactttccgtacttcaagtgatgtctctacatacaaagaagctattagcaatccaaatacttggcacgaatatcgtctttggattagcaaagtttcagatgttaatatggatattcatttctatattgatggaaaatggagagctaaacacactgcaaatcatgttggaaaaccattccatttaattatgaatttacaaatggaaggaagtgctagtgg

SEQ ID NO: 20017 - DNA, 474 bp, Neocallimastix californiae
  ConA-like_subgrp
tgctttaactattcctcataacagtaagattgattctgcattagaaggtagaaattcatttactattgaagtcaatgttgttcctactggtgttcaacaattcaatatgttagcaggaaaaggtgaccgttcgatcggtttcagaacatcaacgaattctattgatttcttcatttatgcaggaaatgaatggcgtaccgttaactacaatatgggtgtagattctgcttcaggttgggtaggcagaaaacatcaagtagctggtatttatgatgctgaaaataatatgttaagagtttatgccgatggtaggatattaggtgaaagatctgtaggtacaaattcaggtgtagctcattccaattataatctcatgttaggtgcttgtccagatactggaagaaattctcaaggaaacttttatgaaatgagagtatatagtaaggctctcacagcttcagaattagcttctca

SEQ ID NO: 20018 - DNA, 721 bp, Neocallimastix californiae
  ConA-like_subgrp
tgagatgaaacttgttttttcagatgaatttgatggtgatgagttagataaatctgtatgggatgttgaagttaattgttggggaggtggtaatggagaaaaacaatgttatgttgatcatgaggaaaatatatttgttaaagatggtcagttacatattaaggctataccaaaaggtgaatataaattaactgatgaggaaaagaaatcatgcactaataataatgagaattcatgtggatggactcaaagtgttactagtggtcgtattagaacttataagagtggtcatgcttggaagtatggtaaagttagagttaaggctaaattaccagcaggtccatatctttggccagctatatggatgttaccacaagacgatgtttatggtacatgggcagcttcaggagaaattgatatcatggaagctagaggacaagttccggatgctgtaggtcatgccattcattatggaggtcaatggccaaataatgttttttcatctgaaactgcttctgttaaagatgttatcaatgatttccatgtttatggattagattgggaagagaatttcctcatttttagtgttgatgaagtcgaatactttactgttgatcttcgtaaaagcttctattctggaaaaggaagtaatccatacaaggatattcgtcaaccatttgatgaaaaattccatcttttattgaatgttgcagtaggtgga

SEQ ID NO: 20019 - DNA, 645 bp, Neocallimastix californiae
  ConA-like_subgrp
gagtgatgatttcgactacagttccaataggttatccttagaatggcaatggaatcataatcctgataatactgcttggtctgtaaccgatcgtccaggttggttaagacttaagaataagtatattgctccagaacttcttaaggcaagaaatactcttaccatgcgtacagaaggtcctgcctgtagtggtgttgtaaaacttgatacttctaatatgaaggttggtgattatgctggtctttctgctttccaatataactatggtaatgttggtgtttatgttgctgataatggtgaaagacgtatttacatggcaagtaatggcggttataatggtaatgctgatgttaccaacagtagaaataatattgttcaagaagtcaaattaaatggtaaagagatttatctaaagaccgattttcgtttcagtactgttaagagcgatggtagtgcttcaaataatatcgataaagttaatttctattactcccttgatggtaatcaatggaataagattggtaaagaaattggaatgacttatgatcttaagcttttcacaggttacagaaatgctcttttcagttatccaacaaagaatactggaggttatgctgatttcgattactttgaatatcaacgcga

SEQ ID NO: 20020 - DNA, 372 bp, Neocallimastix californiae
  ConA-like_subgrp
ttattgggaaactattctttcggattctcttactgattatcaaacttttgaaaaatattgggattacttatatccatggggttcagatcacaatggttcagctcgtatgtatggtgcttctgatgatcacaatcatgtatatttagaaaacaacactgttgttcttaaagcttctagaattaattgggatgaaggaaaaagtacagctaatccacacccagtaattcattatcactctggtgctattcactcaaaacaaacttttacaattaatgatcaatatccaaattatgaaattagaggggaatttcaagccccaactaatggaggtacatggcctgctttctggttaaatggtgcttggacttggcc

SEQ ID NO: 20021 - DNA, 408 bp, Neocallimastix californiae
  ConA-like_subgrp
accagaaattgatattcttgaattcaaaggtactactaccaactggtttaatactttccgtacttcaagtgatgtttctacatataaagaagctataagtaatccaagtggttggcatgaatatcgtctttggattaccaaggtttcaaatactgatatggatattcatttctatattgataataaatggaaggctaaacacactgcaaaccatgttggaaaaccattccatttaattatgaatttacaaatggaaggtagtgctagtggtagtgctccaaatggtgatacatattacagaggaagaaatatttatgttggtagaagtaatgaaagtgctccaccatccaatgctgctgctgaggtcaaaacttctaaaacagcagctactacaactgttgcatcaaa

SEQ ID NO: 20022 - DNA, 507 bp, Neocallimastix californiae
  ConA-like_subgrp
gaacttaaatagtggtggtgaatgtattaaggtacaaaatggtatgttcatcgattctgtaagtcaatcttgtcctggttctggtaatggtggtcgtatgagaaccaatgttcgttacaaatctggtaaatttgaagttcgtgctaagatgcctattgctagtggtttagtaccagctatttattttgcttccacccctgataacaccaacggtgatcaagatgaatttgatttcgaattaattggtagtaaccgtatgcaaacaaacttattcattcatggtaatggtggtcgtgaacaaatttggaacccaccaaccgatttatcgaaggacttccacctctacacctttgaatggagctctaatgccattgtcttgaaggtggataatgaagttattcgtaccttcaataatccaatgccagaccaaccaagttacttcattttaacgaattggatgtgtattggatgtgatggttggactggtcctgcagattggtcaaaaca

SEQ ID NO: 20023 - DNA, 474 bp, Neocallimastix californiae
  ConA-like_subgrp
tgctttaactattccacataatagtaaacttgattctgctcttcaaggtagaaattcatttactattgaagttaatgttgttccaactggtgttcaatccttcaatatgttagccggtaagggtgattactctttaggtttcagaactactactggtgctcttgatttctttgtttatgccggtaatgaatggcgtatggttagttacactatgggtgttgatgctaattctggttggattggtaagaaacatcaagttgccggtattttcgatgctggtagtaatatgttaagattatatgttgatggtaagatggttgctgaaaagtctgttggtactacagctggtgtcagttcttccaactataatcttatgttaggtgcttgtccagatactggtagaaattcacaaggtaacttctatgaaatgagagtttatagtaaagctctttctgcttctgaattatcttctca

SEQ ID NO: 20024 - DNA, 531 bp, Neocallimastix californiae
  ConA-like_subgrp
gttaagattaaaaaataaatatgttgtaagtgaacttcttagagctagaaatactttaactatgcgtactgaaggtccagcatgtactagtattgttaaaatggatacttctaaaatgaaagttggtgattatgctggtctttctgccttccaatttaaatatggtaatgttggtgtttatgttgctgataatggtgaaaaacgtgtttatatggcaactaatggtggtaatgaaattaataatagtagaaattatattgaacaagaaactcgtatgtctggtaatgaaatttatcttaaattagaattccgtttcaataatgttggaaatgatggtagtgcctcaaacaatattgatagagttaatttctattattcttatgatggtgataaatggaccaagattggtaaggaacttggtatgacctatgatcttactcttttcactggttatcgtagtgctctttacagttacccaactaaatctactggtggttatgttgattttgattatattaaatatacacgtga

SEQ ID NO: 20025 - DNA, 636 bp, Anaeromyces robustus
  ConA-like_subgrp
aagtgatgatttcaattatagtagtaatgatgaattagatttagtttggcaatggaatcataatccagataattctgcttggtctgttactgaacgtgaaggttggttaagattaaaaaataaatatgttgtaagtgaacttcttagagctagaaatactttaactatgcgtactgaaggtccagcatgtactagtattgttaaaatggatacttctaaaatgaaagttggtgattatgctggtctttctgccttccaatttaaatatggtaatgttggtgtttatgttgctgataatggtgaaaaacgtgtttatatggcaactaatggtggtaatgaaattaataatagtagaaattatattgaacaagaaactcgtatgtctggtaatgaaatttatcttaaattagaattccgtttcaataatgttggaaatgatggtagtgcctcaaacaatattgatagagttaatttctattattcttatgatggtgataaatggaccaagattggtaaggaacttggtatgacctatgatcttactcttttcactggttatcgtagtgctctttacagttacccaactaaatctactggtggttatgttgattttgattatattaaatatacacgtga

SEQ ID NO: 20026 - DNA, 558 bp, Anaeromyces robustus
  ConA-like_subgrp
tcgttggaatttaaatagtggtgctgaatgtatgaaggttcaaggtggtatgttcattgattcagttagtcaatcctgcagaggatcaggtaatggtggtcgtatgagaactaatgttcgttacaagtctggtaagtttgaagttcgtgctaagatgccaattgctagtggtttagtaccagctatttactttgcttcaactccagataatactaatggtagtcaagatgaatgggatttcgaattaattggtagtaaccgtatgcaaactaatttattcattaatggtcaaggtggtcgtgaagaagtttggaatccaccttatgatttatctagagatttccatacttatacttttgaatggacttctaattctatcgttttaaaggttgataatcaagtcgttcgtaccttcaataatccaatgccaactcaaccaagttacttcattttaactaattggatgtgtgttggttgtgatggatggactggtccagctgattggtctagacaaccatacgatttcattgttgactatgttaaaattactgatgctac

SEQ ID NO: 20027 - DNA, 369 bp, Anaeromyces robustus
  ConA-like_subgrp
atgggaaactgttattagtgattctctttcagattatcaaacttttgaaaagtattggaattacttatacccatggggttcagatcacaatggttctgctcgtatgtatggtgctccagatgatcacaaccatgtttacttaaaagataacactgtagttattttagctacaagaattaattgggatgaaggtaaaagtacagctaatccacatccagaaattcattatcactctggtgctattcactcaaaagaaacttttactattaatgatcaatttccaaattatgaaattagaggtgaattcatggttccaactacaagaggtacctggccagctttctggttaaatggtgcttggacatggcc

SEQ ID NO: 20028 - DNA, 453 bp, Anaeromyces robustus
  ConA-like_subgrp
accagaaattgatattgttgaatttaagggagataatgtgaattggtttaatactttccgtacttcaagtgatgtttctacctacaaacaaggtattagtaacccaggtgcttggcatgaataccgtgtttggattaccaaggtttccaacacggatatggatattcatttctatattgatggtcaatggaaagctaaacatactgctaatcatgttggtaaaccattccatttaattatgaatttacaaatggaaggtagttctggtaataatggtccaacttctaacacttattacagaggtagaaatatttatgttggtagaagcagagcatgtgtaggtaatgattgtgataaggataaaactacaactactacaacaacaaaaaaatctactacaacgactactactaaaaaatctactactacaactacttctaataaaccttctca

SEQ ID NO: 20029 - DNA, 181 bp, Anaeromyces robustus
  ConA-like_subgrp
aattccaagtatggatgattataaattagtattttcagatgaatttgaaggaaataaattagatagatctgtatgggatgttgaagttaattgttggggaggtggtaacggtgaaaaacaatgttatgttgatcatgatgaaaatatttttgtaaagaatggtcaacttcatattaaagct

SEQ ID NO: 20030 - DNA, 822 bp, Anaeromyces robustus
  ConA-like_subgrp
tgaaatgaaacttgttttttcagatgaatttgaaggaaatgaattagacagatctgtatgggatgttgaagttaattgttggggaggtggtaacggtgaaaaacaatgttatgttgatcatgatgaaaatatttttgtaaagaatggtcaacttcatattaaagctgttccaaaaggtcaatataaattaactgatcaagaaatgaaaacatgtactaataataatgaaaactcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtacctgatgctgtaggtcatgcaatacattttggtggtcaatggccagataatgactttatgtctgaaacagcttctattaaaaatgttattaatgatttccatgtttatggtttagattgggaagaaaacttccttatctttactgttgacgagaaaccatattataccgttgatcttcgtaagagtttttggtctggtaagggaactaatccatataaaaagattcgtcaaccatttgatgaaaaattccatcttttattaaatgttgctgttggtggtaattatttcaatggtattggtgaatttgattatggtcgtgatacaccacaatggactcgtccagaaatgattattgattatgttcgtgtctatcaattacc

SEQ ID NO: 20031 - DNA, 837 bp, Anaeromyces robustus
  ConA-like_subgrp
aattccaagtatggatgattataaattagtattttcagatgaatttgaaggaaataaattagatagatctgtatgggatgttgaagttaattgttggggaggtggtaacggtgaaaaacaatgttatgttgatcatgatgaaaatatttttgtaaagaatggtcaacttcatattaaagctgttccaaaaggtcaatataaattaactgatcaagaaatgaaaacatgtactaataataatgaagattcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtatcaaatgctattggaaatgctattcattttggtggtcaatggccaaataatgattttgtagataaaacatacaacctttctaatattattaatgatttccatgtctatggattagattgggaagaagattatttattattctcagtagatgaagaagtcactttctttgttgatcttcgtagaagtttctggtctggtaagggtaataatccatataaaaagattcgtcaaccatttgatgaaaaattccatcttttattaaatgttgctgttggtggtaattatttcaatggtattggtgaatttgattatggtcgtgatacaccacaatggactcgtccagaaatgattgttgattatgtccgtgtctatcaattacc

SEQ ID NO: 20032 - DNA, 474 bp, Piromyces finnis
  ConA-like_subgrp
tgctttaactattcctcacaacagtagaattgactccgcattagaaggtaaaaattcattcaccattgaaataaatgttgttccatcaggcgtacaacaattcaatatgttcgctggaaaaggtgatcattcttttggatttagaaccaccacttcttctcttgatttctttattttcgcaggaggagaatggcgtagtctttatcatgatatgggtgttgactcatcttctggttgggttggtaaaaaacatcaagttgcaggtatttatgatgctgaaaataacatgttgagattatatgccgatggtaagatggttcgtgaaactaaaataaatacaaattctggtgtagaacattctagttataatcttatgttaggtgcctgtccagaaactggaagaaattctcaagccaaattttatgaaatgagagtttataataaggccctcaccgcctccgaattagcttcaca

SEQ ID NO: 20033 - DNA, 405 bp, Piromyces finnis
  ConA-like_subgrp
taagccaaagactaccactactactagaagaaccaccactacacaataccaacaatccactccaactaatactggtgacaagtgtaactgggaagaagatttcaagagtcttgatcttaaccgttggaacttaaacagtggtggtgaatgtatcaaggttaaggatggtatgttctacgattccgttagtcaatcttgcccaggttctggtaacggtggtcgtatgagaaccaacgttcgttacaagtctggtaaattcgaagttcgtgctaagatgccaattgctagtggtttagttccagctatttacttcgcttctactccagataacaccaacggtagtcaagatgaattcgatttcgaattaattggtagcaaccgtatgcaaactaacttattcattta

SEQ ID NO: 20034 - DNA, 321 bp, Piromyces finnis
  ConA-like_subgrp
tcaatattggaattacaaatatccatggggttcagatcataacggttctgcacgtatgtatggtagtgcagaagatcataaccatgtatacttaaaagataatactgtagttcttttagctacaagaattaattgggatgaaggtaagagtactgctaatccacatccagctattcattatcactctggtgctattcattcaaaacaaactttcactattaatgatcaattcccaaattacgaaataagaggtgaatttatggccccaactaatggtggtacatggccggccttttggttaaatggtgcctggacctggcc

SEQ ID NO: 20035 - DNA, 432 bp, Piromyces finnis
  ConA-like_subgrp
accagaaattgatattgttgaatttaaaggtaataatgttaattggtttaacacattccgtacttcaagtgatgtttctacatacaaagaatctgttagtaatgctggtgcttggcatgaatatcgtgtttggataacaaaggttgataatactaatatggatattcacttttatattgatggtaaatggaaggctaaacacacagccaatcatgttggtaaaccattccatttaattatgaatttacaaatggaaggttcttctggtggtaatggaccaactagtgacacctactatagaggtagaaatatttatgttggtagaagccatgaatgtactggtaataattgtaatgctaataatgctgctgccactactactaccgtaaaaactactacaacaagcaaagcccaaactgctactagcaatga

SEQ ID NO: 20036 - DNA, 390 bp, Piromyces finnis
  ConA-like_subgrp
tgttaagtatgctagtgctgtatgggaaacagttattagcgattcccttactgattacaacacttttgaaaaatattgggattatttatacccatggggatcagatcacaatggttctgctcgtatgtatggtgctagtgatgaccataatcacgtttacttaaaagataacacaattgttctcaaagcttgtagaattaattgggatgaaggtaagagtactgctaatccacaccctgttattcgttatcactcaggtgcaattcactcaaaacaaacttttactattaatgatgaattcccaaattatgaattcaagggtgaatttattgttccaactaatggtggtacatggccagcattttggttaaacggtgcttggacctggcc

SEQ ID NO: 20037 - DNA, 432 bp, Piromyces finnis; identical to SEQ ID NO: 20035
  ConA-like_subgrp

SEQ ID NO: 20038 - DNA, 606 bp, Neocallimastix californiae
  Concanavalin A-like lectins/glucanases
aggtaatggaaattacagatacgaaatctggcgtgatggtaacggtggtgaattaaccctttacccaaaggatgcttgctttaaggcttcttggaacaacgctggtgattatttaggtcgtgttggtcttgtttgggatcaatatattaattacaagaatcttgatggtgatcttgttgctaagtataactacaagaagagtggtaacgatggaggtacatattcctacgttggtgtctacggttggatggataatccacaaattgaatactatgttgttgatgactggcttcataacagaggtgctccaggtggttcttacatgggttcacaaaagggaactattactgttgatggtggtacatacaaggtttggtctggtactcgtactggtgcttctaagtggggtcaatctaccttcactcaaattttctccgttcgtactgaacaacgtacctgtggtcaaattaacatttctgaacatttcagacaatgggaaaaattaggtcttagaattggttctgttatggaagctcaaattttagctgaatctggtggtggttctggttacgttgattacacttacgctaccgttgaaattgttaa

SEQ ID NO: 20039 - DNA, 540 bp, Neocallimastix californiae
  Concanavalin A-like lectins/glucanases
tgcttgttttaaggcttcctggaacaacgctggtgatttcttaggtcgtgttggtcttgtttgggataacaagccaaattataagaaccttggaggtgatcttattgctaactactcttacaagaagagtggtaacgatggaggtacatattcctacgttggtatctacggttggatggataatccacaaattgaatactatgttgttgatgactggcttcataacagaggtgctccaggtggttcttacatgggttcacaaaagggtaccattaatgttgatggtggtacatacaaggtttggactggtactcgtactggtgcttctaagtggggtcaatctaccttcactcaaattttctctgttcgtactcaacaacgtacttgtggtcaaattaacatttctgaacatttcagacaatgggaaaaattaggtattagagttggtcaacttatggaagctcaaattttagctgaatctggtggtggttctggttacgttgatttcacttacgctactgttgaaattggtagtggatc

SEQ ID NO: 20040 - DNA, 321 bp, Neocallimastix californiae
  Concanavalin A-like lectins/glucanases
atggcgtccaggtgattgggttggtaataagaagcatggtgatttcactattgatggtgctaagtacactgtttatgaaaatacacgttatggtccatctattgatggtgatactactttcaaacaattctttagtattcgtcaacaagctcgtgattgtggtactattgatattactgctcactttgaacaatgggaaaagcttggtatgaaacttggtaagatgcatgaagctaaagttttaggtgaagctggtagtaatggaggtggtacaactggtactgctgatttcccatacgccaaggtttacattgctggaca

SEQ ID NO: 20041 - DNA, 594 bp, Neocallimastix californiae
  Concanavalin A-like lectins/glucanases
tgacaaatgtaattgggaagaagatttcaagagtcttgatcttaatcgttggaatttaaatagtggtggtgagtgcattaaggtaaaggatggtatgttcattgattctgttagtcaatcttgtccaggttctggtaatggtggtcgtatgagaactaatgttcgttacaagtctggtaagttcgaagttcgtgctaagatgccaattgctagtggtttagttccagctatttactttgcctctactccagataacactaacggtaaccaagatgaatttgatttcgaattaattggaagcaaccgtatgcaaactaatttattcatttatggtaatggtggtcgtgaacaagtttggaacccaccaaccgatttatctaaagatttccacctttacacctttgaatggaattcaaattccattgttttaaaggttgataaccaagttattcgtaccttcaataatccaatgccacaacaaccatgttactttattttaactaattggatgtgcgttggttgcgatggttggactggtccagctgattggtctagacaaccttatgacttcattgttgattacgttaagatttc

SEQ ID NO: 20042 - DNA, 636 bp, Neocallimastix californiae
  Concanavalin A-like lectins/glucanases
tgatgactttaattacgacagtaatcatttagatttagtatggcaatggaatcacaatccagataattctgcttggtctgttactgaacgtccaggttggttacgtcttaaaaataaacatgttgcttctgaaatacttaaagctagaaatactcttaccatgcgtacggagggtccagcatgtagcagtgttgttaagttagatgtaactaatttaaaggttggtgattacgctggtctttctgcttttcaatataattacggtaatgttggtgtttatgttgctgataacggtgaaaaacgtatatacatggctagtaacggtaataccaatggagatgtcatcaaggatagtagaaacaatattgttcaagaaacaaaattaaatggtaatgaagtctaccttaaattagatttccgttttagtaatgttgaacgtgatggaagtgcttcatggaatattgataaggtaaacttttattattcttacgatggtagtaaatggactaaaattggtaaggaaattggtatgacctatgatcttaaactcttcaccggttacagaagtggtctttttagttacccaactaaaaatactggtggttatgctgactttgacttctttaaatatgaacg

SEQ ID NO: 20043 - DNA, 630 bp, Neocallimastix californiae
  Concanavalin A-like lectins/glucanases
aacctttgaaaaatattggaattataaatatccatggggttcagatcacaatggttcagctcgtatgtatggtactagtactgatcatacacacgtttatttaaaggaaaatacagttgttctttttgctaaaagaattaactgggatgaaggaaaaagtacttctaacccacatccagcaattcattatcattctggtgcaatccactcaaagcaaactttcacggtaaatgatcaatatccaaactatgaaattaaaggtgaattcatggttccaactaattcaggtacatggccagcgttctggttaaatggtgcaaaaacatggccaccagaaattgatattgttgaatttaagggtagtaacgttaattggtttaatactttccgtacttcaagtgatgtttcaacttacaagaccactattaataataaaggtgcctggcatgaataccgtatttggataactaaagtttcaaatactaacatagatattcacttttacattgatggtgtttggaaagcaaagcatactgctaatcacgttggaaagccattccatttaattatgaatttacaaatggaaggtagttctggtggtaatggtccaagttcaaatacttacttcag

SEQ ID NO: 20044 - DNA, 600 bp, Neocallimastix californiae
  Concanavalin A-like lectins/glucanases
aacaactggcaataaaacaggaagaattggtagtgtagattatgaaatatgggctgatggtggtaacaacagtgccgatttctataaagatggttctttctcctgtgctttcaataatagtaaagattatttatgtcgttctggtgttaatattagacctgctaaatacccatctgaaattggaaaaattaaggctgaatataaggttgttaaacaaaatgctcaaaatgtaggttattcttatgttggtgtttacggttggactttagaatctggtatttctggagtctttgaattttacattgtcgataattggctttctcaatatagaccaggtgattgggttggtaatcaaaagaagggtgacttcactattgatggtgctgtatacactgtatacaaaaatgttaatggtaatcttactcaatacttcagtcttcgtagagaaccacgtacctgtggtactattgatgttactgctcactttgaccaatgggaaaaattaggtttgaaaatgggaaagattagtgaaattaaggttttaggtgaagccggtaatactggtggtggttgtactggtagagtagatttcccatatgc

SEQ ID NO: 20045 - DNA, 636 bp, Neocallimastix californiae
  Concanavalin A-like lectins/glucanases
ggttactagtaacaaggttggctccatcggtggtgttggttatgaattatgggctgatagtggtaacaacagtgctactttctattccgatggttcattctcttgtaccttccaaaatgccaaggattacttatgccgttcaggtctttcctttgatagtactaagactcaccaacaaattggccacatgtatgctgatttcaagttagttaaacaaaacattcgtaatgttgattattcttacattggtatctacggttggaccagaaatccacttgttgaattctacgttgttgataactggcttagtcaatatcgtccaggtgattgggttggtaacaaaaagcatggtgatttcactattgatggtgctagatacactgtttatgaaaatactcgttacggtccatctattgatggtaacactaattttaagcaatacttcagtatccgtcaaactgctcgtgactgtggtactattgatattactgctcacttccaacaatgggaaaaacttggtatgactatgggtaagatgcatgaagctaaagttttaggtgaagctggtagtaacggtgctggtactactggtactgcagatttcccatatgctaaggtttacattggtagccaaca

SEQ ID NO: 20046 - DNA, 403 bp, Neocallimastix californiae
  Concanavalin A-like lectins/glucanases
ggttactagtaacaaagttggttctattaacggtattggttatgaattatgggctgatagtggtaataacagtgctactttctattctgatggttcattctcttgtactttccaaaaggctaaggattacttatgtcgttccggtctttccttcgatagtaccaagactcatgaccaacttggtcatatgtatgctgactttaaattagttaaacaaaacattcaaaatgttgattattcttatgttggtatctacggttggagcaaggatccacttgtcgaattctatgttgttgataactggctcagtcaatggcgtccaggagattgggtaggaaacaagaagcatggtgattacgttattgatggtgctacctacactgtttatgaaaatgaacgttat

SEQ ID NO: 20047 - DNA, 366 bp, Neocallimastix californiae
  Concanavalin A-like lectins/glucanases
tccacttgtcgaattctatgttgttgataactggctcagtcaatggcgtccaggagattgggtaggaaacaagaagcatggtgattacgttattgatggtgctacctacactgtttatgaaaatgaacgttatggtccatccattgttggtgatactaacttcaagcaattcttcagtattcgtaaggaagctcgtgactgtggtactattgatattaccgctcacttcttacaatgggaaaaacttggaatgaaattaggtaagatgtatgaagctaaggttttaggagaagctggtagtaacagttccggtactactggtactgctgatttcccatacgctaaggtatacatcagtaatccagg

SEQ ID NO: 20048 - DNA, 615 bp, Neocallimastix californiae
  Concanavalin A-like lectins/glucanases
aattaacggtattggttatgaattatgggccgatagtggaaacaatagtgctaccttctatgaagatggttctttctcttgttctttcaataatgctaaggattatttatgtcgttccggtctttccttcgacagtactaagactcataaggaaattggtcacatctatgccgactttaaattagttaaacaaaacattcgtaatgttgattattcctatgtcggtatttacggttggaccagaaatccacttgttgaattctacgttgttgataactggctcagtcaatggcgtccaggagattgggttggtaacaagaagcatggtgatttcactattgatggtgctaaatacacagtttatgaaaacacacgttacggtccatccattgatggtgataccaacttcaagcaattcttcagtatccgtcaaactgctcgtgactgtggtaccattgatattacagctcactttgaacaatgggaaaaacttggtatgaaattaggtaagatgcatgaagctaaagttttaggtgaagctggtagtactggttctggtaccactggtaccgctgatttcccatatgccaaggtttacattggtggtaagcaaca

SEQ ID NO: 20049 - DNA, 528 bp, Neocallimastix californiae
  Concanavalin A-like lectins/glucanases
gtacggtgctccagatgaccacaaccatgtttatttagaaaataattcagttgttcttcaggcctgtagaattaattgggatgaaggtaaaagtactgctaatccacacccagtaattcattatcactctggtgcaattcactcaattcaaacttttactattaatgaccaatatccaaattacgaaattagaggtgaattcatagctccaactactggaggtacatggccagccttttggttgaatggtgcatggacttggccaccagaaattgatattcttgaattcaagggtaccactaccaattggtttaatactttccgtacttcaagtgatgtctctacatacaaagaagctattagcaatccaaatacttggcacgaatatcgtctttggattagcaaagtttcagatgttaatatggatattcatttctatattgatggaaaatggagagctaaacacactgcaaatcatgttggaaaaccattccatttaattatgaatttacaaatggaaggaagtgc

SEQ ID NO: 20050 - DNA, 636 bp, Neocallimastix californiae
  Concanavalin A-like lectins/glucanases
aactagtaacaaggttggtgctattggtgatattggttatgaattatggtcagacagtggtgacaacagtgctactttctatgccgatggttcattctcttgttcattcaagaatgctaaggattacttatgtcgttccggtctttccttcgatagtactaagactcacaaagaaattggacacatttatgctgatttcaagttagttaagcaagatattaaggatgttgattattcatacattggtatttatggttggactcgtgaaccacttgttgaatactatgttgttgataactggcttagtcaataccgtccaggtgactgggttggaaacaagaaatatggtgatttcgaaattgatggtgctgaatacactgtttatgaaaacactcgtactggtccatctattgatggtgataatgttactttcaagcaatacttcagtattcgtaaagaagctcgtgattgtggtactattgatattacagctcatttcgaaaaatgggaagaacttgatttagttcttggtaagatgcatgaagctaaggttttaggtgaagctggtagtattcatgatggtactagtggtactgctgatttcccatatgctaatgtttacattaaggatgctcc

SEQ ID NO: 20051 - DNA, 636 bp, Neocallimastix californiae
  Concanavalin A-like lectins/glucanases
aactagtaacaaggttggtgctattggtgatattggttatgaattatggtcagacagtggtgacaacagtgctactttctatgccgatggttcattctcttgttcattcaagaatgctaaggattacttatgtcgttccggtctttccttcgatagtactaaaactcacaaagaaattggacacatttatgctgacttcaaattagttaagcaagatattcaagatgttgattattcatacattggtatttatggttggactcgtgaaccacttgttgaatactatgttgttgataactggcttagtcaataccgtccaggtgactgggttggaaacaagaaatatggtgatttcgaaattgatggtgctgaatacactgtttatgaaaacactcgtactggtccatctattgatggtgataatgttactttcaaacaatacttcagtattcgtaaagaagctcgtgactgtggtactattgatattacagcccattttgaaaaatgggaagaacttgatttagttcttggtaagatgcatgaagctaaggttttaggtgaagctggtagtattcatgatggtactagtggtactgctgatttcccatatgctaaggtttatattaaggatgctcc

SEQ ID NO: 20052 - DNA, 597 bp, Neocallimastix californiae
  Concanavalin A-like lectins/glucanases
ctatgcaaaacttcgttcagatggtaatttgatacaagataaaagtaataatggtcttatcattccaatttcaagtggtgctaaactccaaaaagataataatggtaattatatttcaggtgctttaactattcctcataacagtaagattgattctgcattagaaggtagaaattcatttactattgaagtcaatgttgttcctactggtgttcaacaattcaatatgttagcaggaaaaggtgaccgttcgatcggtttcagaacatcaacgaattctattgatttcttcatttatgcaggaaatgaatggcgtaccgttaactacaatatgggtgtagattctgcttcaggttgggtaggcagaaaacatcaagtagctggtatttatgatgctgaaaataatatgttaagagtttatgccgatggtaggatattaggtgaaagatctgtaggtacaaattcaggtgtagctcattccaattataatctcatgttaggtgcttgtccagatactggaagaaattctcaaggaaacttttatgaaatgagagtatatagtaaggctctcacagcttcagaattagcttctcaaaa

SEQ ID NO: 20053 - DNA, 636 bp, Neocallimastix californiae
  Concanavalin A-like lectins/glucanases
ggttactagtaacaaagttggtaacataaaaggtattggctatgaattatgggccgatagtggtaataacagtgctactttttatgaagatggttctttctcttgttcttttagtagagcaaaggattatttatgtcgtagtggtctctcctttgatagtacaaagactcatgaccaaattggtcatatatatgctgactttaaacttgtcaagcaaaatattcaaaatgtagattattcatacgttggtatttacggttggactagaaacccacttgttgaattctatgttgttgataactggcttagtcaatggcgtccaggtgattgggttggtaacaagaaacatggtgatttcgttattgatggtgctacttatactgtctatgaaaacactcgttatggtccatctattgatggtgatactaatttcaagcaattcttcagtatccgtcaacaagctcgtgactgtggtactattgatattactgctcacttccaacaatgggaaaagcttggtatgaaattaggtaaaatgcatgaagctaaggttttaggtgaagctggtagtaatggtcaaggtactagtggtactgctgatttcccatatgctaaagtttatattggaaatggaaa

SEQ ID NO: 20054 - DNA, 730 bp, Neocallimastix californiae
  Concanavalin A-like lectins/glucanases
atcaatagatgagatgaaacttgttttttcagatgaatttgatggtgatgagttagataaatctgtatgggatgttgaagttaattgttggggaggtggtaatggagaaaaacaatgttatgttgatcatgaggaaaatatatttgttaaagatggtcagttacatattaaggctataccaaaaggtgaatataaattaactgatgaggaaaagaaatcatgcactaataataatgagaattcatgtggatggactcaaagtgttactagtggtcgtattagaacttataagagtggtcatgcttggaagtatggtaaagttagagttaaggctaaattaccagcaggtccatatctttggccagctatatggatgttaccacaagacgatgtttatggtacatgggcagcttcaggagaaattgatatcatggaagctagaggacaagttccggatgctgtaggtcatgccattcattatggaggtcaatggccaaataatgttttttcatctgaaactgcttctgttaaagatgttatcaatgatttccatgtttatggattagattgggaagagaatttcctcatttttagtgttgatgaagtcgaatactttactgttgatcttcgtaaaagcttctattctggaaaaggaagtaatccatacaaggatattcgtcaaccatttgatgaaaaattccatcttttattgaatgttgcagtaggtgga

SEQ ID NO: 20055 - DNA, 612 bp, Neocallimastix californiae
  Concanavalin A-like lectins/glucanases
aggtaatggaaattacagatatgaaatctggcgtgatggtaacggtggtgaattaactttatacccaaaggatgcttgtttcaaggcatcatggaataatgccggtgattacttaggtcgtgttggtcttgtatgggataacaagattaattataagaatgctggtggtgatattattgctaactatgcttataagaagagtggtagtgatggaggtacatactcctacattggtatttacggttggatggataacccacaaattgaatactatgttgttgatgactggttacataacagaggagctccaggaggttcatggatgggtcaacaaaagggtactattaatgttgatggtggtacatacaaggtttggtctggacaacgtactggagcttctaaatggggtcaatctactttcacacaaattttctccgttcgtacttcacaacgtcaatgtggtcaaattaacatttctgaacacttcagacaatgggaaaaattaggtcttagaattggtcaagtcatggaagcccaaattttagctgaagctggtggtggttctggttatgttgatttcacttacgctaccgtagaaattggtagtggtag

SEQ ID NO: 20056 - DNA, 600 bp, Neocallimastix californiae
  Concanavalin A-like lectins/glucanases
aggtaatggaaattacagatatgaaatctggcgtgatggtaatggtggtgaattaactttatacccaaaggatgcttgtttcaaggcttcatggaataatgctggtgattacttaggtcgtgttggtcttgtatgggataacaagattaactacaagaatgctggtggtgatattgttgctaaatatgcttataagaagagtggtagtgatggaggtacatactcctacattggtatttacggttggatggataacccacaaattgaatactatgttgttgatgactggttacataacagaggtgcaccaggaggttcatggatgggtcaacaaaagggtactattaatgttgatggtggtacatacaaggtttggtctggacaacgtactggagcttccaaatggggtcaatctactttcacacaaattttctccgttcgtacttcacaacgtcaatgtggtcaaattaacatttctgaacacttcagacaatgggaaaaattgggtcttagaattggtcaagtcatggaagcccaaattttagctgaagctggtggtggttctggttatgttgatttcacctacgctaccgttgaaat

SEQ ID NO: 20057 - DNA, 636 bp, Neocallimastix californiae
  Concanavalin A-like lectins/glucanases
agttaccagtaacaaggtaggccaaatcaatggtattggatatgaattatgggcagacagtggcaataacagtgctactttctattctgatggttcattctcatgttctttccaaaacgcaaaggattatttatgtcgtagtggtctttcctttgatagcaccaaaactcatcaacaacttggacatatgtatgctgacttcaaacttgttaaacaaggtatttctaatgtagattattcttatgttggtatttatggatggacaagaagtccacttgttgaattctatgttgtagataactggcttagtcaatggcgtccaggagattgggtaggaaacaaaaagtatggcgattacaccattgatggtgctaaatatactgtttatgaaaatagtcgttacggtccatccattgatggtgatactaatttcaagcagttcttcagtattcgtcaacaagctcgtgattgtggtacaattgatattactgctcacttcgaacaatgggaaaaactcggtatgaaaatgggcaaaatgcatgaagcaaaggttttaggagaagctggtagtactggttcaggtactagtggtactgcagatttcccatatgcaaaggtatacattggtaaaaatgg

SEQ ID NO: 20058 - DNA, 636 bp, Neocallimastix californiae
  Concanavalin A-like lectins/glucanases
aactagtaacaaggttggtgctattggtgatataggttatgaattatggtcagatagtggtgataacagtgctactttctattctgatggttcattctcttgttcattcaagaatgctaaagattatttatgtcgttccggtctttccttcgacagtactaagactcacaaagaaattggtcacatatatgctgatttcaagttagttaaacaagatattcaagatgttgattattcatacattggtatttatggttggactcgtgaaccacttgttgaatattatgttgttgataactggcttagtcaataccgtccaggtgattgggttggaaataagaaatatggagatttcgaaattgatggtgctgaatatactgtttatgaaaatactcgtactggaccatctattgatggagataatgttactttcaaacaatacttcagtattcgtaaagaagctcgtgactgtggtactattgatattaccgctcactttaaaaaatgggaagaacttggtttaacccttggtaaaatgcatgaagctaaagtattaggagaagctggtagtattcatgatggtactagtggtacagctgatttcccatatgctaaagtttatattaaggatgctcc

SEQ ID NO: 20059 - DNA, 636 bp, Neocallimastix californiae
  Concanavalin A-like lectins/glucanases
aacttcaaataaagtcggtactattggtgatataggttatgaattatggtcagatagtggtgataacagtgctactttctattctgatggttcattctcttgttcattcaagaatgctaaagattatttatgtcgttcaggtctttccttcgacagtactaagactcacaaagaaattggtcacatttatgctgactttaagttagttaaacaagatattaaagatgttgattattcatacattggtatttatggttggactcgtaaaccacttgttgaatactatgttgttgataactggcttagtcaataccgtccaggtgattgggttggaaataagaaatttggagatttcgaaattgatggtgctgaatatactgtttatgaaaacactcgtactggaccatctattgatggagataatgttactttcaaacaatacttcagtattcgtaaagaagctcgtgactgtggtactattgatattaccgctcactttgaaaagtgggaagaacttggtttaacccttggtaaaatgcatgaagctaaagtattaggagaagctggtagtatccatgatggtactagtggtacagctgatttcccatatgctaaagtttacattaaagatgcacc

SEQ ID NO: 20060 - DNA, 636 bp, Neocallimastix californiae
  Concanavalin A-like lectins/glucanases
aacttcaaataaagtcggtactattggtgatataggttatgaattatggtcagatagtggtgataacagtgctactttctattctgatggttcattctcttgttcattcaagaatgctaaagattatttatgtcgttcaggtctttccttcgacagtactaagactcacaaagaaattggtcacatttatgctgactttaagttagttaaacaagatattaaggatgttgattattcatacattggtatttatggttggactcgtgaaccacttgttgaatattatgttgttgataactggcttagtcaataccgtccaggtgattgggttggaaataagaaatatggagatttcgaaattgatggtgctgaatatactgtttatgaaaatactcgtactggaccatctattgatggagataatgttactttcaaacaatacttcagtattcgtaaagaagctcgtgactgtggtactattgatattaccgcccactttgaaaagtgggaagaacttggtttaacccttggtaaaatgcatgaagctaaagtattaggagaagctggtagtattcatgatggtactagtggtacagctgatttcccatatgctaaagtttacattaaagatgcccc

SEQ ID NO: 20061 - DNA, 639 bp, Neocallimastix californiae
  Concanavalin A-like lectins/glucanases
tgatgatttcgactacagttccaataggttatccttagaatggcaatggaatcataatcctgataatactgcttggtctgtaaccgatcgtccaggttggttaagacttaagaataagtatattgctccagaacttcttaaggcaagaaatactcttaccatgcgtacagaaggtcctgcctgtagtggtgttgtaaaacttgatacttctaatatgaaggttggtgattatgctggtctttctgctttccaatataactatggtaatgttggtgtttatgttgctgataatggtgaaagacgtatttacatggcaagtaatggcggttataatggtaatgctgatgttaccaacagtagaaataatattgttcaagaagtcaaattaaatggtaaagagatttatctaaagaccgattttcgtttcagtactgttaagagcgatggtagtgcttcaaataatatcgataaagttaatttctattactcccttgatggtaatcaatggaataagattggtaaagaaattggaatgacttatgatcttaagcttttcacaggttacagaaatgctcttttcagttatccaacaaagaatactggaggttatgctgatttcgattactttgaatatcaacg

SEQ ID NO: 20062 - DNA, 675 bp, Neocallimastix californiae
  Concanavalin A-like lectins/glucanases
tactaaagcttattgggaaactattctttcggattctcttactgattatcaaacttttgaaaaatattgggattacttatatccatggggttcagatcacaatggttcagctcgtatgtatggtgcttctgatgatcacaatcatgtatatttagaaaacaacactgttgttcttaaagcttctagaattaattgggatgaaggaaaaagtacagctaatccacacccagtaattcattatcactctggtgctattcactcaaaacaaacttttacaattaatgatcaatatccaaattatgaaattagaggggaatttcaagccccaactaatggaggtacatggcctgctttctggttaaatggtgcttggacttggccaccagaaattgatattcttgaattcaaaggtactactaccaactggtttaatactttccgtacttcaagtgatgtttctacatataaagaagctataagtaatccaagtggttggcatgaatatcgtctttggattaccaaggtttcaaatactgatatggatattcatttctatattgataataaatggaaggctaaacacactgcaaaccatgttggaaaaccattccatttaattatgaatttacaaatggaaggtagtgctagtggtagtgctccaaatggtgatacata

SEQ ID NO: 20063 - DNA, 582 bp, Neocallimastix californiae
  Concanavalin A-like lectins/glucanases
ctctggttaccattatgaaatctggtaccaaggtggtaacaattcaatgacctattacgataatggtactttcaaggccagctggggtggaacaaatgatttccttgctcgtgttggtcttaagtataatgaagataagactcaccaacaacttggtcaaatcgatgcttactttaagtggactaaatctggtagtgctggtggttataactatattggtatctatggttggactgtcgatccattagtagaatactatattgtagatgactggtacaataaaccaggttcttaccttggacaaaagaagggtgaattcactgttgatggtgatacttacgaaattttccaaaatactcgtgttaaccaaccatctattaagggtacttcaaccttcccacaattcttcagtgttcgtcgtagtgctcgttcttgtggtcatattgatattagtgctcacttcaagaagtgggaatccctcggtatgaaattaggtaagatgtacgaagccaaggttctcgttgaagctggtggtggttctggttcatttgatgttacctacttcaagatgactgatggttc

SEQ ID NO: 20064 - DNA, 537 bp, Neocallimastix californiae
  Concanavalin A-like lectins/glucanases
ggaagaagatttcaagagtcttgatcttaaccgttggaacttaaatagtggtggtgaatgtattaaggtacaaaatggtatgttcatcgattctgtaagtcaatcttgtcctggttctggtaatggtggtcgtatgagaaccaatgttcgttacaaatctggtaaatttgaagttcgtgctaagatgcctattgctagtggtttagtaccagctatttattttgcttccacccctgataacaccaacggtgatcaagatgaatttgatttcgaattaattggtagtaaccgtatgcaaacaaacttattcattcatggtaatggtggtcgtgaacaaatttggaacccaccaaccgatttatcgaaggacttccacctctacacctttgaatggagctctaatgccattgtcttgaaggtggataatgaagttattcgtaccttcaataatccaatgccagaccaaccaagttacttcattttaacgaattggatgtgtattggatgtgatggttggactggtcctgcagattggtc

SEQ ID NO: 20065 - DNA, 636 bp, Neocallimastix californiae
  Concanavalin A-like lectins/glucanases
gattactaataataatgttggtcaaattggagatgtaggttatgaattatggtctgatagtggttataatagtgctactttctattctgatggttcattctcatgttcattcagtaatgctaaagattacttatgtcgttcaggtctttcattcgatagtactcaaactcatgatcaaattggtcatatgtatgctgacttcaaacttgttaaacaaaatattagaaatgttgattattcttatattggtgtttacggttggagtagagatccacttgttgaatattacgttgtagataattggcttagtcaatatcgtccaggagattgggttggtaataagaaacatggtgatttcactattgatggtgctaaatacactgtttatgaaaatactcgttatggtccatctattgatggtgatactcaatttaaacaatatttcagtattcgtcaacaagcacgtgattgtggtaccattgatattacagctcatttccaacaatgggaaaaacttggtatgaaacttggtaaaatgcatgaagctaaagttttaggagaagcaggtagtaatggatcaggtactagtggtacagccgatttcccatatgctaaagtctatattggtagtggagg

SEQ ID NO: 20066 - DNA, 573 bp, Neocallimastix californiae
  Concanavalin A-like lectins/glucanases
agaaacaagtaataaagttggtcaaattggagatgtaggttatgaattatggtctgatagtggttacaatagtgctactttctattctgatggttcattctcatgttcattcaataatgccaaggattacttatgtcgttcaggtctttcatttgatagtactaagactcatgatcaaattggtcatatgtatgctgatttcaaacttgttaaacaaaacattagaaatgttgattattcctatgttggtgtttacggttggactagaaatccacttgttgaatattatattgtagataactggcttagtcaatatcgtccaggagattgggttggtaataagaaacatggtgatttcactattgatggtgctcaatatactgtttatgaaaatactcgttatggtccatctattgatggtgatactcaatttaaacaatatttcagtattcgtcaacaagcacgtgattgtggtaccattgatattacagctcatttccaacaatgggaaaaacttggtatgaaacttggtaaaatgcatgaagctaaagtattaggagaagcaggtagtaa

SEQ ID NO: 20067 - DNA, 597 bp, Neocallimastix californiae
  Concanavalin A-like lectins/glucanases
ttatgttgctcaaatgcgttctgatggagctgttgttcaagataagagtagtaatggtcttattattccaatttccaatggtgctaaacttggtcataataatgatggtaattacatttctggtgctttaactattccacataatagtaaacttgattctgctcttcaaggtagaaattcatttactattgaagttaatgttgttccaactggtgttcaatccttcaatatgttagccggtaagggtgattactctttaggtttcagaactactactggtgctcttgatttctttgtttatgccggtaatgaatggcgtatggttagttacactatgggtgttgatgctaattctggttggattggtaagaaacatcaagttgccggtattttcgatgctggtagtaatatgttaagattatatgttgatggtaagatggttgctgaaaagtctgttggtactacagctggtgtcagttcttccaactataatcttatgttaggtgcttgtccagatactggtagaaattcacaaggtaacttctatgaaatgagagtttatagtaaagctctttctgcttctgaattatcttctca

SEQ ID NO: 20068 - DNA, 600 bp, Neocallimastix californiae
  Concanavalin A-like lectins/glucanases
attaggaaaaattggttccgttgattatgaagtatgggctgatggtggtaacaacagtgctgttttctatagtgatggttctttctcatgttccttctcaaatactaaagattatttatgtcgtactggtgtttctttctcacaagctaaatatccatctgaaattggtcatattaaggcagaatataaagttgtaaaacaaaatgctcaaaatgtaggttattcttacgttggtgtttacggatggactttaaattctggtatttcaggtgtatttgaattttatattgttgataactggctttctccaggaagaccaggtgattgggttggtaatgaaaagaagggtgatttcactattgatggtggtaaatacactgtctacaaaaatgttaatggtaatcttacacaatacttcagtcttcgtacaagtccacgtacttgtggtactattgatgttactgctcactttgaacaatgggaaaaaattggtttaaagatgggtaagattactgaagttaaagttttaggtgaagccggtaatgttggtggtggttgtagtggtactgttgatttcccatatgctaagatttatattaa

SEQ ID NO: 20069 - DNA, 528 bp, Neocallimastix californiae
  Concanavalin A-like lectins/glucanases
gttaagattaaaaaataaatatgttgtaagtgaacttcttagagctagaaatactttaactatgcgtactgaaggtccagcatgtactagtattgttaaaatggatacttctaaaatgaaagttggtgattatgctggtctttctgccttccaatttaaatatggtaatgttggtgtttatgttgctgataatggtgaaaaacgtgtttatatggcaactaatggtggtaatgaaattaataatagtagaaattatattgaacaagaaactcgtatgtctggtaatgaaatttatcttaaattagaattccgtttcaataatgttggaaatgatggtagtgcctcaaacaatattgatagagttaatttctattattcttatgatggtgataaatggaccaagattggtaaggaacttggtatgacctatgatcttactcttttcactggttatcgtagtgctctttacagttacccaactaaatctactggtggttatgttgattttgattatattaaatatacacg

SEQ ID NO: 20070 - DNA, 147 bp, Neocallimastix californiae
  Concanavalin A-like lectins/glucanases
tgaatatagtaataaggttggtaatattggaaatgttggttatgaattatgggctgatagtggtaataatagtgctactttctattctgatggttcattttcttgtacattccaaaatgccaaagattatttatgtcgttccggtct

SEQ ID NO: 20071 - DNA, 582 bp, Anaeromyces robustus; identical to SEQ ID NO: 20063
  Concanavalin A-like lectins/glucanases

SEQ ID NO: 20072 - DNA, 636 bp, Anaeromyces robustus
  Concanavalin A-like lectins/glucanases
agttactagtaataaagttggtagtattggaggtataggttatgaattatgggctgatagtggtagtaacagtgctactttctattctgatggttccttctcttgttctttcagtcgtgccaaggattacttatgtcgttctggtctttcctttgatagtactaaaactcatcaacaaattggtcacatttacgctgacttcaaacttgtaaaacaaaatattcaatctgtagattattcttatgttggtatttatggttggactagaaatccacttgttgaattctatgttgtcgataattggcttagtcaataccgtccaggtgattgggtaggtaataagaaacatggtgatttcactattgatggtgctaaatatactgtatatgaaaatactcgttatggtccatctattgatggtgatactcaatttaaacaattctttagtattcgtcaacaagctcgtgattgtggtactattgatattactgctcactttgaacaatgggaaaaacttggtatgaaattaggtaaaatgcatgaagctaaagttttaggtgaagctggtagtaatggtggtggtacaagtggtactgctgatttcccatatgctaaggtttacattggtcaaggtaa

SEQ ID NO: 20073 - DNA, 600 bp, Anaeromyces robustus; identical to SEQ ID NO: 20068
  Concanavalin A-like lectins/glucanases

SEQ ID NO: 20074 - DNA, 630 bp, Anaeromyces robustus
  Concanavalin A-like lectins/glucanases
tgatgatttcaattatagtagtaatgatgaattagatttagtttggcaatggaatcataatccagataattctgcttggtctgttactgaacgtgaaggttggttaagattaaaaaataaatatgttgtaagtgaacttcttagagctagaaatactttaactatgcgtactgaaggtccagcatgtactagtattgttaaaatggatacttctaaaatgaaagttggtgattatgctggtctttctgccttccaatttaaatatggtaatgttggtgtttatgttgctgataatggtgaaaaacgtgtttatatggcaactaatggtggtaatgaaattaataatagtagaaattatattgaacaagaaactcgtatgtctggtaatgaaatttatcttaaattagaattccgtttcaataatgttggaaatgatggtagtgcctcaaacaatattgatagagttaatttctattattcttatgatggtgataaatggaccaagattggtaaggaacttggtatgacctatgatcttactcttttcactggttatcgtagtgctctttacagttacccaactaaatctactggtggttatgttgattttgattatattaaatatacacg

SEQ ID NO: 20075 - DNA, 633 bp, Anaeromyces robustus
  Concanavalin A-like lectins/glucanases
tgttaccagtaacaaggttggtaagattggtgacattggttatgaattatgggctgatagtggtaataatagtgctactttctatgctgatggttcattctcttgttccttcagacaagctaaggattacttatgtcgttctggtctctccttcgacagtactcaaactcaccaacaaattggtcacatgtacgctgacttcaaacttgttaaacaaaacattcaatctgtagattactcatacgttggtatttacggttggactagaaacccacttgttgaattctacgttgttgataactggctcagtcaatggcgtccaggagattgggttggtaacaaaaagcatggtgatttcactattgatggtgctaaatatactgtttatgaaaacactcgttacggtccatctattgatggtgacactaacttcaagcaatacttcagtattcgtcaacaaccacgtgactgtggtacaattgatattactgctcacttccaacaatgggaaaaacttggtatgaccatgggtaaaatgcatgaagctaaagttttaggtgaagccggtagtactggtggtggtacaagtggtactgctgatttcccatacgctaaggtttacattaagggagc

SEQ ID NO: 20076 - DNA, 615 bp, Anaeromyces robustus
  Concanavalin A-like lectins/glucanases
ttcaccaagtccagttggtgataaatgtaattggactgaagatttcaacagtcttgatgaaactcgttggaatttaaatagtggtgctgaatgtatgaaggttcaaggtggtatgttcattgattcagttagtcaatcctgcagaggatcaggtaatggtggtcgtatgagaactaatgttcgttacaagtctggtaagtttgaagttcgtgctaagatgccaattgctagtggtttagtaccagctatttactttgcttcaactccagataatactaatggtagtcaagatgaatgggatttcgaattaattggtagtaaccgtatgcaaactaatttattcattaatggtcaaggtggtcgtgaagaagtttggaatccaccttatgatttatctagagatttccatacttatacttttgaatggacttctaattctatcgttttaaaggttgataatcaagtcgttcgtaccttcaataatccaatgccaactcaaccaagttacttcattttaactaattggatgtgtgttggttgtgatggatggactggtccagctgattggtctagacaaccatacgatttcattgttgactatgttaaaattactga

SEQ ID NO: 20077 - DNA, 633 bp, Anaeromyces robustus
  Concanavalin A-like lectins/glucanases
taacagtaacagggttggtagtattggtggtgttggttatgaattatggtctgacagtggtagcaacagtgctactttctattctgatggttctttttcttgttctttcagaagtgctaaagattatttatgtcgttctggtctttctttcgacagtactaaaactcaccaacaaatcggtcatatatacgctgatttcaaacttgttaaacaaaatattcaaaatgttgattactcttatgtaggtatttacggttggactagaaacccacttgttgaattctacgttgttgataattggcttagtcaatatcgtccaggtgattgggttggtaataaaaaacatggtgatttcactattgatggtgctaaatatactgtttatgaaaatactcgttatggtccatctattgatggtaatacaaacttcaaacaatactttagtattcgtcaacaagctcgtgattgtggtactattgatattactgcccactttgaacaatgggaaaaacttggtatgactatgggtaaaatgcatgaagctaaagttttaggtgaagctggtagtaatggtggtggtacaagtggtactgctgatttcccatatgctaaggtttacattggtaatcaaca

SEQ ID NO: 20078 - DNA, 633 bp, Anaeromyces robustus
  Concanavalin A-like lectins/glucanases
ttgtaacagtaataaagttggtagtattggtagtgttggttatgaattatggtctgacagtggtaataacagtgctactttctattctgatggttctttctcttgttctttcagaagtgctaaggattatttatgtcgttctggtctttctttcgacagtactaaaactcaccaacaaatcggtcatatatacgctgatttcaaacttgttaaacaaaatattcaaaatgttgattactcttatgtaggtatttacggttggactagaaacccacttgttgaattctacgttgttgataattggcttagtcaatatcgtccaggtgattgggttggtaataaaaaacatggtgaatttactattgatggtgctaaatatactgtttatgaaaatactcgttatggtccatctattgatggtgatacaagtttcaaacaatactttagtattcgtcaacaagctcgtgattgtggtactattgatattactgcccactttgaacaatgggaaaaacttggtatgactatgggtaaaatgcatgaagctaaagttttaggtgaagctggtagtaatggtggtggtacaagtggtactgctgatttcccatatgctaaggtttatattggtaacaa

SEQ ID NO: 20079 - DNA, 666 bp, Anaeromyces robustus
  Concanavalin A-like lectins/glucanases
tgctgaatgggaaactgttattagtgattctctttcagattatcaaacttttgaaaagtattggaattacttatacccatggggttcagatcacaatggttctgctcgtatgtatggtgctccagatgatcacaaccatgtttacttaaaagataacactgtagttattttagctacaagaattaattgggatgaaggtaaaagtacagctaatccacatccagaaattcattatcactctggtgctattcactcaaaagaaacttttactattaatgatcaatttccaaattatgaaattagaggtgaattcatggttccaactacaagaggtacctggccagctttctggttaaatggtgcttggacatggccaccagaaattgatattgttgaatttaagggagataatgtgaattggtttaatactttccgtacttcaagtgatgtttctacctacaaacaaggtattagtaacccaggtgcttggcatgaataccgtgtttggattaccaaggtttccaacacggatatggatattcatttctatattgatggtcaatggaaagctaaacatactgctaatcatgttggtaaaccattccatttaattatgaatttacaaatggaaggtagttctggtaataatggtccaacttctaacac

SEQ ID NO: 20080 - DNA, 184 bp, Anaeromyces robustus
  Concanavalin A-like lectins/glucanases
atcaattccaagtatggatgattataaattagtattttcagatgaatttgaaggaaataaattagatagatctgtatgggatgttgaagttaattgttggggaggtggtaacggtgaaaaacaatgttatgttgatcatgatgaaaatatttttgtaaagaatggtcaacttcatattaaagct

SEQ ID NO: 20081 - DNA, 834 bp, Anaeromyces robustus
  Concanavalin A-like lectins/glucanases
atctgttgatgaaatgaaacttgttttttcagatgaatttgaaggaaatgaattagacagatctgtatgggatgttgaagttaattgttggggaggtggtaacggtgaaaaacaatgttatgttgatcatgatgaaaatatttttgtaaagaatggtcaacttcatattaaagctgttccaaaaggtcaatataaattaactgatcaagaaatgaaaacatgtactaataataatgaaaactcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtacctgatgctgtaggtcatgcaatacattttggtggtcaatggccagataatgactttatgtctgaaacagcttctattaaaaatgttattaatgatttccatgtttatggtttagattgggaagaaaacttccttatctttactgttgacgagaaaccatattataccgttgatcttcgtaagagtttttggtctggtaagggaactaatccatataaaaagattcgtcaaccatttgatgaaaaattccatcttttattaaatgttgctgttggtggtaattatttcaatggtattggtgaatttgattatggtcgtgatacaccacaatggactcgtccagaaatgattattgattatgttcgtgtctatcaattaccacg

SEQ ID NO: 20082 - DNA, 843 bp, Anaeromyces robustus
  Concanavalin A-like lectins/glucanases
atcaattccaagtatggatgattataaattagtattttcagatgaatttgaaggaaataaattagatagatctgtatgggatgttgaagttaattgttggggaggtggtaacggtgaaaaacaatgttatgttgatcatgatgaaaatatttttgtaaagaatggtcaacttcatattaaagctgttccaaaaggtcaatataaattaactgatcaagaaatgaaaacatgtactaataataatgaagattcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtatcaaatgctattggaaatgctattcattttggtggtcaatggccaaataatgattttgtagataaaacatacaacctttctaatattattaatgatttccatgtctatggattagattgggaagaagattatttattattctcagtagatgaagaagtcactttctttgttgatcttcgtagaagtttctggtctggtaagggtaataatccatataaaaagattcgtcaaccatttgatgaaaaattccatcttttattaaatgttgctgttggtggtaattatttcaatggtattggtgaatttgattatggtcgtgatacaccacaatggactcgtccagaaatgattgttgattatgtccgtgtctatcaattaccacg

SEQ ID NO: 20083 - DNA, 630 bp, Anaeromyces robustus
  Concanavalin A-like lectins/glucanases
agaaacaggtaataaagtaggtagtattggaggagtaggttatgaattatggtttgaaggtggtaataatagtgctactttctattctgatggttcattttcttgttctttccaaggttctaaggattatttatgtcgtacaggtctttcatttaatagtgataaaacttaccaacaaatcggtcatatgtttgccgattttaaacttgttaaacaaggtatttcaaatgtagattattcttatgttggtatttatggttggacaagaaatccacttgttgaattttatattgtagataattggctcagtccaagtcgtccaggggattgggttggtaatagaaaacatggtgatttcactattgatggtgctaaatatactgtttatgaaaatactcgtaatggtccttctattgatggtaatactaatttcaaacaatatttcagtattcgtcaacaagctcgtgattgtggtactattgatattaatgctcactttgaacaatgggaaaaattaggtatgcaaatgggtaaaatgcatgaagctaaaattttaggtgaagctggtagtaatggtggtggtacatctggtactgctgatttcccatatgctaaggtatatattggtca

SEQ ID NO: 20084 - DNA, 636 bp, Anaeromyces robustus
  Concanavalin A-like lectins/glucanases
aacaagtaataaagtaggtaatattggtggtgtaggttatgaattatgggcagatagtggtaataatagtgctactttctattctgatggttcattctcttgtactttccaaaatgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggatctggtactagtggtactgccgatttcccatatgctaaagtttacattggtaacaagagtaa

SEQ ID NO: 20085 - DNA, 633 bp, Anaeromyces robustus
  Concanavalin A-like lectins/glucanases
aacaagtaataaagtaggtaatattggtggtgtaggttatgaattatgggcagatagtggtaataatagtgctactttctattctgatggttcattctcttgtactttccaaaatgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggagctggtactagtggtactgccgatttcccatatgctaaggtttacattggtaaaggtaa

SEQ ID NO: 20086 - DNA, 603 bp, Anaeromyces robustus
  Concanavalin A-like lectins/glucanases
tgtaggttatgaattatgggcagatagtggtaataatagtgctactttctattctgatggttcattctcttgtactttccagagtgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggagctggtactagtggtactgccgatttcccatatgctaaggtttacattggtaaaggtaa

SEQ ID NO: 20087 - DNA, 600 bp, Piromyces finnis
  Concanavalin A-like lectins/glucanases
tctttctgctaaaatacgttctgatggtgctgtcatacaagataaaagtagtaatggacttacaattccaatatcaggaggagctaaattaggtcatagtaatgatggtaattatatctctggtgctttaactattcctcacaacagtagaattgactccgcattagaaggtaaaaattcattcaccattgaaataaatgttgttccatcaggcgtacaacaattcaatatgttcgctggaaaaggtgatcattcttttggatttagaaccaccacttcttctcttgatttctttattttcgcaggaggagaatggcgtagtctttatcatgatatgggtgttgactcatcttctggttgggttggtaaaaaacatcaagttgcaggtatttatgatgctgaaaataacatgttgagattatatgccgatggtaagatggttcgtgaaactaaaataaatacaaattctggtgtagaacattctagttataatcttatgttaggtgcctgtccagaaactggaagaaattctcaagccaaattttatgaaatgagagtttataataaggccctcaccgcctccgaattagcttcacaaaa

SEQ ID NO: 20088 - DNA, 369 bp, Piromyces finnis
  Concanavalin A-like lectins/glucanases
tggtgacaagtgtaactgggaagaagatttcaagagtcttgatcttaaccgttggaacttaaacagtggtggtgaatgtatcaaggttaaggatggtatgttctacgattccgttagtcaatcttgcccaggttctggtaacggtggtcgtatgagaaccaacgttcgttacaagtctggtaaattcgaagttcgtgctaagatgccaattgctagtggtttagttccagctatttacttcgcttctactccagataacaccaacggtagtcaagatgaattcgatttcgaattaattggtagcaaccgtatgcaaactaacttattcatttacggtaatggtggtcgtgaacaagtttggaacccacc

SEQ ID NO: 20089 - DNA, 624 bp, Piromyces finnis
  Concanavalin A-like lectins/glucanases
ccatcaatattggaattacaaatatccatggggttcagatcataacggttctgcacgtatgtatggtagtgcagaagatcataaccatgtatacttaaaagataatactgtagttcttttagctacaagaattaattgggatgaaggtaagagtactgctaatccacatccagctattcattatcactctggtgctattcattcaaaacaaactttcactattaatgatcaattcccaaattacgaaataagaggtgaatttatggccccaactaatggtggtacatggccggccttttggttaaatggtgcctggacctggccaccagaaattgatattgttgaatttaaaggtaataatgttaattggtttaacacattccgtacttcaagtgatgtttctacatacaaagaatctgttagtaatgctggtgcttggcatgaatatcgtgtttggataacaaaggttgataatactaatatggatattcacttttatattgatggtaaatggaaggctaaacacacagccaatcatgttggtaaaccattccatttaattatgaatttacaaatggaaggttcttctggtggtaatggaccaactagtgacacctactatag

SEQ ID NO: 20090 - DNA, 672 bp, Piromyces finnis
  Concanavalin A-like lectins/glucanases
tgctgtatgggaaacagttattagcgattcccttactgattacaacacttttgaaaaatattgggattatttatacccatggggatcagatcacaatggttctgctcgtatgtatggtgctagtgatgaccataatcacgtttacttaaaagataacacaattgttctcaaagcttgtagaattaattgggatgaaggtaagagtactgctaatccacaccctgttattcgttatcactcaggtgcaattcactcaaaacaaacttttactattaatgatgaattcccaaattatgaattcaagggtgaatttattgttccaactaatggtggtacatggccagcattttggttaaacggtgcttggacctggccaccagaaattgatattgttgaatttaaaggtaataatgttaattggtttaacacattccgtacttcaagtgatgtttctacatacaaagaatctgttagtaatgctggtgcttggcatgaatatcgtgtttggataacaaaggttgataatactaatatggatattcacttttatattgatggtaaatggaaggctaaacacacagccaatcatgttggtaaaccattccatttaattatgaatttacaaatggaaggttcttctggtggtaatggaccaactagtgacacctacta

SEQ ID NO: 20091 - DNA, 189 bp, Piromyces finnis
  Concanavalin A-like lectins/glucanases
tattcgtaaggaagctcgtgactgtggtactattgatattacagctcacttccaacaatgggaaaagcttggtatgaagcttggtaagatgcatgaagctaaggttttaggagaagctggtagtaatggatcaggtactactggtacagctgatttcccatacgccaaggtattcattggttctggtaa

SEQ ID NO: 20092 - DNA, 636 bp, Piromyces finnis
  Concanavalin A-like lectins/glucanases
atatagtaataaggtcggttccattagtggtattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgattgtggtactattgatattacagctcacttccaacaatgggctaaacttggtatgaatcttggtaagatgcatgaagctaaggttttaggtgaagctggtagtactggttctggtactagtggtactgctgatttcccatatgctaaggtttacattggtgatggtaattc

SEQ ID NO: 20093 - DNA, 633 bp, Piromyces finnis
  Concanavalin A-like lectins/glucanases
tagtaacaaggttggttccattggtggtattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgactgtggtactattgatattactgctcacttccaacaatgggaaaagcttggtatgaagcttggtaagatgcatgaagctaaggttttaggtgaagctggtagtactggttctggtactagtggtactgctgatttcccatatgctaaggtttacattggtgatggtaattc

SEQ ID NO: 20094 - DNA, 639 bp, Piromyces finnis
  Concanavalin A-like lectins/glucanases
agttacctcaaataaggtaggttcaattggaggaattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgactgtggtactattgatattactgctcacttccaacaatgggaaaagcttggtatgaagcttggtaagatgcatgaagctaaggttttaggtgaagctggtagtactggttctggtactagtggtactgctgatttcccatatgctaaggtttacattggtgatggtaattc

SEQ ID NO: 20095 - DNA, 528 bp, Piromyces finnis
  Concanavalin A-like lectins/glucanases
ctcaaatgctaaggattatttatgtcgtactggtctttcattcgatagtactaagacccacgatcaacttggtcacatgtacgctgatttcaagcttgttaagcaaaacattagaaatgttgattactcttacgttggtatttacggttggaccagaaacccacttgttgaattctacgttgttgataactggctcagtcaatggcgtccaggtgattgggttggtaacaagaagcatggtgatttcactattgatggtgctcaatacactgtttacgaaaacactcgttacggtccatctattgatggtgatactcaattcaaacaatacttcagtattcgtcaacaagctcgtgattgtggtactattgatattacagctcacttccaacaatgggaaaagcttggtatgaagcttggtaagatgcatgaagctaaggttttaggtgaagctggtagtactggttctggtactagtggtactgctgatttcccatatgctaaggtttacattggtgatggtaattc

SEQ ID NO: 20096 - DNA, 858 bp, Anaeromyces robustus
  Condensation
agaattcccagtaactactcaacaattaggtgtttatgttgatactattaaaaacccagatgctatagtatataatacaccattaatatttaaattaactaaaaatattgatattaataaaattaaagaagcttttaataaattatttaaaaatcaagaaatattaagaagtaaatattatgaaaaggaaattaatggaaaaacggaaatttatggatttattgatgatgagtgtttattacttttcgaagaatatacatatgaaaatgctaaaacatttgttcgaccatttgaattatccaaagcaccattaataagagttggttttattaaaaatgaaatattattaattgatatgcatcatattatttccgatggatccactatgcttataattaagaaggaattaaataattattataataataatgaaataaaagaattggaaattcaatttagtgattatgctattgatttaaatgaaaataaaaataatgaatattacaataaacaaattgaattttataaagaaatgttttcatgtgaatatgaaaaattaaatattccaataagaaataacaatttactttcacctgaagaaagaaataaaaatgacatgaaatgtaatatttgtgtcaatattatagatgaatttacgagtgaaaaaattaatgaatatgttaaaaataataaaattagtaaaacagcgtttttccttagtatatatggatatattttatcaaaatacagtagacaagatataatctatagttcagttatgagtactaatcgtaataataattatattcaagacatgattggaatgtttgttagtacacaaccaatattacttaaata

SEQ ID NO: 20097 - DNA, 855 bp, Anaeromyces robustus
  Condensation
taaagaattcccaataacttcacaacaattgggtgtttatattgactcaattaaaaatccagatagtattatgtataatattccaagtgtatttaaattgaaaaaagatattgatattaataaaattaaaatggcattaaataaaatatttaaatgtcaagaaatcttaagaagcaaatattatgaaaaggaagttaatggaaagacagaaatatttggatatattgatgatgaatgcttattattatttgaagaatatacttatgaaaatgcaaaatcatttattagaccatttaaattatcagaagctccattaataagaattggttttattaaaaatgaaatattgttaattgatatgcatcatatcatttctgatggttcttcaatgttaattattaaaaatgaattaaatagttatttctataataatgaaataattcaagaattagaaatccaatttagtgattatagtatatatatgaatgaaaagaaatcggaagaatattacgataaagaaatagaattttataaaaaaatgttttcatgtgaatatgaactattaagtattcctatgaaaggtaagatattagatgaaaataaaactattgaaagtagtagcaagaactgctataaaagtattgataaatctactacgagtttaataaatgaatatattaaaaagcatggaataagtaaagcagcattcttcattactatatatggatatgtcttatccaaatatagtggacaaaatatagtttatagttcaatagttaatgccaatagaaataatcattatacagaaaatatgattggtatgtttgttagtacccaaccaattttattgaaata

SEQ ID NO: 20098 - DNA, 216 bp, Anaeromyces robustus
  Condensation
aaaaattattgatagttcattgagtaaaagaatcaatgaatacatcagggtcaacagaattagtaagacagcattctttattagtatctatggatatatattgagtaaatatagtggacaagacaatatatatacttcaatgatgagtgccaatagaaataatcattatgtagaaaatatgattggtatgtttgtaagtactcagccaattctttt

SEQ ID NO: 20099 - DNA, 861 bp, Neocallimastix californiae
  CotH
tgtttcctctcaatattataagagacaagctttcaacattaagattggtaaaaaacaacttctttatggtagaaaacaattccgtattcgttctgatgctagagaaccaacaatgattcgttctaaacttttctgtgatgtaatgggacgtttaggtcttaaaaatgctatgtctgccaattatattaaattaagtattaatggtgaagatttaggtttttatgtaatcatggattcattaaagttatcttatgttgaaattgaatatggtgatgttaatagtactaatttattacaatgtaaggatttaaatgcctttttaacttcctcctctggtaccacatgtttatctgaaaatgaagataatccagatactagtgctttcaaacaattcttatctcaacttgacagcgctaattctgttagtcaaatggctcaatactttgactatgaaaactttttgagagttacaattttagaatggcttactggttcatgggatcattacactctctttggtcacaactacaacgtttataagattccaaatggtaaatgggaagtatctctttacgattttgatgctacctggggtcaagatcttggtcttggtttaatgcttggtggtccaagaagtattagtgctaataatgttagtacatggccaaatgctaaatatgaagaatggatccaaactcaaaaacaacatccacttagtgttataatgcaagataaaaatcttttccttaagaatcttcaggacattcttgacactgcttttaatccagctattttatacgaaagaattgacgaacttaaggaatttattactccatatgttagagaaactaagtctaaagg

SEQ ID NO: 20100 - DNA, 837 bp, Neocallimastix californiae
  CotH
tcgtattaagggggcttccactagaaattctcaaatgaagagtttcaatgtctatgctcgtaaaagctatggtgaatctaagttcaagtatgccatagtagaggataataaatccgttattgatgataaattaattaaaaaatatgattccttcagtattcgccactgtaattggttcgatagaatgagagaatctatcgttcaacgtggtcttaaggaatctcctgttcttgctactcttgacaattctaaatgtctcctcttccttgatggtgaattctggggtttatatgatattgctgaaaaatcttcagatctttatattgaaaataactacggaattccaaaagaaaatgttgctcttattaagaattatgaattggaagaaggtaccgaagatgatcttaaagatttcactaatcttgtaaagtattgtgaaaagaatgatcttactgatgaagctaactacaactacgttgctgatcaccttgacttagaaagtataatatatagttatgccactggtctctatcttggtagttgggattggccaaacagaaattatcttgtctaccgtaataagggcgaacccatcgaaggtaatgaatatggtgatggtaaatggagatttggatcctttgatttcgattattctgctggtattacctatgatgactttggaggtgttccaggttatgctcatgattccttcactaagtttcaaagttcaaagaattattacccaacatcaatgttcagtaatttaattaaaaatccaaaattctataaaagatttgctgaagtaatgcacctgatggaagatgaaatctttagttt

SEQ ID NO: 20101 - DNA, 861 bp, Neocallimastix californiae
  CotH
tcgtattaagggggcttccactagaaattctcaaatgaagagtttcaatgtctatgctcgtaaaagctatggtgaatctaagttcaagtatgccatagtagaggataataaatccgttattgatgataaattaattaaaaaatatgattccttcagtattcgccactgtaattggttcgatagaatgagagaatctatcgttcaacgtggtcttaaggaatctcctgttcttgctactcttgacaattctaaatgtctcctcttccttgatggtgaattctggggtttatatgatattgctgaaaaatcttcagatctttatattgaaaataactacggaattccaaaagaaaatgttgctcttattaagaattatgaattggaagaaggtaccgaagatgatcttaaagatttcactaatcttgtaaagtattgtgaaaagaatgatcttactgatgaagctaactacaactacgttgctgatcaccttgacttagaaagtataatatatagttatgccactggtctctatcttggtagttgggattggccaaacagaaattatcttgtctaccgtaataagggcgaacccatcgaaggtaatgaatatggtgatggtaaatggagatttggatcctttgatttcgattattctgctggtattacctatgatgactttggaggtgttccaggttatgctcatgattccttcactaagtttcaaagttcaaagaattattacccaacatcaatgttcagtaatttaattaaaaatccaaaattctataaaagatttgctgaagtaatgcacctgatggaagatgaaatctttagttttgaaaaaatggaaaaaattgtaga

SEQ ID NO: 20102 - DNA, 867 bp, Neocallimastix californiae
  CotH
taactcaggtcgtggttacggtaaattaggttacaatgttaagattcgtaatgataaggatgatttattcggtgctcgtcaattcagacttcgtggtgaagctcgtgatccatctgttattcgtaacaagattggtagtgatatttacaataaaatgggtattccaacttctttcgctggtttcgttcgtctctacgttaacaacgaattcttcggtttatattctattcatgattctatcaagcaaaaatggattgaaagagaattcggtgaagccgatacaaaacatttatacaaatgtggtttagttaaccaattcctttcttacataccagaattagataactgtgaaaatgatgatgattctgtcaccgatagaactgaatggactgacttattaaaggctattgatgccgctcaaactcgtgaagatttagaaaaattcttagatgttgatttattcattaagaatatggtcgctgaatggctcgtcggttcttgggatcgtttcaacttagtcggtcacaactactacatgtataaaaaccctcaaactggtaagtggatgttcattccttacgactacgattctgatcttggtagtgatatgtacggtggtctcttctacaataagaaacttttcgcttacgtttacgactggcctttcttcacctatgatgattatgctgctcatcgtcacattactgatgttttagttcgtgctgataactctaccttcaataaatacgctatggaatatgttcgtgatgtcttcaacccagttgttcttttcgatcacatcgatgaagttaagaatttaattaatgctgatgttcttgccgataagactgaagacccagttaccgg

SEQ ID NO: 20103 - DNA, 360 bp, Neocallimastix californiae
  CotH
caacttagtcggtcacaactactacatgtataaaaaccctcaaactggtaagtggatgttcattccttacgactacgattctgatcttggtagtgatatgtacggtggtctcttctacaataagaaacttttcgcttacgtttacgactggcctttcttcacctatgatgattatgctgctcatcgtcacattactgatgttttagttcgtgctgataactctaccttcaataaatacgctatggaatatgttcgtgatgtcttcaacccagttgttcttttcgatcacatcgatgaagttaagaatttaattaatgctgatgttcttgccgataagactgaagacccagttaccggttt

SEQ ID NO: 20104 - DNA, 1029 bp, Neocallimastix californiae
  CotH
tcgtattaagggtgcttccaccagaaattcaaatatgaaaagtttcaatatttatgctcgtaaagagtacggaaaatccaaatttaaatacgaagttattgaagataacaaatctgtaattgatggaaaacctattacaaaatacgattccttcagtcttcgtcattctaattggttagatagaatgagagaatcggtggttcagcgtggtctaaaggatttcccaattctcgccactcttgataattctaaatgtttggtcttccttgatggtgaattctggggattatatgatcttattgaaaaaccttctgatttttacataaaaagtaattatgatattccaactgaaaatgttgctttgattaagaatgatattttagaagaaggtactgaagaagatcttaacgaccttaccagtcttgttgaattctgtgcaaagaatgatcttagggatgaagccaattataattatgttgccgagaaggtcgatgtagaaagtttaatttatagttatgcttccggtctttaccttggtatttgggattggcccaatagaaattatcttgtttacagaaataagggtgaaccaatagaaggaaatgactatggtgatggtaaatggaaatatggtgcctttgattttgattactctgctggaattacctttgcttcctttggtggtgttcctggttatgctcatgattcctttaaaaaattccaaagtgccaaggacattttccctaccccaatattcgatggtatgattaaaaatccaaaattctataagagatttggggaagtaatgcatcttatggaagaagaaatctttaatcctgaaaaaatgaagaaaattgtcgaggaacaaaagagtaagtatttggattacatagttaagaatgattggagatggcataatggtactccaaaaaaatcttgggaagccttcagagaagcacaaaataaatattattcagatggttgggatgttattactgaattctttgaacgtcgtcctcaatatgttta

SEQ ID NO: 20105 - DNA, 948 bp, Neocallimastix californiae
  CotH
aaaatcaaccgctactttttcaaaaccaggttacaatattaaaattaaaggaacaaatagtacattacatggcactaagaatttccgtttaagaagtgatcaacgtgatgtttctatgatgcgttcaaaaattaccacagatatattacaaaaaagtggtttgatcgctactgaagttggttacactgaactttatgtcaataatgaatatatgggattctgggttgtttctgattctgtcaaaaataaatggattaaaagaaagtttggtgatgatgggaaagaaattaaaactttatatgaatgtaatggggatgtcattagatttgatgacggctctgctaaaacaaaatgtgtcaatgctaatgaagattacattgattatatggaaccatttattaattttgttgaccaagttaatgcttctactacaagagaagaattagaagaaattatggacgttgataattttattaaatatatggcatgggaatggttaatgggttcctttgatcatttcttaagttattatggacataatttatattggtatcaacaacctaatggaaaatgggtatacattccttatgatcatgatattgaattaggtcaagatgaatatattggtttttatcctaatagaacttttaatcatcatggtgatatcgattttgcaaatctttcatttaaagattttgaattagatcatcctattattcaagttttagttcatgatgatgataccaccttccgtgaattacttggagatattatcagtaaagtttttaatccagatactttacttattcatattaataaaataagagatattattgctccttatgttaaaaaggatagagatactggtgctggaaaaataaataaattgggtaaagattctagattcaattatgaacatttccttttaaatacagaatatacttatgt

SEQ ID NO: 20106 - DNA, 855 bp, Neocallimastix californiae
  CotH
tagttcttctcgtacctattctagacaagctttcaatcttaagattcgtggtaaaaatgatttatatggtcgtaagcaatttagaattcgttcagatgctcgtgaagctacttacttaagatctaaattagcatgtgatatgcacaatcgtttaggtattccttctattgctgctaactacatttccttatacgttaatgaagaatactggggattctacgttcttatggattctccaaaaccatcttgggctgaacttgaatatggtgataaggatactactcatatttacaaatgtaagtctggtggtattaacttacaatatagtaacagtgctacccaatgtgaaaatgaaaatgaagatgttactgaccattctgattggactagtttcttatctaccttagatagaactaactctataagagaagccgaaagtttctttgatgttgatcaattcttatacgaaatggcttacgaatatttatctggttcatgggatcacttccttaacactggtcataactttgctatgtataagatgccacaaagctatggtggtaagtggactatgattgaatacgattttgatgctgatttcggtcaagatgtatgtgctattgagtttgctggtagtattaagaatgacaaggattatccatcatggtcatttgatgattggtctactaaaaagaatcatgttcttgacacctttattaagaaggatcgtactcgtttcaaccaaataatgaaaagatttgttgaagaagctttcaatccagatcttcttttcccacgtattgatgaattaaaggactttattagatcctatgtcaaaaaagataagactccagg

SEQ ID NO: 20107 - DNA, 387 bp, Neocallimastix californiae
  CotH
taaagttcgtggtaactggacatcaaattatgttaagaagtcacttaaaattaatttttcagaatctcaaagtatgcttggtcttaatggaggtaagaagtttaaaagttggatccttcttgctgaatacaaggatggatctatgcttagaaataagtcaacttttgctatttctcgtgaaattcttggaaaagatggtctttacgcttccgattcaagacttgttgaattgaagattaatgatgaatactttggtgtttatcttttatgtgaagttcaacaaattaacaaaggtagagttgatattacaaaggttgatgatgattatcaaggtacagatatgggttacttacttgaatatgatgctggatatgctatgtacgaaga

SEQ ID NO: 20108 - DNA, 615 bp, Neocallimastix californiae
  CotH
caagaaaactttgaagttcaataataactattctcaagttgttgaagcctccggtttgagcacaagacaagctattgaaaatgttattgatgctaattccttagctgatatgtttattattagtgaaattgcttgtgatgctgatctttactactccagtttctatttggatgttgattttggagctgatggtagtaagaaacttagattcgaagctccatgggatttcgattctggtcttggaaataaggatcgttgtgccgatggtaaaggtcattttgctgctaatattattccagataatggtggtttcggtaataccattaatgcttggttagctgttattatctatgaagattggttccaagatattattagaaataagtggaccaaggcttatgaaagtggtatcttcaaaaatgttgctaactcaattcgttcagaatcaagcagttatgctgaagcttttgatcgtaactacgctaaatggaataatatcattgaaaacagtcaatttgccaatgaactttctccaggtgctaaaaaatgtaagacccaaaaggaagctgctaattaccttgctgattggttagaaaaaagagttgctttcattaa

SEQ ID NO: 20109 - DNA, 1020 bp, Neocallimastix californiae
  CotH
tggtggtagatcaactaaattctttgctaaattaggttacaatattaatattaagaatggtcttttatatggtgctaaggatttacgtttacgtccagtagttgttgatccttccttcttaagagataagcttgcttatgatttacataataagattgaattaccatgtattagtgctaactatgctagactttacattaatgatacctttatgggtttatatcttttaagagatgcttacaaggctcaatgggtagaaaatacttttggtgaaaaatcaactaagcatttatatacttgtagtaatgattacaaggataagggtaatgatttctttaagtgtgttaatgatgatgaagatattacagatgatgaagatatgaaaatctttttaaagaaattagaaaactcaaaggatcgtaaggatttagaagaattctttgatgtcaagagtttcatcagattacaagctgctagatatttatttggttcctttgatcatgtcactggtgaaaataataatatgctttatatgtatcatgatgtctcctccggtagagatttatggattccacttatttacgatttcgatatgaactttggtaacttcagaaaaccaagtaccaaccgtacatttgatgaagaaattttcgaaaaaaagaacccattatatactatgcttaatcttaataataatagtgaagaattaatctctattatggatgaaattatgcgtacttccttcaatccaaatattcttcttccacgtattgatcaacttagaactttcattgaaccttacgttaaggaagatcgtactccaggtgaaaatggtcttttcccaggtagatttaatattggtgttggtagagctcatgattcctttacctatgaagatttccttactaacactgaattcaccactataaaggctcgtagatacataaacgactttaccgataaatatgaagaagatacctgtttaggtcttaagcaatgggttattgaacgtttcaagtt

SEQ ID NO: 20110 - DNA, 855 bp, Neocallimastix californiae
  CotH
tagttcatctcgttcttacgctagacaagcttttaatcttaaaattcgtggtaagaatgatttatatggtcgtaaacaattcagaattcgttctgatgctcgtgaagccacttacttaagatcaaaattagcttgtgatatacacaatcgtttgggtattccatctattgctgcaaattacatttctttatatgttaataatgaatattggggtttctacgttcttatggatgccccaaaaccaacttgggctgaaattgaatacggagataaggatacgactcacatttacaagtgtaaagctggaggtattaacttacaatctagtactagcgctactcaatgtgaaaatgaaaatgaagatgttactgatcattctgattggacaaatttcttatcctccttagatagagctaactccatgagagaagctgaaagcttctttgatgttgatcaatttttatatgaaatggcttatgaatacttaactggttcatgggatcatttccttaatactggtcacaattttgctatgtataagatgccacaaaactatggtggtaaatggactatgattgaatacgattatgatgctgattttggtcaagatgtttgtgccattgaattcgctggttccattaaaagtgacaaggactatccatcatggtctttcgatgactggtcaactaaaaaaagtcatgttcttgatatctgtattaagaatgatcgtagtcgttttaatcaaattatgaagaaattcgttgaggaagctttcaatccagaaattcttttcccacgtattgatgaattaaaggacttcatcagaccctatgttcaaaaggataagactccagg

SEQ ID NO: 20111 - DNA, 1029 bp, Neocallimastix californiae
  CotH
tcgtattaagggtgcttccactagaaactctcatatgaagagtttcaacatttatgcccgtaaggaatacggtaaaggaaagtttagctatcctctcattgaaaacaatgttaatgttgttgatggtacacctattgaaaagtatgattccttcagtattcgttctaatggttggtttgatagaatgagagaagctgttgtttctcgtggtgttaaagatattccaattgttgcttcctttgatactaccaagtgtgttttattccttgatggtgaattctggggtacctacgaaattgttgaaaagccatccgattactacttcaagactaattatggcattccatcagaaaatcttgctcttcttaaggatggtaagttagaagaaggtactgaacaagatttacaagaattcaatagtcttgtcgatttcagtaagaataatgatcttagaaatgaaaacaactacaactacattgccagtaagattgatatcgaatccttacttcatcattatgccgttaacctctaccttggtacttgggattggccaaacaaaaattaccttatgtacagaaacaagggctccccaattaacggtaatccttacagtgatggtaaatggagatatggtgtcttcgattttgattacactaccggtcttacttatgctgactttggcggtgtaccaggatacgcttatgattccttcaaaaagtatgaaactatgaatcatatgtatccagctccaatcttcacttccttaattaagaacccaaaggtctacaacagattctctgaaattatgcacactatgggagatgaagtcttcaatcctaataagatgagaaaaattattgaagaacaaaagagtaagtacttagattacattgttaagactgactggagatggttcagtggtactccaactatgagttttgaaactttcagaaatggtcaaaatcaatacttctctggtggttggaatgatatgattgaattcttcaacaaccgtccacaatacatcta

SEQ ID NO: 20112 - DNA, 1011 bp, Neocallimastix californiae
  CotH
tatgtatgcacgtcaaaatgataaagttagctttaatataaaattagaaaaaaagtttttaggacgtaaaaatattagactcagaccagatgctaatgataaaagtcaccttcgttctaaactttgttgtgatattgctaatagaatgggagtcccatctattcaagccgtttatgctagactatatatgaatgatgaatattggggcttatatgttttaatggatgctattaaaccatcatggattaaacaaacttttaatccaagtgaaaaagaaatcactactttatttcaatgtaaaaatggtggtatgaatttaaaacaaaattctgccaataaatgtgtcaatgctaatgatgattatcaagaaatgtctgttttacaaaattttgttaaagaaattaatcaatgtaaaactgctgatgaagttgaaaatattatggatgttgatatatttttaaaatttatggctatggaatggttaattggttcatttgatcatttcttagtttatggtcataatttctacttttataagagagaaacagatggaaaatggctcattatagaacatgactatgataacacttttggtactggcgttaaagcttctttatgggctagtaagggtccaaatcaagatggtagtagtaacaacgacaacaacaataataacagatctcaagaaggaggtccacaagctggtggcccccaagccggaagagggggtaattttggtaactttggtaattttggtaattttggtaactttggtaactttggtggtaataacagttatagaggaaataatccaattgaatatacttttgctgattgggaaatgaatattccaattattaatgttttagttcataaaaacaaagagaaatttactagtatcgtacgtgaagttttagtttctgccttcaacccaactttattagataatcatattagtgaattaaaggaatttcttactccatatgttgaagaagatagtactccaggtaa

SEQ ID NO: 20113 - DNA, 999 bp, Neocallimastix californiae
  CotH
tagttcttctcgtgctttgtctaaacaaggttttaacatcaaaattcgtggaaataataatttatatggtcgtactcaaataagacttcgtcctgatttccgtgaaccaacattattaagaactaaattagcttgtgatattcaaaatcgtatgggtgttccatcaatttcagctaattttgctaaattatatattaatgaccagttcatgggattttatgttttgattgatgctttcaaactttcatgggttgaatcggtttacggtgaaaaagattctacttcgttaattcaatgtaaatatatggataataatttaacctataagtattctattggtggatgttccaatgaaaatgaagatgttactgataacactgaatgggctaatttattaactgcttttgataatgctcaaactccagaagatcttgaagatttcttcgatattgatctcttcttaaagaatatagcctatgaattcttagctggatcatgggatcatttccttagctatggacacaatttctatctctttaaaccaaaagatggtaaatggcaattcttattgtatgattttgatactgaatttggtattgattgctctcaaggtattggtgagccaggtacaataactactgactttaacttttctgaatatacacttgatcagtggcacaaaccacgtcacttgattgacgttttaattggtcaaaattctacacgatttgataatattcttagacaacaagttaaggaagtcttcaatcctgaagttgttttcccacatatagatgaattaaaaaaatttattaaaccttacattattgaggattatactccagatgaaaatggtaaatatccaggtagaattaatgaaagagcttcgaatccatacaatcttactcactgggatgctaatattgaattcactacggttaaaagtgcctatcataatgctgcttatggtcttaagatgtggtttcttagaagatatag

SEQ ID NO: 20114 - DNA, 1008 bp, Neocallimastix californiae
  CotH
taaatatactaaaagtttcgaaaaattgggttataatattaaagttaagaagggagaattattcgaaagaaaacaacttcgtttacgttcagaatctgtagatccttctttccttagagaaaaaatagcttatgatatttgtaatttggtggaattaccttctctctcctctaatttcgctgatgtctactttaatgataggtatatgggattatttgcaatgagagatgctttcaaatctcaatggattgaatatacctatggtgaaaaatccactaaacatttatatacttgtgatattacctatggtagtaatgaatttttcaattgtattaatgatgatgaaaaactcgtagattcggataccgaattcaaaaaattccaagatcgtttagcaaaggctaaaacaagagaagatttggaagaattctttgacgttgaaactttcatgaaatggcaggtcataaaatatttatttggttcctgggatcatgaaactaatgctcataatcaatgcctctatatgttccatgataccacttctggtaatgataagtggattcctctactttatgatttcgatagtgaatttggcgcttatatggattctaatcctcgtagaaccttcagtaaggaaatctttgatagtactaatccacttttcactattcttaacctaaaggatgataataaggaactcattggctatatcgatgaatttatgagaaaggccttcaatccaaagaaattaattcctcgtattgatcaattaaagcaattcattgattcttatgttaagaaagatcgtacacccgatgcggaaggtaatcttccaggtagagttaaaagagtgaacatcaaaatagaagattactttacctatgaagatttcttaaataattccgaatttactgatattaaactcagaaaatatagtagtgatacttcctatcgtgaggatcgtattgttggtttaaaacgttggatgattgaaagatttaaatttat

SEQ ID NO: 20115 - DNA, 771 bp, Neocallimastix californiae
  CotH
tactactttctattcaaaattgagttatgatgtaactattaatgatggtaatcttgaaggaaacaattatattcaattccgtgctgaaaatggggatccctctctcttaagagaaaaagtagtctatgatatattgaatgcagcccaaattccatcacttagtgctaattttgttcaactttacttcaacgatcactatatgggtttatacaccatgagagacttcttaaactcagattggcttgaaaactacttcggtgctaagaattcaaagaatttattcttttgtgatccagactataccagctgtaagaatgctttacaatcttccagtgataatgtcaaacgtttccaagaaaagataaataatgctactaccagagaagaattagaaaaattctttgatgttgaaacatacatgaaatggcaagctttaaagtatttattaggttataccgttatctactcgaatgttaaaaatgactacctctacatgcattcctacaacaacaaggaaatgtgggttccaatccccgttcaatttgattatttccttggtggtagtggtgatgccaagaaaacctttaataaggatattaaatctaaaaataatcttttcaaggttcttgacatctctgaatctaatcctgaaattatcaaatatatggaagaatttatgaagaccgtcttcaatccagtcattttaattcctcatattgatgaactcaaggaaagtattgatgatgctgttaagttggatcgtactccaga

SEQ ID NO: 20116 - DNA, 501 bp, Neocallimastix californiae
  CotH
actctacaaatttttattgaaaatgactaaagctaaatcagcagcggatgttgaatccatttttgatattgaacaattttataaagaaattgccattgaacttataacgtcttcatgggatcaattctacagtggtcataattattatatttataaaaatcctaaaaataataaatggacatatttaattcatgatttcgatcttactttgggtaccggagatatatattataaaaggtttattagtgaagattttatatattttatggaaaatgaaatattaaatatgttaatatctagtaatatggatcgttttattgaaataataaaagaaattgtaactaatgtttttaatcctgccacattattcccacgaattgatgaaataaaatcatttattagaccttatcttcaattagataaaactcccaatgaggatggccaataccctggtagaattaataataatgataatactttttacactatggaagaatggga

SEQ ID NO: 20117 - DNA, 939 bp, Neocallimastix californiae
  CotH
taaaggtagtcgtaactttgttaagccaaattacaatattaagctttccaaaggaaagttatttgacttaaaattacttcgtcttcgttctaatattcgtgatgccactttaatgcgtgaaaagctttctagtgatttactttataagatgggaattaaggcaacttctacaaactatgctaaggttgaagttaatggagaataccttggtctctatattcttactaataaggttaagaaagattttatgaagaaatatttcaatgatgaagaacttactactctttatgaatgtaaagatgatcgtatcagatttgaagataatactgttgctgaaaagtgtattaatgtaaatgaagatcttgttgattataaggatgaaattaaaagcttaaatgatgctgtcaataatgctaaaactattgatgatattaaagatattatcgatgttgatgctgttttaagatcatttgcttttgaattcgttactatttcttgggatcatttcttccttcaaggtcacaatttcttctggtataagaaaccagaagatggtaaatggatgataattcttaatgatttcgatgaaacctttgctcaagatatttatccaaattactacacggatgaaagtagatatgtcgaaaagaattacattccagatatagaaactattaatttaccaaatctctctgttcgtgatatggatactggtcataagcttgttaaattacttatcttagatgatgatactcgctggcgtgaaattcttggtgaagtcgttaagactgctttcaacccagatgttctttatccacgtattgatgaaattgctgatttaattcatgatgaaattgctgtttctcgtggtattgttgaagaaactggcaaggctcatggttgtttcaacattcttggtcaagatccaggatggaacat

SEQ ID NO: 20118 - DNA, 1065 bp, Neocallimastix californiae
  CotH
taaatttactcgtaacttcgctaagccaggttacaaccttaagattgaaaatggtgatctttttgaagttaaatcacttcgtttacgttcaggctatcgtgataattcattgatgcgtgaaaagctttcatctgatatgttctataaaatgggggttccaactacttctactaattatattagagttgaggtaaacggtgaaaatcttggtctttacattgctactaacaaaattaagaaggatttcattaagagatactacggtgaaaagaatactaataatctttatgaatgtagaattgaccgtactagattcgaagattttagtgttgctgaaaagtgtgataatattaaggaagaacttgttgataaaagagatgatattagaaaattcaatgaagctatcaacaatgcaaaatctattgatgatatcaaggatatcattgatgttgaaacctttttaaaaactatttgcttcgaattccttactttagcctgggatcacttcttagtctataatcacaactatttttggtataagaagcctgatggtaagtggaccattattcttaatgattttgatgaaacttgggctcaagatctttggactactatctaccgtggtgaaggtctttccgaagaacaaacttatgttgataagtcctatataccagatgctgatggtcttccatgggctaacttccctaacttttctattcgtgattgtgatatgggtcataagatcattaagttacttatttatgataacgaagaacaatggcgtgaaattgttggtgaagttgttaaaaattatttcaatccaactattctcttcaagcgtattgaagaaattaaagaattaatttatgatgatgttgttattaatcgtaccattaatccagaaactggtaaattcattggttgctttaatactgaaggttttgatccaaagtggaatatgactcactttgaagaaggtattaactatgttaactgggccaataatccagatcaagctcgtagttatggtttaaagttctttattgaagaacgtttcaagtacat

SEQ ID NO: 20119 - DNA, 933 bp, Neocallimastix californiae
  CotH
ttcttcctctcgtatctatggtagacaaggtttcaatcttaaaattcgtggaaacaaagatttatatggtagatctcaatttagaattcgttcagatgctcgtgaagctacctatttaagatcaaaattatcttgtgatattcataatcgtttaggacttacttctatatctgcaaattatattaccttatatattaatgaagaatatttaggtatgtatattttaatggatgctccaaagttaccatggattgaacaagtatatggtgaagcggatacccctaacttatacaaatgtaaagatggttccaattatttatcagtaatgagttctgctgaattatgctataacgaaaatgaagatgttactgatagaagtgaatgggttgaattcttaactgctttagataatgctcaatccgctgaagatattgaagatatttttgaagttgatcaatttttatatgaaattgcattagaatatttaactggttcttgggatcattttttaagtactggtcataatttcagtatgtataaacaaaaatctaatggtaaatggaccatcatttattatgattttgatgctgatttcggacaagatgttgataacattgaattcggtttaactgaaactgatccaaataaagatttcccaaattattcctttggtgaatgggactctaaacgtcaacgtattattgaaattttaattttcaaagatccaactcgtttcttaaatattcttagaaaaattgttactgaagtatttaatccagctactctttttgctcatattgatgaattaaaagaattcattaagcctcatgttattaaagataaaactgctgatgaaattataaatcgtccaggtgttctcaacaaaaaaggttctgattattctatagaacaatgggatgccaacagtgaatt

SEQ ID NO: 20120 - DNA, 1014 bp, Neocallimastix californiae
  CotH
aaaatatactaaagcattcgaaaaattaggttttaatataaaaattaaaaaaggtgtttttttagaaagaaaaaatcttcgtttacgtacggaagctgttgatccttcattccttagagaaaaattagcttatgatttatgtaatattattggtctaccaacactttcacttaattatgcgcgtgtattctttaatgacaaatatatgggtttatatgccttgagagatgcttttaaatcacaatggattgaatatacttttggagaaaaaaatactaagcatttatatacttgcgatagagaatataaaactaaagaaactgaagatctttataattgtattaatgatgatgaaaatataaaggatgatccagattggaaacactttattgatcgtttaaagtctgttaaaaataaagctgatcttgaagaattctttgatgtggagacttatattaaatggcaagttattaaatatttatttggttcatgggatcatgaaactagtgctcataatcaagtggtctatatgtatcatgatacttcaaatgaaaaagataaatggattcctatgctttatgattttgatagtgactttggtgcctatagagttcctaaacctcgtagatctttttcacaagaaacaaaagaagcctcaagtccattttataaattacttcaattaaatgatgaaaatgaggtacttatttcatatattgatgaattcatgaggaaagcatttaacccaaaggatttaattcctcgtattgatcaattaaaagaatttctttctccatacattaaagaagatcgtacaccagatgaaaatggacgattaccaggtagacaggaaagagttaatattaagattgaagattactttacctttgatgatttcaatgataacagtgaatttactaccattagacttaataaatatactagtgatacaacttatggtactgataatattatgggattaaaacaatggattattgaaagattccaatttgc

SEQ ID NO: 20121 - DNA, 987 bp, Neocallimastix californiae
  CotH
taaatatactaaaatatttgaaaaacaacaatataacattaaaattaataatggtgatttatttggtagacaacaacttagattacgttctgaagtagttgatcctagtttccttcgttcgaaaattggttatgatttatgtaatattcttggtttaccttctcttcaagcttcctatactttagtttatattaatgatgacaatatgggattatatttacttcgtgatgcctacaagccacaatgggttgaagctaactatggtattgccaataccacatctctttataaatgcgataaaagttatggatcaagtgactatttcaattgtcaaaatgatgaaactgaagttgtggacgaagattttactaatttcataaataaaatggaaaaggccaaagatactagagaattatctaaattctttgataccgatttatatattaaatggcaagcttttaaatatttaacaggttcatgggatcatatcacaaattatcataatcaatatcttttcaataataatggaaaatggataaatttattgtatgattttgatagtgattttggagcttacagagcaccaaatccatccctttcattcgttagtgaatctgttgaaatggattatccactttataaaactcttggtttaagtaatacacataaagaacttgtaaataatataaaaaaatttgtgattaatggctttaatccagttaaacttttcccacgtattgatgaacttatgaaatatttatatccatatattctagaagacagaacaccagaaaaagaaactactgaacgtccaggccattttgtacgtccagattacaaaattgaaaatggttttactgttactgatcatgttaaaaatgctgaattccataactatgtattgaagaaatattctaataataaatcatatagtactgatgaaatttatggtcttaaacgttggattattgaaagattcagatatgc

SEQ ID NO: 20122 - DNA, 1059 bp, Neocallimastix californiae
  CotH
taaaattactcgtaactttgctaagccaggttacaatatcaaaattaatgatggtaacatctttgatgttaaattacttcgtttacgttccggtattcgtgatgtttcttttatgcgtgaaaagatctgctctgatattgtttacaaaatgggattattatctacttctactaattacgttaatgtagaagttaacggtgaaaatcttggtatattcattcttaccaataaaattaagaaagattttattaagagacattttggtgaaaagagtactaataatctttatgaatgtaaaaaggatttctctagatttgaagataatagtattgttaccaattgtgaaaatgctaaggaagaacttattaatgataaggatgatcttcaaaaattcgttgatgccgtcaacaatgctaagagtgttgatgaccttagacaatttttagatgttgataccttcataagaactcttgcctttgaatttgttaccttatcttgggatcatttcatgggtcttagtcacaactacttctggtataagagaactgatggtatttggactattattcttaatgactttgacgaaactttaggtgctgatgtctggccaagtattttccaaggtgatggtgactatgttaagaagtacgttgataagtcatacattattgatgatgttaccatcattaacttcccaaattgttctgttcatgattgtgaaatgggacacaagattgtcaagttagttattcacgataatgaagaacaatggcgtgaagttatcggtgatgttgttaagaatgtttacaacccaacattcattaacaagcgtattgatgaaattaaagaattaattcaagatgatcttgctgttagtcgtgctattgatgaaactaccggtgtttctttaggttgtttcaattctgctggattctatccaaaatggaacatgactcaatttgaaactggtgttaacaatgtaggttggcaagccaatactggtcaatctcgttgttacggtttaaaatatttcattgaaaagcgtttcgactatctctg

SEQ ID NO: 20123 - DNA, 987 bp, Neocallimastix californiae
  CotH
tatgtatgctcgttctaacagtaaagttggttttaatatgaagtttgaacagaagattttcggtagaaaaagtttaagattaagaccagatccaaatgataagagttatatgcgtgaaaagctttctagtgatatattaaacagagctggattaccatcagtacaagctggctatgctagactttacattaatagtgaattctttggtttatatacccttcttgattctgttaaaccagctatgataaagaaggtatttagacttgaagaagaaactgatgatatgattctttatcaatgtaaatatgatggtatggacttctccattggaagtgaatcacattgtattgatgccgttaatgaagataatactgatttgagtgaattaaaagatttaattcagaaggttaattctgctactactattgctcaatttgaagaatttttagatgttgatttattcttgaagaatgttattgttgaatggcttattggttcttttgatcacttcttaattttaggtcataactttaatttatataagagaccaactgataacaaatggtgtattgttatctatgatttcgataatacttttggatataacttaaatgcaggttcgtttaacattcgtggtagaaatggaggatggggttttaatcaaaatatcgattatactaccttaagtttcaaagatttcaattctaaagttaatcacaaaatcttccaatatttaatttatcaagatgataccaagtttaaagctcttctcaaggatgtattagtttatgctttcaacccacaacttttaaagcaacatatgaatgaattaaaaactttcttaactccttatgttaatgaagatttaacaccagtaggaggtcaacttccaggtagagttaatagaaagggttataattctaaagcaaacgtcaacgacttccaaagaaataatgaagttgaaagttatattcaaagaagatatga

SEQ ID NO: 20124 - DNA, 972 bp, Neocallimastix californiae
  CotH
aaataattctaaaaagtatcaaaaattaggttataatattaaaattaagaaaggtgaattatatggtagaaaacaacttcgtttacgtgcctttgtcattgatccttccttcattagagataaattaggtaatgatattgttaatgccttgggattaccttctctttcttcaaatttcgctcatttatatattaatggccgttttatgggattgtactccataaaagatgcctacaaagcacattggattgaagccaatttcggtgaaaaatcaacagaacatttatatacttgtgattacggcaaaaatccttatttcaattgtgtgaatgatgatgacaaaattaccgatgataccgaatataaagaattcatggatcgtctcacaaaatctaaaactagagaagaattagatcaattctttgatagtgaaacgtatattagatggcaagtcgttaaatatttatttggtagttgggatcatcatagtaacattcataatatttatctttataaaaggaaggatggaatctggacgcaatttctttatgattatgataattcttttggctcattacagggtccgaatacaaagagaaccttttatgatgaaattgttaaatattataaggaacccagccctcttattgatgtccttcaaatctacgataacagtactgaatttaaaaaaattttggaggaatccttggaaaaggtattcaatcctaaaaagttattccctcatattgatgaaattaaggaatttcttgatccttacattaaggaggatcgcaccccagatgcaaatggtcaacttccaggaagattccccagagccctcacctattatgaggataagtattcgtatgatgacttcaaagataataccgaatatactagagttaaaataagatatcgtagttccgaagaaaaaattttagcgttaaagcaatggattcttgaacgatacct

SEQ ID NO: 20125 - DNA, 606 bp, Neocallimastix californiae
  CotH
tttagcattcactagtgattacactgatgttgttgaagctactggtaaaactccaaaggaagctattgaaagtgttattgatgcaaattctttagctgatttattcattattagtgaaatgacttgtgatgctgatctttactattctagtttctacatggatgttgatttcggagctaatggttctaagaaacttagatttgaagctccatgggatttcgattcaggtcttggtaacagagatcgttgtccagatggtaagggtcattacgctgctaatattatgccagataataatggatttggtagtaagattaacccatggttagctgttattatatatgaagattggttccaagatattattaagagtaaatggagtaaagcttatgatagtggtgtatttggtcgtgttgttgatatgattcattctgatactaaaattgctgaagcagctttcactcgtaactatgaaaagtggaacaatcttgttgataaacatggatttgataatgaactttctccaggtgctagacaatgtaccactcaagctcaagcttctgaataccttgctaaatggtttgaaaatagagttgcttttattaa

SEQ ID NO: 20126 - DNA, 378 bp, Neocallimastix californiae
  CotH
taaagtacgtggtaactggacatcgaactatccaaagaagtcacttaaaattagctttgacgattctcaaagtgttcttggacttaatggaggaaagaagtttaagaattgggtccttcttgctgaatacaaggatggttccatgcttagaaacaaagcatcttttgctttatctcgtagtattcttggaccagatggactttatgcctctgattcacaattagttgagttaaagattaatgatgaatactttggtgtttaccttttagctgaaaatcaacaaattaatgaaggtagagttagtattaccaaggcaaaagatgattatcaaggtactgatattggttatttccttgaatttgatactggttactctcg

SEQ ID NO: 20127 - DNA, 1014 bp, Neocallimastix californiae
  CotH
aatgtcttctgctgttttaactaaacctggttataatattaagattatcggtaattatactttacatggtactaaaaatttcaaacttagaagtgaccagcgtgatccaagtatgatgcgttctaagattactactgatatcttacaaaagagtggtcttttagcaactgaagcgggttatactgaactttatgtcaacgaagaatatatgggattttgggtagttacagattctcttaagaaaaattgggttcaaagaaaatttggtattaatgaagataatgtttctactctttataaatgtgattatttccgttttgaaaaatcttacaaatgtgaaaatgcaggagatgatcgttatgctgaaaattgggatccaatttggattttagttcaacatgttcgtgaatccaaatctattgaagatttagaagaaatgatggatgtagaaaatttcataaaatatatggcttgggaatggttaatgggtacatgggatcatttccttggtattttcaatcataacttaaattggttacaaagaccagatggtaaatggatttatattccaaatgatcatgatattgaattaggtgaagaaattcatgctaaattctatccagaaaaaccttttgttgatgaaatcaatgatactgatattgattacgccaatattccaattgaagattttgaaaataatcatccaataatgcaaattcttgtccatcaagatgataccatcttccgtcgttgtgttggtgatattattagtaaggtgttcaatccagatactcttttccctcaaattgataaaattagaaaattaattggtccttatgttaagaaggatagagaattaaaaggtggttatatcaataaaaagggtaaaaatattgtctatacttatgatcatttcttattaaatactgaatatacctatattcgtaacaatgttgatacttggtataagagttatggtcttaaggattggattcgtcgtcgttacaatttcgc

SEQ ID NO: 20128 - DNA, 1029 bp, Neocallimastix californiae
  CotH
attaggtggtaaatcctcaatggaattttctagaccaggttacaactttaaaattaagggaagtggtaaaactttacatggtactaaacaattccgtttaagaagtgaacaacgtgatccaacttacatgcgtactaagcttacttctgaaattcttcttaagagtggtttaatcactactgatagtggttacactgaattatatattaataatcaatacatgggattctgggttatttctgattctattaaaaagagttggattactagaaactttggtgaagttggagaagaagttaaaacattatatcaatgtaagattgatagtattagaattgataataatactgccaaaactgcctgtcttaatgcctataatgaattcctcgattataaggaaccatttaataaatttgttgatcaagttaacgcttctaagactagagctgatttagaaaaattcttggatgttgataacttcttaaaatatgttgcttgggaatatttagttggttcttgggatcacttcttaggtccattcggtcacaatttatactggtaccaacaaccaaatggtatttgggtttatcttccatacgatttcgatcttgatttaggagcttgtttatggagtgatcaattcagcagtaagtcctacaccactgctggtgataacattcaattcccagccattgctttcaaggactttgaattagaacatccaattattaagattttagttcatgatgatgatactagattccgtgaaattattggtgatgttgttagtaaagttttcaatccagatactttacttccacgtattgatgaacttaagaaattagttgaaccatacattaagaagaatattgaaactggtgcaggaaaaataaacaaagtctgtccaaagcaagctaactggacaatggatgacttttatgaaaactgtgaatacacttacctctatgatactaaggattacgttaaggctttcggtcttaaggattggatccgtcgtcgttacaatac

SEQ ID NO: 20129 - DNA, 831 bp, Neocallimastix californiae
  CotH
gagaacaaaattaatgtgtgatattcataataaattaggtttaccatcaatttcagcaaattatattaaattatatattaatgatgaatttatgggattatttattttaacagatgcttataaagaatcttggattgaatatgtttatggagaaaaagatactacaaatttatataaatgtgagaaatgtaatttattatttaataaaagatatggtttcgaaaatgaaaataaagaagctaccgacaatcaagaattttatgaatttttacaagcaatgacaaaagctaaatcttcagttgatgttgaatccatttttgatcttgatcaattctataaagaaatagccatagaatatttatcatcttcatgggatcatattaataatcaacataattattatgtttataagaatcctaaaaataataaatggatttatttaattcatgattttgatcttgatatgtgttcagaattatttgaaggattaaatgaatgcataaaatatgatttcaaaaactttttatatgttcctattgtaaaaaaattaatttataataatattgaacattttaaagaaattttaaaagaaattgtaattaaagtttttaatcctgctacattattcccaagaattgatgaaattaaatcatttattagaccttatgttcaattagataaaacactcaatgataatggagaatatcctggtagaatgaataaaaatgatgataccttttatactatggaacaatgggaagcctcaactgaatttgaagaatcattaattggattgaaacaatttattcttttaagatatagatatgtttg

SEQ ID NO: 20130 - DNA, 849 bp, Neocallimastix californiae
  CotH
taaggttggtggtagatcaaccagaagttactcaaaattaggttataatattaatattaagggagataaggatttccatggcgtgaagaatcttcgtttacgttctgaagttgttgatccaactttcattagagataaattaggttatgatttatataatataattaatttaccaactctttctgctaattatgctaagctttactttaatcaaaaatacatgggtttcttcttagtaagagatgctttcaaatctcattggattgaacaaaactacggtgaaaagaatactactcatttatatagttgtgatagtaaatatggtgataatgtcttctttaactgtcataatgatgctaaggaagatagtgacagatcagaggataaagaatggactaactttcttcaaaaattagaaaaagcggatactcgtgaaaaattagcagaattctttgatgttgatagctacattaaatggcaagtttctcgttatgcttttggatcctgggatcatgttactagaaaacataataatgtggtctatatgtatcatgatactactaatggtagagatttttggattccattcctttacgattttgatttaaattttggtgctcgtaatattgttaatgctaccaaatctttcaaagaagaagttatggaaaaggaagaggtcaatccactctacaagattcttaatattaatgaagagagtgaagaagttcgtggtattttacaagaaatttttgagaaagcattcgatcccaataaaattttatctcgtattgatcaaattagaaccttcattgctccttacgttttagaagatcgtactccagatgaaaa

SEQ ID NO: 20131 - DNA, 987 bp, Neocallimastix californiae
  CotH
aaagtatactcaaaattttgaaaaaccacaattcaatgttaatattaaagatgattccttatatggaattaagcatcttagattacgttctgaagttattgatccaagtttccttcgttctaagcttggtagtgatttaactacagttcttggtttcccatctaatcacgctacctattctaaagttttccttaataatgatgatatgggtctctacttacttcgtgatgctattaaggcaaattgggttgaatacaactttggtgttgcaaatacaacatctctttatacttgtgatttaatgtatggtgatagtttattctataattgtgtaaatgaagaaactgaagaaaaagatgaagatattactaattttagtaatcaaattgaaaatgctaaaactgttgaagaattagatcaattctttgatactgatttatatattaagtggcaagcttataaatatcttacaggttcttgggatcacgttactaatcaacataatcaatatctttataaggatggcgataaatggttggatattttatatgattttgatagtgatttaggtgcctataagattccagttcctgcccaaactttcagtgaagaatcccttgaaatggatttcccaatctataaattaattggtttaaatgataatcatcctaaattagttgaatacattaaagaaatggttactacttatttcaatccagtaaaagttttcccacatattgatgaattggttgaatacttatacccatatgttgttgaagatagaactccagaagatgatccaaccgctcgtccaggtcactatcttcgttccgatcataagattgaaaacggttttactgctgacgatttcttaaagaattccgaattcactaatatcttccttaataaatactatactgaaactaattatgatgttgatgaaatctttggtgttaaacgttggattattgaaagattcagattcgt

SEQ ID NO: 20132 - DNA, 1008 bp, Neocallimastix californiae
  CotH
aaaatcatcaactgaattttcgaaacctggatttaatattaaaattaagaatggagaaacattacatggtaccaaaaatttccgtttaagaagtgatcaacgtgatgcatccatgatgcgttcaaaaatttcaactgatattttacaaaaaagtggtttaattgctgttgaagttggatatactgaattatatattaataatgaatatcgaggattttgggttgtttctgattctgttaaaaacaaatggattaaaagaaagtttggtgatgttgatgatattactgatttaattcaatgtagagatgacaagattcgttttgatgataattcagccaaaaaaaagtgtgtaaatgctaatgatgaatatgccgataacatgactaatttcaataaattcgtcgatagtgttaatgcagcaaaaacaagagctgatttagaaaaaataatggatgttgataatttcattaaatacttagcatgggaatggttagtttttggttgggatcattttcttggtgtatacggacataatttatattggtatttacaaccaaatggtaaatgggtttatattccgtatgatcacgatttagaagttggtcaagatatttggactcaaagttttccaggaaaagatttttataatggaaatgatattgaatttgcaaatatatctttcaaagattttgaattaaaccatcctattgtaaagattcttgttcataatgatgatactatcttccgtgaatgtgttggagatatcattagtaaagttttcaatccagatactttactttctcatatagacaatattaaaaacttaatatcaccttatgttaagaaagatagggattctggtgctggaaaacttaataaacttggtaaagatgttgattatacctatgaacatttcttacaaaatgttgaatatacatatttattttcctataaaggtagtgtacgtggatatggtttaaaagattggattagacgtcgttacaatta

SEQ ID NO: 20133 - DNA, 1008 bp, Neocallimastix californiae
  CotH
taaatataccaaaagttttgaaaaattaggttataatattaaaattaagaaaggaaatttatttgagagaaaacaactacgtttacgttcagaagcagtagatccatccttcctcagagaaaaattagcttatgatatttgtaatgtggttgaattaccttctctttcttcaaactttgctagagtttatttcaataaaaaatatatgggtttattcgctatgagagatgcttttaagtctcaatggattgaatactatttcggggaaaagtctaccaagcatttatatacctgtgattcgaattatgggaacaataaattcttcaattgtgttaatgatgatgaggatattaaggagacggataccgaattcaaaaaattccaagatcgtttagccacaattaaaacaagagaagaattagaggaattcttcgatgttaaggtctttatgaaatggcaagccttaaaatatttgtttggttcatgggatcatgtcactaatgctcataatcaatgcctttatatgttccatgataccacctacggtaaagatatgtggattcctttactttatgattttgatagtgaatttggcgcttacaaggattctaatactcaaagaaccttcaatcaagagatttatgacagtaccaatcctctcttcaccattctcagcctaaatgatgataataaggaactcattggttatatggatgaaattatgagaaaggcgttcaatccaaagaaattaattccacgcattgatgagttaaaagaattcattggtccctatgtgaaagaggatcgtacgccagatgaggatggaaaccttcccggaagagtaaagcgaatcaatattaaaatagaggattactttacctacgaagatttcttaaataactcggaattcacggatatcaaactaagaaaatactccagtactatgacctataatgaagatcgtattattggtttaaagcgttggatgatcgaaagattcaagtttgt

SEQ ID NO: 20134 - DNA, 1014 bp, Neocallimastix californiae
  CotH
taaatatactagaaatttcgaaaaattaggttacaatattaaagttaagaagggtactttattcgaaagaaagcaacttcgtttacgttctgaagctgttgatccttctttccttagagagaaaattggttatgatatatgtaatttggttgaattaccttccctttcttcaaattttgccgaagtctattttaataaaagatatatgggtatatttgggatgagagatgccttcaaatctcaatggattgaatatacttatggtgaaaaatcaaccacccatctttatacttgtgataaagagtatggtgataatgaattcttcaactgtattaatgatgatgaagaccttgtagaaagtgataccgaatttaagaaattccaagatcgtttagcaaaggctaaaactagagaagaactggaaaaattctttgatgttcaaacgttcatgaaatggcaagccataaagtatttatttggctcatgggatcacacgaccacctatcataatcaatgtctctatatgttccatgatacaacgaccgaaaatgatatgtggattcctttactttacgattttgatagtgattttggtgcttacagagattccaatcctaatagaaccttcaataaggaaatttatgataaaactaatccgcttttcgaagttcttcaattaaacgatgataataaggaactcattggttatatggatgaaatcatgagaaaagccttcaatccaaagaaattaattcctcgtattgatcaattacgagaattcattgatccctacgtcaaaaaagatcgtactccagatgccgatggtaatcttccgggaagagttaaaagagttaatatcaaagttgaagattccttttcctatgaagatttcttaggtaattccgaatttatggatattaaactcagaaagtatgccactgaatctgattcttcttacagcgaagatcgtattgttggtttaaaacgctgggtgattgaaagatttaaatttgt

SEQ ID NO: 20135 - DNA, 918 bp, Neocallimastix californiae
  CotH
tgtttcttctcaatactatgccaaacaagcttttaatattaaggttcgtaatgatgaactctatggtagaaaacaattccgtattcgttctgatgctagagaaccaacaatgattcgttcaaaacttttctgtgatgttagtaatcgtttaggtcttgtaaattctgtctctgctaattatattaaattaagtattaacggtgaggatttaggtttctacgttattatggattcattaaaattaacttatgttaatattgaatatggtgataaagatagtacaaatttaattcaatgtaaagatttaagtgcttacttaacctccagtagtgtcaatggtaaatgtttatctgaaaatgaagacaatccagatataagtgcttttaaccaatttgtttcccaattagatagtgctaatacaattaatcaaatgaatcaagttttggatgttgaaaacttctttaaggttactattttagaatggctcacaggttcatgggatcattacactcttttcggtcacaattacaatgtttataaaattccaaatggtaaatgggaagtatctctttacgattttgatgccacttggggtcaagatcttgcacttagtttcccaactgctggtactccagctggtttaaatgctaataatgttgatacttggcctaaagctaagttcgaggactggattaatactcaaaaacaacatccacttgctgttataatgaatgaagataagaatctttttattaaatatctacaagaaattattgattctacttttaatccaggacttttatttgatagaattgatgaaattaaagattttattagaccatacgttaaagatgatagaactaaaaaattaggtagattgaatccaaatacctcttgtactgaatatacctatgagaa

SEQ ID NO: 20136 - DNA, 1077 bp, Neocallimastix californiae
  CotH
tatgtatgctcgttctaatgataaggttggttataacataaaattagacaagaaatttttaggtcgtaagaatattagaattagaccagatgcaaatgataaaactcatcttcgttcaaaacttgcttgtgatatagcaaacaagatcggtgtaccatctattcaagctgcttatgctagactttatatgaataatgaatactggggtttatatactttaatggatgctataaaaccatcatggattaaacaaacttatgatccagctgaaaaagaagtttcaaatttaattcaatgtaaatatgatggtatgaatttaactccaggatctgaatctaaatgtttaaatgctaatgatgaaaacccagatatgtctgcttttaaccaatttgtaagagaagttaatgctgcaagtagtattgaagaaattgaaaaggttttagatgttgatgttttcttaagatttatggctatggaatggttaattggttcatttgatcatttcttagttttaggtcacaatttctatttctacaaaagagaaactgatggaaaatgggttcttattgaatatgattatgataatactttcggtaatggtgtttcattccctgtttactggatgaacaagggtaaaaacaatggtggtaataataacaacaacaacaacaataataatggaggttggggcggcttcaattttggttttggtggctttggtggattcggtggtggtaatggtttaggaaataatgttcttcaatatacttttgctgattgggaattgaatattccaattattaacactttagtccacaaaaatccagaaagatttactggaattgttaaagatattttagctaatgctttcaatccatcacttttaaatgattatattgatcaacttaaaaccttccttttaccatatgttaaggaagattgtacaccaggtgctaatggtagacttccaggtagaattaatcaaaagggtaaccaaaatccagcttctgttaatgatttcgaagcaaacattgagggatctgttaataatgttgaaggtgtgaagtcttggattaa

SEQ ID NO: 20137 - DNA, 969 bp, Neocallimastix californiae
  CotH
taataattctaaaaaatatcaaaaattaggttttaatgttaatattaaaaaaggtgatttatacggtagaaaacaacttcgtttacgtgcttttgtcatcgatccttctttcattagagataaaattggtaatgatattgttaatgcgctcggtttaccttcactttcttctaatttcgctcatttatatattaatgatcgttttatgggcttttatgtcataagagatgcctacaaaccacattggattgaggccaatttcggagaaaaaaatacaaagcatttatacacctgtgactacggaaacaatccttactttaattgtgttaatgatgacgaagatattaaaaaggatgccgagtacgatgaattcttagatcgtttaactaaaactaaaactagagatgaattagaacaattctttgatactaaaactttcattagatggcaagtcgttaaatacttattcggtacttgggatcatagaacaaatattcataatatttatctttataaaactcaaagtggtatgtggactcaattcctttatgattatgataatgctttcggttcattaagaagccctaataccagaagaacctatggtgaagaaacacttactgccttcagagaaccaaagcctatcatcgatattctccagctctctgataatagtactgaattccaacaagttttaaatgaaaccattagcactgttttcaatcctaaaaaattgttcccttacatcgatcaaattaaggctttcattgatccatatattaaggaggatcgtacaccagatgctaatggtaaacgtccaggaagattcccaagagcccttgaatattatgaagattattattcctacgatgattacaaattaaatactgaatatactcgtgtcaaacttagatattacaacaatgaagaaaagattttaggtcttaagcaatggattcttgaaagatt

SEQ ID NO: 20138 - DNA, 993 bp, Neocallimastix californiae
  CotH
taaatatactcaaatatttgaaaagcaacaatacaatattaaaatcaataatggtagtttatttggtagacaacaatttagattacgttctgaagtagttgatccaagtttccttcgttctaagattggttatgatttatgtaatattcttggtttaccatctcttcaagctacctacactttagtatatattaataatgataatatgggtttatatttacttcgtgatgcctataagccacagtgggttgaatataattatggtattaccaatactacatctctttacaaatgtgataaaaaatatggatcaagtgactacttcaactgtcaaaatgatgaaactgaaactgtcgatgaagattttactgatttcattaaacaattagaaaaggctaaaaatactaaagatttatcaagatttttcgataccagtttatatattaaatggcaggctttaaaatatttacttggttcatgggatcatatcactaatcaacataatcaatatctttataaacatagtaatggtaaatggttaaatttattatatgattttgatagtgattttggggcttacagatctccaaaacctgcccaatcttttactagtgaatctggagaaatggactttccgctctataaaattcttggtttaagtgatacccataaagatcttgttgccaatattaaaagcatggttatcaatggttttaatccagttaaacttttccctcgtattgataatcttatggaatacttatacccttatatcctagaagatagaagtccagaaaaggaaacgactgaacgtccaggtcattttgtacgtccagatttcaagattgaaaatggatttaccgttgatgatcatgttaaaaatgctgaattccataactattatttaaagaaatatgaaaatgataaatcatatactattgatgaaatttatggtcttaaacgttggattattgaaagatttagatacgtttg

SEQ ID NO: 20139 - DNA, 888 bp, Neocallimastix californiae
  CotH
ttcttctcgtgtgtactctaaaccaaattataatttaaaaattcgaggagataaagaattatttggtcgtcgtcaatttaaacttcgtggggatgccgctgatccatcctttatgagaacgaaattgatgagtgatattcataaccgtttgggattaaagtcactttctgccaattacgccttcttatatattaatgatgaatttatgggattacaggtattaaccgatatctataaggaaacctggattgaatatgtctatggtgaaaaaaataccactaatctttttaaaggtaacaacgcagacctaaccatcaataatttaaatggttatgaaaatgaaaacaaagatacgaccgccgatgatacgaaagatctttccaaatttttaacagacatgactaatgcagaaacagcaaccgacgttgaatctatctttgaattggaacaatttaataaggaaatagcccttgaatatataacgattggaaccgatcattttatggccagtcataactattatatctataaacaaccccagaatggtaaatggatctacttatcgcatgatttcgatcttgacctggacacctatactgatgagacaaatcatgaattaacttttaatgattttaatacttccaatatggtaactaaattaattttgagtaatgaggaatatttcaaagagatgattaaagaaatcattgagaaagccttcaatccctcggtattgttcccacatattgatgaaataaaatcatttattaaaccgtatgttgaattagataaaaaaccagatgagaatggtgaatatcctggaaaaattaataaaaacagttactatgaagaatatttgtttaccttaaagcaatggaatgattctat

SEQ ID NO: 20140 - DNA, 1209 bp, Neocallimastix californiae
  CotH
taaagttcgtggtaactttacttctaattatccaaagaagcctcttcatataaagtttgataaaaagcaaagtattcttggaatgaataacgatggagcctacaaaaattggattcttctttctagttacaaagatgaatctcttgtcagagatgtaagcgttctttctattgctcgtgaaatttatagtactgaaggctactacgtctccgatactagatacgttgaagttactatcaatggagaatatgaaggtgtctacattttagctgaacaacaacaaattgctgagggtagaattgaaggagttgaaccaaagaagggctatgaaggttctgatattagttacttacttgaacatgatggttacgcatatcttgaggatccattaaataaggttctcattgattaccataatagagatccattaaagggctacgatggaaaaggtggtttagaaacaaagtctccagaaggtggtatgggggatgaacaaattgctataagtagtgatattaattcccaagctcaacatgattttattgctaattacattaataaggtttatgatatcatgtatgaagctgcctataacaataaaacttttgaattcaatgaagattacagtgaaattgttgaaaacgctgaacttaccccacaacaagccgttgaaaaggtggttgatgttaattcattagctcttttctatatcattaatgaaattgcatgtgatgctgatgttgctttctctagtttctatatggatgtagatttcagtgctgaaggaaaaaagaaacttagatttgaagctccatgggattatgattcagcacttggtattaaacgttgtgaaaatggtcaaggtttatttgctgccaatattgttccaacggctagtaatgctccaggtactgatattaatccatggttaagtgttctcatgtatcaagaatggtaccaagaactcattagaaagaagtggaatgagtactatcaaaagggagccttcaataaggctattgataatattcacaaaattactgaaactaatgctaaggcctttgaaatagaacatcaaagatgggatactgaagatcatgataaatctgttgcaggagaagctcttccagtaattcctccacttgattcacaaccagaacatgcaaattatgttgcagattggctcaagaaaagaattgaatttattaa

SEQ ID NO: 20141 - DNA, 933 bp, Neocallimastix californiae
  CotH
tagactttcccgtaggtattcaaagcaattatttaatttaaaaattcgtggaggaaaagaattatttggacgtcgccaatttaaacttcgtagtgacgcaaccgaaccatcttacatgagaactaaattaatgtgtgatatatataataaattaggattaccatcaatttcagcaaattatatcacattatatattaataatgaatatatgggattttatattttaactgatgcttttaaagaatcttggattgaatatgtttatggagaaaaagacactacaaatttatataaatgtgaagactgtgacttaacttataatacaagatatggttttaaaaatgaaaataatgaagctactgatatcaaagaactctatgaatttttggcaaaaataacaaaagctaaatcaataactaatattgaatcattttttgatattgatcacttttataaagaaattgcaatggaatttttatcatttggatgggatcattatattaatcatcataatttttatatttataaaaatccacaaaataataaatgggtttatttaaattttgattatgatcttgatttaggttcctttcaatatgattttactaaaagtataactaaaaaatttagtgatatgttctataatgataaattattaagtaatatagaacattttaatgaaattttaaaagaaattgtaattaaagtttttaatcctgctacattattcccaagaattgatgaaattaaatcatttattagaccttatgttcaattagataaaacactaaatgataatggagaatatcctggtagaatgaataaaaatgatgataccttttatagtatggaacaatgggaagcttcaactgaatttgatgaatcattaattggattgaaacaatttattcttttaagatatagatatatttg

SEQ ID NO: 20142 - DNA, 999 bp, Neocallimastix californiae
  CotH
aaattggagtagatctaatgatagggttggtttcaatcttaaattaaataaaaatgatcgtttattcaatacaaaaaatataaaattaaggccagatacaactgattttactagtatgcgtaccaaaatcgcaatggaattattatacaaatggaacttaccatcccctcacagtacatatattgaattatatattaatgataagtattttggtttatattaccttgaagatggtgttaaaccaaattggattaaaaatatgtatgaacttccaaaagatgaagaaattacaacccttttcaattgtaaaaaggatggtgctcttatgaatcttgaaactgctaatcactgctttaattctaatgatgattatgctaattacactcaaccaattgatgaagcttttggtgctattgaaaaagctacttctattgaagatttaaaaaaagtgattaatattgatcaattcataaaaaatatcgctattgaatttttatttggttcttatgatcattttattgttcacgctcataattatttattatataagaaagcagatggtatatgggatatgattttagttgattttgataatgaattaggtaatgggcttctttcttcatggtcatttgttttgaaccgtactgcagatgatattacaaaaattaaattagaggaaatgccgaaagaagaatcaaatatttttaatgttgctattttaaaagatcaaacattgtttaaaaaagctcttcatgaacttttagttacaggattcaatcctgattttattttcccacgaattgaggaaattaaaaaattaattactccatatgttgagaaatctattactccaaatgaagacggatcctatccaggtgttattaatcttattggttcaccttccgtacatacattaaaagattttgaagatagttttacttcagaagatcaaatgaaaattggtcttaaaacatggattcaaaaaagatttgaatttgc

SEQ ID NO: 20143 - DNA, 918 bp, Neocallimastix californiae
  CotH
aaaatcatcacgtacatttaataaagtggcatacaatattaagattcatggtgataacctatacggacgtaaagatttaagacttcgtgccgattacaatgaacctactttcttaagaacaaaattatattgcgatattactaatcgtttaggaattccatctatctcagcaaattatgtttctttatatattaatgatgaatatatggggttatatattttattagatatttataaatcttcatggattaaatataactacaatgaagccaatacatcatcattatataaatgtggttatgctaataattatttaacagctcaaatagaaggtacttgtaataatgataaagatgaagtttcagataccagccaatggaaagaactattagaaacattagataatgcacaaacagcagctgatattgaaaatatttttgatattgatttatttttatctcaagtagctattgaatatttaactggagcatgggatcatttcttaattactggaaataattattatatgtacaaaccacaaaatgataaatggaaattttttgaatatgattttgattcatctttcggtgataatatagaacgttcaaagaatttaaaagtcattattacagataaactaaatattatgaaaaaatatattttagactatccatcaatatcatttgacaattgggttgtaccttctcatttagttgatatcttaattttaaaggatcctactcgttttgaaactattcttaaaaatattgttgaaaaagtgtttaatcctaaaattctcttctctcatctcgataacttaaaagaattaattaaaccttatgttcaattagaaaaaacacaagatgctaatggtaactatcctggtcaacataatagaaatcataaggactatacttt

SEQ ID NO: 20144 - DNA, 918 bp, Neocallimastix californiae; identical to SEQ ID NO: 20143
  CotH

SEQ ID NO: 20145 - DNA, 1029 bp, Neocallimastix californiae
  CotH
tcaatattctcgtcatctttcaaaaccaaatttcaatataaaaattcatggtgaaaaggacttatatggtcgtcgaaattttaaacttcgttctgactatactgagccaacatttttgagatcaaagttaacttctgatatttatgatagattaggtactgtcagcatttcagctaattatgccaatttatatattaatgatagattcatgggcttattcgtattaacagatactcttaaattatcctgggcggaattagtctatggtgatgtgaattcaaaaaatttatatcagtgtacgggtggggctaaccttacttatagatcaataaactcatgtcaatgtgaatataaaatgccctataatcgtacggaatgggcagtactattaaaaacccttgataatgctaaatctgctagagatcttgaaaatgttattgattttgaccaatttatttattctatggctgttgaatatttattgggatcttgggataattatcgtaatagtaataatttttatatgtataagccattaaattctacgaaatggttatacattggctatgatttcgatcataatttcggtactaatttggactatgtctttgccagtcatatatatcttgatttacctgaagcctatgaaagggttaataagaattatccagagtattccatagataaatggtttagtagtattgccgataaaccattaattaaatatttaattttaaaagatagaaccagattttatgaagcccttagaactatcattgaaaaggtattcaatccaggaaccctctttctacgaattgatgaacttaaagaatttattagaccttatgttgaaatagaatatacaccagatgaaaatggtaaacttccaggaagaattaatgaaagtggaaatgatccatatacttttgctgaatgggaagctaattcagaatttacaactgtaaaaacagctcaatacaatgcctatggtattaaatattggattctttcccgatacagatatatctg

SEQ ID NO: 20146 - DNA, 609 bp, Neocallimastix californiae
  CotH
tatgtatgctcgtgtcaatgataaggttggcttcaatattaaattaccaaaaaagttcttaggacgtaaaaatataagaattagaccagatccaagtgatagaactcatcttcgttccaaactttgttgtgatatggctaatagattaggtttaccatctattcaagctatatatgcaagactttatatgaatgaagaatactggggtttatatactttaatggattctattaaaacttcatggattaaacaaactttcaacccttccgtagaagaaattacaacattaatacaatgtaagagtggtggtgctgatttagcacctggtactgaaagaaaatgtgtaaacgctaatgatgattatccaaatatggatgtttttaaacaattcgttgatgaaattaatgctgctaaaactattgaagaagttgaaaaaatcttagatgtagatgttttcttgaaattcatggctatggaatggttgattggatcatttgatcatttcttagtattaggtcacaatttctatttctataagagagaaagtgatggtaaatggattataattgaatatgattatgataatacattcggtaatggtctttctaa

SEQ ID NO: 20147 - DNA, 969 bp, Neocallimastix californiae
  CotH
taaaggtagtagaaatttttctaaaccaggttataatattaaattggaagaaggttcaatttatgaagttaaaaaccttcgtttacgttctaattctcgtgaccccactttattacgtgaaaaactttcaactgatatgctctacaaaatgggacttccaacaacttctacaaactttgttaatttagaagtgaatggagaagatcttggtctctttattgtcaccaacaagataaaaaaggattttattaagagatattttaatgataagaatactgataatttatttgaatgtttatcggatcacaatagatttgaaacctatgaatttgctaacagttgtcaaaatgcaaaagaagaacttgcagctaataaggaagaaattataaatttcaataatgccataaataatgctacctctgttgaagatattgaaaaggtacttgatgttgataactttttaagatatattgcttatgaattccttactctttcatgggatcatttcttaggttataatcataactttttctggtataaaaaaaaggaagatggacgttttatcatgattcttaatgattttgatgaaacgtttggtgctgattttagcaacattatattcttaatatacaatcaatacgcagacagaagttacatgccaggatatgaggaaatgtatgtaccaaatactgcattccgtgatattgatttagatcataagataatgaaatatcttgttcatgatgatgatactcgtttccgtagaattattggtgaagtagttaagcaagtctttaaccctaaggttcttaatgcccgtattgatgaattagccgaattaattcatgatgatatggccaatagtcgttctattgatgaaaaaaccggatattgtaggggatgctttaataccattggtcttgttacaggttggaatataacacattttgaagatggtgtaaactatgg

SEQ ID NO: 20148 - DNA, 936 bp, Neocallimastix californiae
  CotH
ccaatcaggtttacggtttggtaaaattgggtttaattttaaaattcgtggtaaagatgaattatatggacgtactcaatttaggcttcgtcctgatgcccgtgaagcaacattcttgagatctaaattggtttgcgatattcaaaatcgtttaggtattccttcaatttcagctaattatgctacgttatatataaatgatgaatatatgggattttatgttttaatggatacatttaaattatcatggattgaatatgaatatggcgataaagatacaagatttttgtatcaatgtaaagaaactggtaattatttaacagaaacctcttcatataattgcataaataaaaatgaagaagtcttggatcacactgaatggaatgaattattaacatcaataaagaatgcagaaactgcttctgatattgaagaaatttttgatgttgatctttttgtaacacagattgctcttgaatatctattaggatcatgggatcattttcttaattatggtcataattattatttatataaacctgtaaatgataaatggaagtatttgacttatgattttgatggtgaatttggtcaagatattgaaatggtgtatgttggcgcaattattgatgatgtaccagaaataatggatactgttaatatggattatccaaattattcctttgaacaatggacaaaaaaaaatcatttgattgaaattttaattttaaatgataaaagtcgatttaacgaaattttaaaaaatgtggtcaatgaagtttttaatccttccattctttatcctcgtatagatgaattaaaaacatttattaaaccgttcgttaaattggataaaattaaaaatgatgatggtaaatatcctggaaggcttaatgaaataattggtgattatacatttgatcagtgggatgctaa

SEQ ID NO: 20149 - DNA, 1023 bp, Neocallimastix californiae
  CotH
gggaagatcttcacgttcttatggtaaaccttgttataacataaaaattcgtaataaagatgatttatatggcaggactcaatttaaaatacgatctggatccagagatgctacatttttaagaaataaattagcatgcgatatacataatgctttaggtattccatctatttcagctaattatattacgttatatattaatgaggactatttaggtttttatattattatggatgctataaaattgtcatgggttgaatttttatataatgataagaattccacatttttatataaatgtgatgatgtacataatggaatttcaaagaaaactgctgttaaaggatgtacaaatgaaaatgagaattttactgataaaaaagattgggaagaatttttaacttcaatagatgaagctgaatctgccaataacctagaagatatattagatattgatcaatatttaacggaaatagcattagaatatttatttggttcatgggatcattatccagttcatagtcataacttttatttttataaagcaaatagtgtcgataaaaaatggaaatatttaatttatgattttgatggagaatttggacaagatattaatagtcattttatttcacaaatagaatttccatcatctaaatcatttttcatttctaattcaacattatattcttcattattacgtagaaccgacagtagtttaaatgaaaccgaaataaatcaaaataataaaacaattgcatccaacaatatagaagaactttttattgatcatgaagataaaaaatatgaatttgcagcctattcctttactgaatggtataatggacaggaccatttaattaaaattttaatattaaatcatcccactcggtttgttgatacactaaaaaagattatcactaaagtttttaatccaactatacttttcccacatatcgatgaaattaaaaaatttattacgccctatgtaaagaaggaaaagtacccagatgaaaatggtaaata

SEQ ID NO: 20150 - DNA, 954 bp, Neocallimastix californiae
  CotH
tagatcaacaaaaacttattctaagttaggttataatgttaaaattaagaagggaaaacttcatggagtgaaacatttacgtttccgttcagaagtagttgatcctactttcatgagagataaattagcttatgatcttcatcgtattataggattaaatactctcactgccaattattgtaaactttatattaatgatatctatatgggtgttttccttattagagatgcttttaaaaattcatgggttgaaatgtattatggtgaaaaggataccacccacttatacaaaagtattgatgtcagtgaagataaagataaaaatccattctttaattgtgaaaatgaagatgaaaatattaccgaagatccagattgggatgaattccttcaacaattagcaaatgctaaaagtcgtaaagatttagaagaattctttgatgttgaaggttacattaaatcgcaagtagctcgttatttatttggttcctgggatcataccaccaataaacaaaatagttacctttatcgatccattgataaagaaactggaaagtacaaatggttgtatttcctatatgattttgattttaactttggaggtaaaaatggagcctatattgaaaaaacatttgatgaagaaattgtagatgagaccaatccattatattcccttcttaatattaatggtgaaagtcaagaaattagaaatctcatggaagaatttatgcgaaaagttttcaatcctgaaacccttcttgttcgtattgatcaacttaaggccttccttaatccttacatttatgaagatcgtacgccagatgaaaatggaaatcgtccaggtagatttagtcgaatggttcgtagagttgaagatacttttaactataatgatttcttaaccaattctgaatttaccaccgtcaaaacaattcaacactatgatgacagtgg

SEQ ID NO: 20151 - DNA, 867 bp, Neocallimastix californiae
  CotH
taaatcatctctttgtttctccaagcctggttacaatattaaaattcgtggtgataaagatttatttggtcgtaatcaatttaaacttcgttctgaatctgccgatccaagtttcttaagatcaaaattagcttccgatgtttacatttccttggggcttccatgtatttctactaattatgctactttatatatcaatgatgagtatatgggtttatttacaataagtgatgcttataaatcctcttggattgaatcagaatatggtgataaaaatacttcttcattatataaatgtgacgttctctcttacttaacattggttaattctccatacttatgtgaaaatattaatgatgaagttactgattctagtgaatttgttcaatttttaacaactttggataaggcccaatcagccgcagatattgaagatatttttgaagttgatcatttcttaactgaaatggcactcgaatatatcttgggtagttgggatagaattcttcatcaaggtcacaattattacatgtataaacaaccaaatggtaaatggatttatttagcacatgattttgatcatgaatttggtattaatatggatagaggtattatgggaccaattactcttgattctccagaacgtgtccaaaaattaaactttgattatcctaactactcttttgatgattgggaaacgagacatcttcatattattgatattttaattagaaaggatactactcgtttcgataaaattttaaagaatattgttgaaaaagttttcaatccagctacactctacccacatattgatgaattaaaggaattaattaaaccatacgttgaatcagattataaacctct

SEQ ID NO: 20152 - DNA, 1008 bp, Neocallimastix californiae
  CotH
taaatatactagaaattttgaaaagcttggttacaatatcaagattaagaagggtgaactatttgagagaaaacaacttcgtttacgttctgaagccgtcgatccttccttcctaagagaaaaattagcttatgatatttgtaatttagtggaattgccttctctctcttccaacttcgctaaagtgttccttaacaataaattcatgggtttattcgctatgagagatgccttcaaggcccattgggttgaatactatttcggtgaaaaatctactaaacacctctatacttgtgatagaaactacggtagtaataaatttttcaattgtgtcaatgataatgatgaaattaccgatgataccgaattcaagaaattccaaaatcgtttagaaaaggctaaaaccagagaagaattagaaaaattctttgatgtggaaacgttcatgagatggcaagccttaaagtatttaatgggttcttgggatcatacgaccaacgatcataatcaatgtctctacatgttccatgatacttcttccggtaatgatatgtggattcctttactttatgattttgatagtgaatttggtgcctacatggactccaatcctcgtagaactttcaatagagaaatttatgacagtaataatcctcttttcaaaattctcaacctaaaggatgacaataaggaattgatgggttatgtcgaagaatatatgagaaaggccttcaatccaaagaaattaattccacgtattgatgagttaaaaaaattccttgacccatacgtcaaggaagatcgtacccctgatgccgatggtaaccttccaggtagattgaaaagagtcaacatcaaaattgaggattacttcacctatgaagagttcttaagcaacaccgaatataccgatatcaaactcagaaaatacaccagtgataccacctataatgaagatcgtatccttggtttaaagcgttggatggtcgaacgattcaaatttatttg

SEQ ID NO: 20153 - DNA, 1008 bp, Neocallimastix californiae
  CotH
taaatatactagaaattttgaaaagcttggttacaatatcaagattaagaagggtgaactatttgagagaaaacaacttcgtttacgttctgaagccgtcgatccttccttccttagagaaaaattagcttatgatatttgtaatttagtggaattgccttctctctcttccaacttcgctagagtgttccttaaccataatttcatgggtttattcgctatgagagatgccttcaaggcccattgggttgaatactatttcggtgaaaaatccactaaacacctctatacttgtgataaagattacggtaataataaatttttcaattgtatcaatgacgatgatgaaattaccgacgataccgaattcaagaaatttcaagatcgtttagaaaaggctaaaaccagagaagaattagaaaaattcttcgatgtggaaacgttcatgaaatggcaagccttaaagtatttaatgggttcttgggatcatacgaccaatgctcataatcaatgtctctacatgttccatgatacttcttccggtaatgatatgtggattcctttactttatgattttgatagtgaatttggtgcctacatggactccaatcctcgtagaactttcaataaagaaatttttgacagtactaatcctcttttcactgttctcaacctaaaggatgacaataaggaattgatgggttatgtcgaagaatttatgagaaaggctttcaatccaaagaaattaattccacgtattgatgagttaaaaaaattcattgacccatacgtcaaggaagatcgtacccctgatgacgatggtaatcttccaggtagattgaagagagtcaacatcaaaattgaggattacttcacctatgaagatttcttaagcaacaccgaatataccgatatcaaactcagaaaatacaccagtgataccacttataatgaagatcgtatccttggtttaaagcgttggatggtcgaacgattcaaatttatttg

SEQ ID NO: 20154 - DNA, 1008 bp, Neocallimastix californiae
  CotH
taaatatactagaaattttgaaaaacttggttacaatatcaagattaagaagggtgagctatttgaaagaaaacaacttcgtttacgttctgaagccgtcgatccttccttccttagagaaaaattagcttatgatatttgtaatattgtgggattaccttcgctctcttccaacttcgttaaagtgttccttaaccataaattcatgggtttattcgctatgagagatgccttcaaggcccattggattgaatactatttcggtgaaaaatccactaaacacctctatacttgtgatagagagtacggtaataataaatttttcaattgtattaatgatgatgatgaaattaccgatgataccgaattcaagaaattccaagatcgtttagaaaaggctaaaaccagagaagaattagaaaaattctttgatgtggaaacgttcatgaaatggcaagctttaaaatatttatttggttcttgggatcatgctaccaacgctcataatcaatatctctacatgttccatgatactacctatggtaaggatatgtggattcctttactttatgattttgatagtgaatttggtgcctacatggactccaatcctcgtagaactttcaataaagaaatttatgataagaataatcctcttttcaatgttctcaacctaaaggatgacaataaggaattgatgggttatgtggaggaatttatgaagaaagtcttcaatccaaagaaattaattccacgtatcgatgagctaaaaaaattccttgacccatacgtcaaggaagatcgtacccccgatgccgatggtaatcttccaggtagattgaagagagtcaacatcaaaattgaggattatttcacctatgaaaatttcttaagtaacaccgaatataccgatatcaaactcagaaaatacaccagtgacaccacctataatgaagatcgtatccttggtttgaaacgttggatgattgaacgattcaaatttatttg

SEQ ID NO: 20155 - DNA, 912 bp, Neocallimastix californiae
  CotH
aaatgtttctcgcatttactctaagcgtggatttaatattaagattcgtaataataaaaatttatacggtcgttctcatattagaatgcgtccagatgcttctgaagctaccttcttaagatctaaattatcatgtgatattttaaatcgtttaggtcttacttctctttcttccaattatgcaaaattatacattaatgatgaatacatgggtttatataatatgatggattcttttaaattatcttgggctgaatatgcttatgatgatgaaaatactactggattaattcaatgtcctgatagttccagtttcttaactgtagaatcctcctctgaaatatgtaaaaatgaaaatgaagaagtcactgataattctgaatgggttcaattcttaactgctctagataatgctcagtctatcgaagaaattgagaaattttttgatgtagatcacttcttgaagttaatggcctatgaatatttatttggagcttgggataatttcctcgttactggccacaattattacttatacaagcaacaaaatggtaaatggaaattccttctttacgattttgataactcttttggtcatgatattgatactgccttcaaaaacgttatcttcaataaaaatacccctcttggtaccaaaaactatccagaattatcttttactgaatgggctaagccaagtcatatcgttgatgttttaattttaaaggatccaactcgttttaattctatcattaaggaagttgttgctgatgtattcaatccagctaccctttatccttacattgatcaattaaaggaaaaaatcagaccttatgttgaattagataaaacacctgatgaaaatggtcaccttccaggtagaattaacccaaaggcttctgaatacacttt

SEQ ID NO: 20156 - DNA, 1050 bp, Neocallimastix californiae
  CotH
tcagtatgctcgttccaatgataaagttagttttaatataaaattagaaaaaaaatttttaggtcgtaaaaatattagattgagacctgatgctacagataaaagtcatcttcgttctaaaatttgttgtgatatcgcaaatagaatgggtgttccttccattcaggctgtctatgccagactctatatgaataatgaatattggggcctttatacgttaatggatgcccttaaaccttcttggattaaacaaacttttaatcctactgaaaaggaagtaactaccctttatcaatgtaaaaatggtggtatgaatttaaaatcaggttctgcttctaaatgctttaatgccaatgatgagtatcaacatatgactcaattaaataattttgttaaaggtgttaatgaggctaaaaatattaatgatctcagtaagattatggatgttaatgttttcttaaagtatgtggtatttgaatggttaattggttcctttgatcatttcttaatttatggtcataatttttacttctataaaagagaaactgatgggaaatggcttctcattgagcatgattttgataatacttttggttccggtatttctctcaatttatgggctaataagggtcctaaccaagatggtagcagtggtaattccaataacaacaacaataacaacccatggggttggggttggggttttggtgggaacaacaataacaatagaggtagtgaacccataaaatatagttttgctgattgggaaatgaatataccaattcttaaaaccttagtttataataataaagataattttaaaaaaattgttcgtgaagttttagtttctgccttcaatccaaccattttggatccacatattaatgaattaaagaaattccttactccatatgttaaagaagatagtaccaaaggaaaggatggtagtcttccaggtagaattaataaaaagggacagaagcatagttcttctgttagtgaatttgaaaataatattgaaacaagtcttaaatattggattaaaacaaa

SEQ ID NO: 20157 - DNA, 855 bp, Neocallimastix californiae
  CotH
tagttcatcacgttcatttggaaaacaaggttacaactttaaaattcgtggaaaggaaaatttatatggtcgtactcaatttagacttcgtccagatgctcgtgaagccactttcttaagatctaaattattatgtgatgttcataatcgtttaggaattccatctgtttcagctaattatgctactttatatattaatgacgaatacatgggattctatattttaatggattctattaagttatcatggattgactttgtgtatggagataaagatagtacttctttatacagatgtaaagatgtaaataatgatttatctgtcaaaatgtcttctaccggttgtattaatgataatgaagaagttactgataatagcgaatggattgaattcttaacagctttagatagtgctcaatctgctgaagatattgaaaatatttttgatattgatttatttttaacagaaattgcaattgaatatatatcaggttcatgggatcactatcttatctatggtcataatttctatttatataaaccaaaggatgataaatggaaatttatagtttatgattatgatggagactttggtcaagatattgatatgggtattaacggtatgagttttgattttactgctcctagaaatccaagtacagattacccaacctattcatttgaagaatggactaaatcacgtcatcttgttgacattttaattttaaataattctactcgttttgataatattcttactaaccttgtttccgaaattttcaatccagctactcttttcccatacattgatgaattaaaggaatttgttcgtccttatgttgaattagataaaat

SEQ ID NO: 20158 - DNA, 969 bp, Neocallimastix californiae
  CotH
taagaccagtcgtttcttggccaagccaggttataatattaaaattcatggcgatgataatgcaatttatggtgttaagaagttacgtatacgttccattattcgtgatgcttctcaaatgcgtgaaaagctctccagtgatattcttcaattaatggatgtccctaccacctctactggttatattaatcttgaaattaatggtgaatttatgggtctctacctcctcaccaataagattaagaaagatttcataaagtattactatggtgaaagtaagccaaaaaatctctatgactgtaaattagataaaaccagatttgaagataatactgtcgttactcaatgtgaaaatgtagatgaaaagttaacagataaaacagaactccaaagctttgttgatgcagttaatcaagctaagagtgctgaggagcttgaagcatttcttgatacggaagcagtattaaaatcctttgcttttgaatttataacagtagcctgggataatttcttagctttcaatcataattacttcctctacaagcaaaccaatggtaaatggaccatgattattaatgattttgactatacttttggtcaagaattttggagcactcacttccaaggcaatggcgtttacgtcaataaggattacattccagatgctactcatgttaacattttcaatttctcaattcgtgattgtgatcttggtcataaattggtaaccttacttattcttaatgacgatactcgtttcagagaaattatagccgatgtcgtgaagaaggccttcaatccacaacttctccttccccatattgatgctattaaggaccttatctatgacagtattgttgctgatcgtcaatttgatgataaattcaatggaccgggtcgtattaattctcttggtaaattcgtaagatggaatgtcacccacttcatagatactacagaatacaccag

SEQ ID NO: 20159 - DNA, 807 bp, Neocallimastix californiae
  CotH
tcaaaattctagaaattatagtaaactcaattataatataaaaattaaaggtggtgaagatttatatggtcgaaaacaattcaaaatacgttctgataatagtgagccaacatttctaagaactaaattaattgctgatatacataattatatagatctaccatctatatcagctaattttgctaatttttatattaatgatgtatatatgggtttctatattatcactgattcatttaagccctcatggatcaattatatatatggtgatgaagatacatcaaatttatacaaatgtgaaaatactaagaatggtttaacgacttataaagccacatatggttgtaaaaacgaaaatgatgaagttacagatattacagaatgggtcgaatttttaaataaagttgatcaagctgaatccctttcagatttagaaaatgttgttgatattgataaatttctaatagaaatggcattagaatatttattagatagttgggatcatatccaaaatggtcataatttctatatgtataaaactcctcaaggtctatggacttatttaacctatgattttgacctagattttggtcaaaataaacaaccacctcaaagttataatgattatttagcaatgataaaagaacttaattctcatattttaaatattttaattttaactgaaccaactcgcttcgaggaaaaaataaaacaacttgttacagaagtttttaatccaatgattttatatccacatattgatgaattaaaagaatttattaaaccatatgttatttttgataaaac

SEQ ID NO: 20160 - DNA, 1005 bp, Neocallimastix californiae
  CotH
taaatatactagaaattttgaaaagctaggctataatattaaggttaagaagggtgagctctttgaaagaaaacaacttcgtttacgttcagaagcggtcgatccttccttccttagagaaaaattagcctatgatatttgtaatttagtggaactgccttccctctcttccaattttgtaaatgtttactttaacgatcggtatatgggtttatttgccatgagagatgctttcaaatctcaatggattgaatactattttggtgaaaagtccacgacgcatctctatacttgtgatcgagaatacggtaacaatgtcttcttcaactgtatcaatgatgacgatgaaattaccgatgacgttgatttcaaaaaattccaagatcgcttagccgagaccaaaaccagaaaggaattagaagaattctttgacgtggaaacgttcatgagatggcaagccttaaaatacttatttggttcctgggatcatgctaccaatgatcacaatcaatccctctatatgttacatgataccacttccggtaaagataggtggatccctttactgtatgacttcgatagtgaatttggggcctacatggactccaatccccgtagaacttttaatcatgaaatttacgataaaaaaaatcccctcttcgagattcttaatttaaaggaagataatgaggaattaatgggttatgtcgaggaatatatgaggaaggccttcaatccaaagaaattaattccccgtatcgatcaactgaagcaattccttgatccttatgttaaaagagatcgtacccccgatgccgatggtaaccttccaggtcgagtgaagagagtcaacatcaaaatagaggactacttcacctatgaagattttctaagcaacaccgaatataccgatatcaaactcagaaaatatactagtgagtcgacgtataatgaagatcgtatccttggtttgaaacgttggatgattgaacgattcaaatttat

SEQ ID NO: 20161 - DNA, 921 bp, Neocallimastix californiae
  CotH
tgtctcctccagatattatccaagacaagcttttaatgttaaaattcgtaatgataaattatatggtcgtaaacaattccgtattcgttctgaagcaagagaagcaactttcttaagatcaaaaattttctgtgatattaataatcgtattggtcaaccggattctgtttcagcaaattatattaaaatgacaattaatggtgaagatatgggattctatgtgattatggatgctgtaaaattaacttatgttaatattgaatatgatgataagaattctactaatttaattcagtgtggtaatttaaatagtgatttaactatgaaaagtatgcgtacttgtgaaagtgaaaatgatgataacccagatatgactagttttcaacaattacttacctctcttgatggagcctccactattgaagaattggaagaagttttaaatgttgaagttttcatgaaagctgtcctcatggattatcttagtggttcatgggatcactactgtttatttggtcacaattttaatatgtataaaccaccaaatggtaaatggcaaattgtactatatgattttgatgcaacctttggtcaagatctttctatgggtcttatgtatggaacgcctgcaggtgtagttggtaataatattaatacttggacacaagcgaaatttgaaaactggcatggaaataaacatattattaatattattttaaaggacagacctgaacttttcttatctagtcttcaagaaattgttacgaaggctttcaaccctaaatacttattcccacatattgataatcttaaaaagttcattcgtccctatgttgaagaagataagactaataaacctggtagaattaattccagaagtacttgttatgattatactttcagtgaatgggatgctaattc

SEQ ID NO: 20162 - DNA, 1017 bp, Neocallimastix californiae
  CotH
taaatcatcaactgaattcagtagaccaggttacaacattaagattaagggtggtgaaaatttacatggtaccaagaacttccgtttaagaagtgaccaacgtgatccaacttatatgcgtacaaagcttgttgctgatatcatgcaaaaaagtggtttaattactgttgaaagtggttacacagaactttacgttaatgatcaatacatgggattctggatcattcaagattctgttaagaataagtggattgaaagaaactttggtccatacgaaggtaaagatcttaagactttatatcaatgtaaggttgatgaaattagattcgatgatggttctgctaagaccaagtgtgtcaatgctaatgacgatttcgctgattatatggaaccattccacaccttcgttgatactgttaacgctgctaaaactagagaagatttagaaaaggtcatggatgttgataatttcttaaagtacatggcttgggaatatttagttggttcttgggatcacttcttaggtccattcggtcacaacatctactggtaccaacaaccaaacggaaagtgggcttacattccatacgattacgatcttgatttaggttcctgtatgtggaaagatcaattcaagattaagtcttacttcgaaggtgaaggtgatattcaattcccagctattgctttcaaggactttgaattagatcacccaattattaagattttagttcatgatgatgatactaaattccgtgaattacttggtgatgttgttagtaaggtcttcaacccagatactttacttactcgtattgatgaactaagagctttcattgaaccatatgttaagaagcaacttgaaactgaagccggtaaaattaacaaacttgccaagaagaaggctctctggacttacgatgatttcaacgaaaactgtgaatacactttcctttacgataccaatgatcacgttaaggcttttggtcttaaggattggatccgtcgtcgttacaa

SEQ ID NO: 20163 - DNA, 1002 bp, Neocallimastix californiae
  CotH
caaatataccaaaaattttgagaaattagggtataacgttaaaattaagaagggacaactatttgaaaggaaacagctacgttttcgttctgaagccgtagatccttccttccttcgagaaaagcttgcctatgatatttgtaatgtagtagagttgccttccctttcactaaattttgctaaactttatttcaacgataaatttatgggattattcgctatgagagatgcctttaaatctcaatggatagagtataattatggtgagaaatccacgaaacatctttacacctgcgatagaaattatggtaataataaatttttcaactgtatcaatgatgatgaagatatcgttgatgaccccgactttaaggcatttcaagatcgtttagagaaaacaaaaaccagaaaagaattggaggaattctttgatgttaaaacgttcattaaatggcaagctctaaaatatttatttggttcatgggatcacatcaccaatgcccataacagttttatctatatgtatcatgataaggagaaaggtaaggatcaatggattcctttactttatgactatgatagtgaatttggtgcctacaaaatctccaatactcgcagaacatttactcaagaaatctatgatggttcaaatcctctttttaaaatccttgatttaaatgaagagaatgaggaactccttagggatatggcggaaattatggaaaaggtcttcaatccaaagaagctccttccacgtatcgataaattaaagcaatttattgccccctttattaaagaggaccgtactccagatgagaatggttcccttcccggaagggtgaaaagaattaacattaagattgaggattatttcaactatgaagattttcttgagaatacggaatttacaaccgttaaacttagaaaatatcaaagtgactcgatttataatgatgactatattctcggcctaaaacaatggataattgaaagatttagatt

SEQ ID NO: 20164 - DNA, 1050 bp, Neocallimastix californiae
  CotH
tagtggtagtcgtaactatataaaaccaggatataatattaaacttaagaagggagcaaagttgggtgaagtaaagtctcttcgtttacgtggtaacgttcgtgatcctacgctcatgcgtgaaaaactttcttctgatattctttacagaatgggtattccagctacctcaactaattatgctaatttaatagtgaatggtgaagatcttggaatctttgtcttaactaataaaattaaaagagattttgctgagaaatattatggtgatgaaagtcctgataatcttttcgaatgcaaaaaagcgggttcaagatttgataataatggtgttgctgaatggtgtgaaaatgtaaaagatgaattaaatgacttcagagatgatcttattgcctttaatgaagctattaataaggctacttctgttgaagacattgaaaaagtacttgatgttgatcatttcttacgtgtagctgcttttgaattgcttactgattcatgggatcatttcatcacttattctcacaataatttctggtataagagaaaggaagatggtaaatggcttattttccttaaagattatgatgaaactttcggtaataatttctatagttttattttcatgtatttcactgaatattctgatagaacctatgttccaaatgatgatgaacttaatattgtaaatatgtcaatccgtgacttagattatgatcataaatttttaaaatatcttattcatgatgatgatactcgtttccgtaagattatcggtgaagttgttaaggaagtcttcaatccaaaagtacttttatcaagaatcgatgaaattgcagaattaattcgtgatgatattaaaagtagtcgtacgcctgatgaaacgacaggtctctctaaaggatatttaaatactcttggttttaatccaaatttcaatgtaactcattttgatgattgtattggtgatggcaattggagatctaatgtcagtaatacagttacctatggtttaaaatactttattgaagaacgtttcaaatatatttg

SEQ ID NO: 20165 - DNA, 1074 bp, Neocallimastix californiae
  CotH
tatgtttgctcgctctaatgataaagttggtttcaattttaaattgaataaaaaatttttgggtcgtaaacaattaagaattagaccagatgcaaatgataaaagttacattcgttcaaaactttcatgcgatattgccaatagaattggattaccttcaattcaagctaattatgcaagactttacatgaatgataaatattggggtttatatattttaatggatgctattaaaccttcatggattaaacaaacattcaaaccatcacaagaagaagttactacacttttccaatgtaaacttgatggtatgactatgaaaatcggaacggaatctttatgtaataatgctaatgatgattatccagatatgtcagaattttctcagttcattaggcaaattaataatgcgaaaactagtgaagaaattgaaaagattatggatgttgaggtatttttaaaatttatggctatggaatggttaattggatcttttgatcactttttagttttaggacataatttctatttctataaaagagaaagtgatggaaaatgggttattattgaatacgactatgataatacattaggtaatggattatcatttagttcttattggaattcaaagaaaaatattggaacaaataataaaaataataatagaaataattggggtaacaattggggaaataattggggtaacattggaagaggttttggcatgggaggttatagttctaatgatcttataaatttctcctttgccgattgggaactggatcgtccaattataaaaatcttagttcatgataatcaagaaagatttaagaaaattgttcatgaagttttagtctctgcctttaatccagatatcttaaatccatatataaaccaactcaaatcattccttttaccctatgttcaagaagattgtactcctgacagtaatggtagacttccaggtagaattaacagaagtggatcacaacacagatcaaccgtcagtgaatttgaaagaaatatagaaactagtagtaacggtacggaaggagttaaatcttggattaaagg

SEQ ID NO: 20166 - DNA, 921 bp, Neocallimastix californiae
  CotH
tagttcttcacgtatgtatgctagacaagctttcaaccttaagattcgtggtaaggatgatttattcggacgtaaacaatttagaattcgttcagaagctcgtgaagctacctatttaagatctaaattagtttgtgatattcaaaatcgtcttggtatgacttctatttctgctaattacatgtcattatacgttaacaatgaatactggggattctacgttttcatggattcaccaaaaccaacttgggctgaattagaatatggtgacaaggattctactcacgttatgaaatgtaagtctggtggtgctactttaactgttagagatagtgctactcaatgtgttaacgaaaatgatgaggttactgataatactgaatggagaaacttcttggatactttagatcgtgctcaatctataaatgatgttaaaaatatatttgatgttgatcaatttattaataatatgatttatgaatatttatgtggttcatgggatcacttccttaatactggtcacaactttgttgtttacaaaaagccacaacaatttggaggtaaatggactatgattgaatacgattttgatggtgatttcggtcaagatgtttgtgctgttgaatttgctggttcaattaaacaagataaggattatccaagttggtcatttgctgattggacttctaaatctcgtcacattcttgatgtttgtattaagaaggatcaaactcgtttcaagcaacttcttgaaaagtttgttgctgaagctttcaacccaggacttcttttcccacgtattgatgaattaaaggactttattagaccatatgttcaaaaagataagactccagttaatggtagaaaaccaggtatgcttaatactaaggctactgctgattatactatggctcaatggga

SEQ ID NO: 20167 - DNA, 1017 bp, Neocallimastix californiae
  CotH
taaatatacgaaatcatttgaaaaattaggttataatattaaaatcaaaaaaggtaatcttttagaaagaaagaatttacgtctacgtacagaagcagttgatccatcattccttagagaaaaagtagcatatgatatttgtaatgtgattggtttaccatcactttcacttaattacgctcgtgttttctttaatgataaatatatgggtttatacgccttgagagatgcttttaaagctcaatggatcgaatatacttttggtgaaaaaaatactaaacatttatatacctgtgatggtcaatatatgacagaagaaaccgaaaatctctataattgcattaatgatgatgaaaatattaaggatgatccagattggaaacattttattgagcgattgaaagctgttaaaacaagagctgatcttgaagaattctttgatgttaagacctttattaaatggcaagtaattaaatatttatttggttcatgggatcatgatactactggtcataatcaggtagtatatatgtatcatgatacttcctctgaaaaagataaatggattccaatgctttatgattttgatagtgactttggtgcctatagagatcacaaaacccgtagatcattttcagaagaaacaagagaagcattaagtccattttataaattacttcaattaaatgataaaaatgaggaacttatttcctatattgatgaatttatgagaaaaggatttaatccaaaggatttaattcctcgtattgatcaattaaaggaatttctttctccttatgttaaggaagatcgtactccagatgagaatggccgtttgccaggtagacaagaaagagtaaatattaagattgaagactattttacatatgatgatttcaatgataacagtgaatttacaaccattagacttaataaatatactagtgaaactacctataattctgaggaaattatgggattaaaacaatggattattgaacgattccaatttgtttg

SEQ ID NO: 20168 - DNA, 1020 bp, Neocallimastix californiae
  CotH
tggtggtagatcaactactttcttttctaaagtaggctataacattaatattaagaatgatctattatacggtgccaaggatttacgtttacgtgctgttactgttgatccatcattcttaagagataaacttgcgtatgatttacataataaaattgaattaccatgtataagcgcaaattatgctaaactgtacattaatgatacatttatgggtttataccttttaagagatgcctataaagctagatgggttgaaaatacttttggagaaaaatcaacaaaacatttatatacttgtagtaatgcatatgagagtgaaggaaatgatttcttcaaatgtataaatgatgatgaagatatcacagatgatcaagatataaaaattttcttaaaaaaattagaaaattcaaaaaatcgtaaggacttagaaaaattctttgatataaaaagtttcataagactacaagctgctagatatttattcggttcattagatcatattactggcgaaaataataatatgctttatatgtatcacgatgtttcttctggtaacgatttatggattccacttatttatgattttgatatgaactttggtaattttggaaagcctaacaccaatcgtacatttgatgaagaaatttttgaaaagaaaaatccattatatacaatgcttaatattaatgataaaagtgaagaattaatttctattatggatgaaattatgcgtaacgctttcaatccaaatattcttcttccacgtattgatcaattgagaaacttcattgctccatatgttaaagaagaccgtactccaggtgaaaacggccgttttccaggaagatttgatattggtgtaggtagaccacatgatcaattcacttatgaagattttattaacaacagtgaattcactacaattaaagctcgtcagtactacaacaacttcactgacatttatgaagaaaatactgctttaggtcttaaacagtgggttattgaacgttttaagtt

SEQ ID NO: 20169 - DNA, 1029 bp, Neocallimastix californiae
  CotH
agttggaggaaaatcttcagctgcaatgactaagccaggttataatattaaaattaaaggaaaaaatcaaactttacatggtactaagcaattccgtttaagaagtgaccaacgtgaagcttctatgatgcgttcaaaaattactactgatatcttacaaaagagtggtttaattgcaattgaagttggatacgctgaattatatataaatgatgaatatatgggattctgggtagtttctgattccattaaaaataaatggattgaaagaaaatttggagatgatagtaataatattaaaacattatatcaatgtaaagaagcatacatgagattagatgatggttctgccaaagaaaagtgtacaaatgctaatgacgaatatgctgattatatggaaccattccataattttgtcgatcaagttaatgctgccacttcaagagaagatttagaaaaaattatggatgtcgataactttattaaatatattgcctgggaatatttaatgttatcatgggatcattttataactgctttaggtcataatttattctggtatcaacaaccaaatggaaaatgggtttacataccatatgatcatgatgttgaattaggacaagaactttcaaatgattattgttactataaaccatattgtggccttaaagaagttgatttttctaatatttcattaatagattatgaattaggacatccaattcttaaaattttaattcatgatgatgatactaaattccgtgaattagttggagatattattagtaaagtttttaacccagatactcttcttattcatattgataaaattaagaacttaattgatccatatgttaaaagagatagagaaagtaatgccggtagaattaataaagtgggagtagaaaagaaattttcttatgaacatttccttttaaatactgaatatacatatattatagataatgttcataaaacaagatcctatggtcttaaagattgggttcgtcgtcgttacaattatgtaac

SEQ ID NO: 20170 - DNA, 345 bp, Neocallimastix californiae
  CotH
tcataactacagtgtttacaagaagaaggatggtaaatggattgttctttactacgatttcgatggtgatttcggtcaagatgttagtcaaggtattgaattcggtaaaccatttgttaatccaaaaaaaaactacccatcttatggttatgaagaatggttcttagttccaatgaacatttacgatgttttaattaagaatgacccagctcgtttcgaaaagattcttgctaaggttgttaaggaagctttcaacccagctgctcttttcccacacattgatgaattaaagaaattcattaagccagaaatcgttagaattagaactccagatgaaaacggtaa

SEQ ID NO: 20171 - DNA, 1026 bp, Neocallimastix californiae
  CotH
tcgtcttaagggaaaatctactagaaatcataaattcaagagtttcaatatcagaccacgtaagaagtatggtgattctaagttcagagctgatattattgaaggtaatcgtaatgttattaataatgaagaaattactgaatacgattctttcagtcttcgttccgttggatggtttgatagaatgagagaagctattgttcaacgtgctcttaaagactatccaattcttgctacctacgataacaataaaagtttagttttccttgatggtgaattctggggtttatatgatattattgaaaaatgttctgctgaatttattgaatctaattacagtattccacataaacaagttgctattattaaggattatgaattagaagaaggtactgaacaagactttaatgactttaaagaacttgttaaattctgtcaaaacaatgatcttactcaagctcaaaactataaatatgtctctgatagagttgatgttgatagtttaatttatcattatgctaatggtttataccttggtatttgggattggccaaacagaaatttctttgtttacagaaataatggttccccaattgaaggtaataaatacagtgatggtaaatggagatttgcttcctttgatttcgattattcttctggtcttacttatgaagactttggtggtgttcaaggatatgctcatgattcctttactaaattccaaaagaagaaggatgaacatccaactccacttttcacttacatgatgaaaaataaggaattccaacaaaagtttgttgatgtcttttaccttatgggtgaagaaatctttggtgctcaaaagatgaaatctattgttcaaactgaaaaagataaatacttaaagtttgtcatcaaaaccgattggagatggtacggtggtacaccaaatatgtcatacaatgaattctttggccttcaaaccagatactatggtggaggttatgatgatattgctactttctttactaaccgtgctcaatacgc

SEQ ID NO: 20172 - DNA, 831 bp, Neocallimastix californiae
  CotH
tgctaagctttacttcaatgaaaaatatatgggattctataccttaagagatgccttcaaacctcaatggattgaatatacctatggtgaaaaatcgacaaagcatctctacacctgtaatgaatcctacggcgacaataagttcttcaactgcttcaacgatgatgaggatcttaaggatacggataccgaattcactaaattccaaaataaattggctaaagctagaaatagaaaagatttggaggaattctttgatgtggaaacgtttatgagatggcaagccttcagatacttattaggttcatgggatcactacgccaactaccacaacaccgtctattatatgtatcaggataaatctaaaggtagggagaagtggattcctttactttacgattttgatagtgacatcggggcctacagatatccagatccaagtagaagatttaatgatgaaattttggaaaatgatcatcctctcttcggtctcctggatatcaatgaaaataatcctgaatttatgaaatatgtggaggaatacatgagaaggggggtcaatccaaaggatttaattcctcgtatcgataagctgaaggcctttgttgatcctttcattaaggaggatcgtactccggatgcggagggtcatcgtcctggtagagttctaagagtagataatcgtgtcgaagataatttcagctatgaagacttccttggcaataccgaattcaccaccatcaaacttagaaaatatactaccgataaaaaatacgattcggattatattctcggcttgaaacagtggttcatcgaacgattccaatttat

SEQ ID NO: 20173 - DNA, 309 bp, Neocallimastix californiae
  CotH
gtatatgtttcatgatacctccaaaggtaaagatttttggattcctttcctctacgattttgatttaaatttcggttctcgtaatattattaatgctaccagaacttttaatgaagaagttgtcaataaagaatccgttaatcccttatataagattcttaatatcaatgaagatagcaaagaagttcgtgatctcttacaggaattctttgaaaaggcttttgatccacgtaaagttttaagtcgtattgatcaaataagagctttcttagctccttacgttttagaagatcgtacaccggatgagga

SEQ ID NO: 20174 - DNA, 1014 bp, Neocallimastix californiae
  CotH
tcaatattcaagagaattaattaaacctaattttaatttaaagattagaggtggcaagaatttatatagtcgtagtcaatttaaacttcgttctgattatacagaaccaacatttttaagatcaaagttaacatctgatattcataatcgtttaggtcttccttcaatttccgccaattatgccactttatatattaatgatgaatttatgggattatttgttttaacggatgctattaaacagtcatggataaaatttgtatacggtgaagaagattctcaatctttataccaatgtagtagttctaatttaacttttaattcaagacatggttgtggtaatgaagatagtgatttcaaagattacacagattggatggactttttaacaaagttagatgctgcagagtctgcttctgatattgaagacttttttgaagtagataactttatatatgaaatggccattgaatatttaattggtggttgggatcatattcaacaaattggccacaacttttatatgtataaacaaacaaatggtaaatggaaatatttttcctacgattatgatcatgaatttggtattaatatcgatagagtatttgtagcttatatttttgaagatttgccagaacgttatgaagccattaatacagattatccaagttattcatttgctgaatggactatgccttatcatattattgatattttaatattaaaggattctactcgttttgatgaagctttaaaagatattgttacgagagcttttaatccagctactctatttccacgtatcgatgaattaaaagaatttattaaaccttatgtgataatagataaaacaccagatgaaaatggtaatcgtcctggaagaattaatgtaagtgctgaagaaacatatactttagaggaatgggatgctaactctgaatttacttccattagtaccattcaatataatgcctatggtataaaatattggattcttgctaaatatagatatgt

SEQ ID NO: 20175 - DNA, 921 bp, Anaeromyces robustus; identical to SEQ ID NO: 20166
  CotH

SEQ ID NO: 20176 - DNA, 1026 bp, Anaeromyces robustus; identical to SEQ ID NO: 20171
  CotH

SEQ ID NO: 20177 - DNA, 909 bp, Anaeromyces robustus
  CotH
taattccgctcgtgattacggaagacaaggtttcaaccttaagatccgtggtaaggaagatttacatggtcgttcccaattcagacttcgtgctgatgctcgtgatgctactttcttaagatcaaagattgcttgtgatattcacaacagattaggtcttgtttctatttctgctagttacgttaacttatatgttaatggtgattacttaggtttctatgttattatggatgctccaaagttaccatggattgaacaagtttatggtgaaaaggatactgaaaacttaatcaaatgtaagattggtggtaattacttatctgaagcttcctgtgctactcaatgtgttaacgaaaatgatgatgttactgacaattctgaatgggttaagatcttaagaactatcgataatgctaagactccagctgatttagaaaaggactttgaaattgatcatttcttacatgaagctgcttttgaatacttagttggtggttgggatcacttacttacctctggtcataactacagtgtttacaagaagaaggatggtaaatggattgttctttactacgatttcgatggtgatttcggtcaagatgttagtcaaggtattgaattcggtaaaccatttgttaatccaaacaaaaactacccatcttatggttatgaagaatggttcttagttccaatgaacatttacgatgttttaattaagaatgacccagctcgtttcgaaaagattcttgctaaggttgttaaggaagctttcaacccagctgctcttttcccacacattgatgaattaaagaaattcattaagccagaaatcgttagaattagaactccagatgaaaacggtaaattaccaggtgttcttaacgaattaaacccagttgattacagtat

SEQ ID NO: 20178 - DNA, 366 bp, Anaeromyces robustus
  CotH
caaagttcgtggtaattggacatctaactatgttaaaaaatcacttcgtattaactttgatcaaaaccaaactgttcttggacttaataatggaaataaaattaagagttgggttcttcttgccgaatacaaagatggatctatgcttagaaataaatctgcttttgctatgtctcgtgatattctcggagaagataatctttttgcctctgattctaaattagctgaattatatattaatggtgaatactttggtgtttaccttatagctgaagttcaacaagttaatcaatacagagttaatattactaaaccagaagatggttatcaaggtactgatattggttactttatggaatatgatat

SEQ ID NO: 20179 - DNA, 678 bp, Anaeromyces robustus
  CotH
aaatgactttattagtaattttgttaatggtgcctataagattatgtatgaagctgcctataaccaaaatactttaaaattcactagtgattatagaagtattgttgaagcaccagaattaaccccaagacaagctattgaaaatgttcttgatgctaattccttagctgatatgttcattattagtgaaatgacttgtgatgctgatctttattattctagtttctatgttgttgctgatttcggaccaaaaggttctaagaaacttagatttgaagctccatgggactttgattctgctcttggtaacagagatcgttgtagagatggtcaaggtcactttgctgctaatattgtattagatactagtggttttggtgatagaattaatccatggttagctgttattatttatgaagattggtaccaagatattattagaactaaatggacaaaggcttacaatagtggtgtctttggtaaggttgttgatatgattcatcaagatactaaaactgctgccgaagcatttgatcgtaattacagtgtatgggacaatattagaaataattcaaactttgttaatgaactttcaccaggtgctaaacaatgtaaaacacaacaagaagcagctgactatcttgcttactggatagaagaaagaactgcttttgttaa

SEQ ID NO: 20180 - DNA, 849 bp, Anaeromyces robustus
  CotH
taattttgctagaaccttttctaaaccaggttttaatattaaactttctaaaaaattctatgatagaaaaagtttccgtcttcgtgctgatgttaatgacaggtcccatttaagacaaaaaattgtttgtgatatttccaatagaattggtttaccatctactcaaagtacttatgttagacttactattaatgaaaatttatatggagtatatactttaatggattctgttaaaccagcaaacattaaacaaatttacaatgtcaaaacagataaagaagatttaaaattatataaatgtgatattaatggttttgatatgagttctaaaactgcaaatcattgtcttaatgaaactggtgaagatgaaaaagaaattagtgaatttaaagaatttatgaaacaagttgataatgctaaaactgtagatgatttagataaatttatgaatgttgatattttcttaaaatcaattgctcttgaatggattattggttcatttgatcatttattagttatgggacataatatttatttctataaaaatgaaattaataataaatgggatatcttttattatgattttgataatactcttggtgtatctcttaatgaaaatctttggtttagtactggtaaaaataaaggagttaaagatttttctaaattatcttttaaacaatttactaatgatcaaaaaatttttgatattgctgttaataatgatagtacaagatttaaaaagaatttaaaagaaattttaacttatggttttaatccagttcttttaaatcctcatattgatgatattaaatcttatatttcaccttatgttaaagaagaatttat

SEQ ID NO: 20181 - DNA, 981 bp, Anaeromyces robustus
  CotH
taaaggtagtcgtaactatggtaaaccaggttataatattaaacttgaaaaaggttctatttatgatgtaaaattacttcgtcttcgttctaacattcgtgatgccactttaatgcgtgaaaaattatcttctgatttactttataaaatgggtgttaaaactacctctactaattatgctaatatcatagttaatggtgaagatattggtttatttgttcttactaacaaaattaagaaagatttaattaagaaatatttcaatgataaaactattaatgatctttatgaatgtaaattagattatgctagatttgaagataatagtattattgaacattgtaataatattaaggatgaacttgtagatgataaagatgatcttcaaaatttagttgatgccgttaacaatgctaaatctgttgatgatattaaagatttaattgatattgatgctgttttaactacttttgcctttgaatttgtcactttatcttgggatcatttcttcattcttggtcataattacttctggtataaaaacccacaaagtggtaaatggatgatgattcttaacgatttcgatgaaactttctgtcaagatatttggtcaaattatttcactgatgatagtagatatattagtaaaccatatattccaaaccttgaatatcttaatttaccaaacttagctgttcgtgatatggattctggtcataaacttgttaaattacttatttatgatgatgatactcgttggcgtgaaattcttggggaagtcgttaaaaaggctttcaatccaagtgttcttttcccacgtattgatgaaattgctgaattaattcatgatgatcttgctgttagtcgtgaaattcttgaagaaactggtcgtgctagaggtgtatttaatactgctggttatgatccaaaatggactgttactcaatttgaagatactactaactatattaattgggctgc

SEQ ID NO: 20182 - DNA, 999 bp, Anaeromyces robustus
  CotH
taaatatactaaaattttcgaaaaacaacaatataatattaaaattaataatgatgatttatttggtgtaaagcaacttagattacgttctgaaactgttgacccaagttttattcgttctaaacttggttatgatttatgtaatattttcggtttaccatctattcaagcttcttatactaatctttatattaatgacgatgatatgggtttatatttacttcgtgatgcttataaaagtcattttattcaaactacttttggtgttgctaatgtcactaatctttataaatgtgattctgattttggtaagaataattctttcaactgtgcaactgaagatgaagaaattgttgatgatgaattcaaaaatttcattaaaagaatagaagaagttgaaaaaactagagatgctaatgaactttctaaattctttgataccgaattatatatgaagtggcaagcttacaaatatttagtcggttcatgggatcatattacttatcaacataatcaatatctttacaaacatccaaatggtaaatggatgaatttcttatatgattttgatagtgattttggtgcttataaaaagccaaatcctaacaatacttttgatcaagaaatgctttattatgaatcagcaacaccattctataaaattcttaatattaatgataagaatgaaaaatttattggttatattaaagatatggttattaaaggtttcaatccagtaaaacttattccacgtattactgaagttatggatttcatttatccacatgtattacatgatagaactccagaagaagaaactgaaaaacgtccaggtcattttaagcgtccagaatacaaaattgaaaatggttttaaaatggaagactttttcaaaaattctgaactttataattacgttcttataaaatatgctgataaagaaaactttagtactgataatatttatggtgttaaacgttggattattgaaagatttag

SEQ ID NO: 20183 - DNA, 1008 bp, Anaeromyces robustus
  CotH
tagatcaacaaaattctttgaaaaagtaggttataatattaatgttaaaggtgataatttattatatggagctaaacaaattcgtttacgttctgtcactgttgatccaaccttcatgagagataaattatcttatgatttatttaatatcatgggtataccatgtttatctgctaattatgctcgacttttcattaatgatacttttatgggattatatcttttaagagatgcctataaatctcaatgggttcaaaatacttttggtgaagtagatactaaacatatttataaatgtagtggtggtaaaaacccattctttaattgtgctaatgatgatgaagatgttaccgataataaagattgggaagaattcttagataaattagataaagctaaaactcgtaaagatttagaagaatttttcgatgtagatacctatattagatctcaagtagctagatatttaattggtgctttagatcatcaaagtggtaataataataatgtagtatatatgtatcatgatgttagtgctaataaggatatatggattccacttctttatgattttgatatgaattttggtaatttccaaaaaccaaatactaaacgtacctttgtagaagaaattgttgataaaaataatccattatattccatacttgaacttaataatgaaagtgaagaagttaaaaaaattatggatgaaattatgcgtaaagttttcaatccagtagtacttgttccacgtattgatcaattaagaactttccttaaatcttatgtgaaagaagatcgtactaaaggtgataatggtcgttatccaggtagatttgatattatggctactagagttgaagatttattcacctatagtcatttcaaacataattcagaatttacaaccattgtctctattgaacattataataatttcaatgattttaaacatacctctacggctttaggtcttaaacaatgggttattgaacgtttccaatatgc

SEQ ID NO: 20184 - DNA, 1014 bp, Anaeromyces robustus
  CotH
aagatctactaaattctttgctaaagttggttacaatattaatattaaggatggaaacttatttggtgtaaagcaacttcgtttacgttctgttgctgttgatccatctttcttaagagataaattagcttatgatttaactagagctattggtttaccaactctttctgaaaatttcgctagactttacattaatgataatttcatgggtttatatgctatgagagatgcctataaaactaaatgggttgaatatactttcggtgaaaagaattctactcatctttatacttgtagtgatgcttttggtgataatgctttctttagatgtgttaatgatgaagaagaaatcaatgatcaagatccagattggaatgcctttttagataaattagctaccgttaatactcgtgaacaattagaagaattctttgatgttaaatcttacattaaaactcaagtttcaagatatttatttggttccttagatcatattagtggtactaataataatgatatgtacagaattcatgatgatcttactggtaaggatcaatggattcaacttctttatgattttgatatgaactttggtaatttccaaacaccagatactcatcgttcctttgaagaagatgtcccagaacaaagtaatccaatgtatcaacttcttaatcttaatagtcaaaatccagaagttgttagtgttatggatgaaattatgcgtaccgttttcaatccaaatgttcttattgatcgtattgataaattaaaggcatttattgatccctatgttaaagaagatcgtactccagatgctaatggtaatttaccaggtagattcccattaactattgaaagaccagaagaacttgctacctatgaagactttttaggcaatactgaatttactacaattaaagctaatcaacatttcaataatttcaatgatcataccaatcttcaaaccgctcttggtcttaaacaatgggttattgaacgttttaagtatgc

SEQ ID NO: 20185 - DNA, 1017 bp, Anaeromyces robustus
  CotH
tagttcttcaaaagctttatctaaagttggttataatattaatattaaagatggtgatttatatggaactaaaaaattacgtttacgtgctgaaagtgttgatccttcctttttaagagaaaaacttgcttatgatttatataaaattgttggattaaccacaatttctgctaattatgctaaactttatgttaatgatacttttatgggtatatatgttttaagagaagctattaaagcggattggattagagataattttggagaaaaagatactaaaaatttatttgcatgtgaagaaagtactgaaggtttaaaatgttctcatgacgatgaagatataacggataattctgattttgatgaatttaattcaaaattaatgaaaactaaaactcgtgaagaattagaagaattctttgatgtcgatggttttattagatggcaagctgctaaatatttatttggatctttagatcataataaaggtaaaaatacttttctttatagatttacagatcctaccgctgaaacaaaaaataaggaaaaatggattattatttattatgattttgatatgaattttggtaattatcgacaatcaagaccaaataaaacttttaatgaagaaatgcttaaagattattatccattttatcatgttcttgaagttcttaaacttaatgataaaagtgaagaattaatatcaatcatggatgaaattatgcgtgatgtatataatccaaatattattattccacgtattgatgaattaagaaatcatattgttgattataaacgtgaagattttatccctgatgaaaatggtcgtttaccaggtagacttgaaagttttgaaagatttggtgaagattcttttacttttgaagattttgaaaaaaatattgaatttacaactataaaaacaaatgttcttaataatcaaaatgttactgaacatgaaaccgttagtcgtggacttaaagattggattattcaacgttttaaatttgtttg

SEQ ID NO: 20186 - DNA, 948 bp, Anaeromyces robustus
  CotH
aagatctacaaaaagatatgaaaaattaggttataatattaaagttaaaaaaggtaaattatatgatagaaaacaacttcgtatacgttctgaagccgttgatccttctttccttagagaaaaaatagcttatgatatttgtaatattcttggattaccatctttatcttctaatttcgttaaagtttatttcaataaaagatttatgggtttttatttaatgagagatgcttataaatctcaatggattgaagctacttttggtgaaaaatcaactaaacatttatatagttgtgatggttttggtggtgatcctttctttaattgtcataatgatgatgatgatcttgttaatactgatgaagattttaaaaaattccaagatcgtttagctaaaactaaaactagaaaagaattagaagaattttttgatgttgaaatctttttaaaatggcaagctcttaaattcttattaggttcttgggatcatccagtcgctggtcataataaatttatgtatatgttacatgatgtttctaaaaataaagatatttggattccattactttatgattttgataatgattttggaggttataattatatgcatcctaaaaaaacttttaaagatttaatttatgaaagtagtaatcctatttttgaaattcttgatttaaaagaggatgccaataaagatgttattaaatatatggatgaatttatgagaaaagtatttaatccaaaaattttagttccacgtattgatgaattaaaaaaatttattgatccttatatgaaagaagatcgtactcctgatgaaaatggtaatcgtccaggtagaattccaagaacttttattagaattgaagattatttcacttatgaagatttccaaaaaaattccgattataccaatattactcttaaaaaacatttacgtgctgatga

SEQ ID NO: 20187 - DNA, 1005 bp, Anaeromyces robustus
  CotH
taattcttcaaaaatgtattcaaaattaagttataatcttaatattaaatcaggaacattatttggtagtaaacaattacgtttacgttcagaacctgttgatcctgcttttattagagaaaaattagcttatgatttacatactgttataggattaccatccctttcagctaattttgctaaactttatattaatgatgaatatatgggattttatcttttaagagatgcttttaaatctaaatgggtagaacaaacttttggagaaaaatcaaccaaacatatttataaatgtggaaatggtgataatccattttttaattgttctaatgatgatgaagatatgactgaagataaagaatgggaaaaatttttagatcgtttagataaagctaaaacacgtcaagatttagaagaattttttgatgttgatacatttattaaatggcaagcttcaagatatttatttggttccttagatcatcaaagtggtcgtaataataatgcaatgtatatgtatcataatgttactaatggtaaagatatttggataccattactttatgattttgatatgaattttggtaatttccgtgtacccgtcatacaacgtaattttactcaagaaattgttgatccttataatccattatatgaaattttaaatcttaatgatgaaagtgaagaattaaaatctatatttgatgatattatgcgtcaagtttttaatcctttagtgatgttagcacgtattgatcaattaaaatattttttaaaacaatatattaaagaagatcgtactccagatgcctatggtcatcgaccaggtagatttaatttaaccatgtattttgcggaagatctttatacgtatgatgattttaaaaagaattccgattataccactgtaaaatcaagattatattataataattttaatgattatagtcgttattccgaagctgtaggtattaaacgatgggtcatagaacgttttcaatatgt

SEQ ID NO: 20188 - DNA, 1011 bp, Anaeromyces robustus
  CotH
aagatcatcaaaagcttatgctaaattaagttataatattaacataaaaaaagatcttttatatgaatgtaaacaattacgtttacgtgccgattctgttgatccatcctatttaagagaaaaaattgcttatgatttacataatcttattgatttaccatctctttatgctaattatgctagactttatattaatgataaatatatgggatttttccttttaagagatgccattaaatctagatggattgaaatgatttttggagaaaaggatactaaaaatatttataaatgtcatgaaagtgctactcaaatatttaattgtgaaaatgatgatgaaaaaattacggataataccgatttcttaaaatttgtggataaattaaagaatgttaaaagtcgtgaagaattagaaaaattctttgatgttgaaacttttattaaatggcaagcagcaagatatttattaggatccttagatcatgataagggtaaaaatacggtactttatatgtatcatagaaaagatacggatgtagattattgggttccccttcattatgattttgatatgaattttggtaattataaaattccaaataccatgcaaccttttagtaaagaaattgcttataaagaaaatccattatatcctatttataaattacttaaacttgatgatgaaagtgaagaattaattggtcttatggatgagattatgcataaagtttttaatccaaatgttcttattccacgtattgatcaattaaaatattttattcaaaaatatgtcaaggatgatttaacggaagataaagagggtcatttaccgggtagatttgatatacctgtccatcgtggtgaagatctttttgattataatgattttgaaaagaatagtgattttactaccattgaaaccattcaatatcacaatgattttaatgataaagatttccgtagaacaaccgctcttggtcttaaacaatgggtcattgaaagatttaagta

SEQ ID NO: 20189 - DNA, 852 bp, Anaeromyces robustus
  CotH
taattcttctcgtttaatggctagacaaggatacaatattaaaattagaggtaaaaaagatttatatggtcttactcaatttaaacttcgttctgatgctcatgatgctacttatttaagaacaaagttagtaagtgatattcataaccgtttaggacttacttctatttcagcaagttatgttatattatatattaatgatgaatattatggtcttcacatgataattgaatctataaaattaccatggattaaaggaaaatttgatgatgaagatactccttacttatataattgtagtaaaggtgcttgtttcttaaatccaaattgtatgtacatgtgtgaaaatgaaaatgaagatgttactgataactctgaatttagtgaatttttaaaaagagtagattctgctaactctgctaaagatattgaagatatctttgaaattgatcaattcttatatgaaatggcttatgaatatttattaggtgcatgggatcatatatttattggtcataactttggtttatataaacaaaagaatggtaaatggattatcatttattatgattatgataacgatttcggacaagatcctgtagatgttgaatatggtttagtagaaactaatccaaacaaagattatgccaattacacttttgatgaatggtttaatagaccaatccgtgttgttgatattttactttacaaaaatcaagatcgtttcaaaaagattatgaatgatttcattactaaagctttcaatccagatgttctttacccacgtattgatgaattaaaagaattaattagaccacatgttaaatatgataaaactccagatgaaaatgg

SEQ ID NO: 20190 - DNA, 915 bp, Anaeromyces robustus
  CotH
tggaagatctacaagaagatatgaaaaattaggttacaatattaaaattaaaaaaagtaaattatttgatagaaaacaattacgtttacgtactgatgctgttgatccttccttccttagagaaaaattagcttatgatattagtaatattctcgaatttccatccttatcttctaattatattaaactttatttcaataaaacatttatgggactttatttaatgagagatgcttataaatctcaatggattgaagccacttttggtgaaaaatccactaaacatttatatagttgtgatggttttggtggtgatcctttctttaattgtcataatgatgatgatgaacttagagataaagatacaacctttaaaagtttccaagaacgtttagctaatactaaaactagagaagaattagaagaattctttgatgtggatttatttttaaaattacaagcttttaaatttgttataggtacttgggatcatcctgctaatggtcataataaatcaatgtatttatatcatgatgtttcaagaaataaggatagatggattccattactttacgattttgataatgattttggagcttataatcatatgcatccaaagaaaacatttaaagaattaattattcaaaaaaagaatccaattttcaaattattaggtatggtggaagatgctaatgaagatgttattaaatatatggatgaatttatgagaaaaataattaatccaaaaattttacttcctcgtattgatgaattaaaagaatttcttgatccatatatgaaagaagatcgtattccagataaagatggtaaacgtccaggtagacttcaaagacctttcattagaattgaagattatttcacttatgatgattttgtaaataattgtgaatatac

SEQ ID NO: 20191 - DNA, 897 bp, Anaeromyces robustus
  CotH
tcatttctcacgtaattttgcaaaaccagcatacaatattaaaattcgtggaggtaaagaattatatggtcgtcgtcaatttaaacttcgttctgatcctgctgatccaacttatttaagatcaaaactagtttctgatattcacaatcgtttaggtgttccatctatttctgcaaattatgctactttatatattaatgacgaatatatgggtctctttgttttaactgatgcttacaaagaaacttggattgaatatgtttatggtgaaaaagatactaaattattatataaatgtaatatttctgatttaacttatgaaactagaaatggtttcaaaaatgaaaacaatgaaattactgatagaaaagaactttatgaatttttagctgctatgactacagctcaaactccatctgaaattgaacatattttcgatgtagatcaatttgtaacagaaattgcccttgaatatttaacttctgcatgggaccactttatgaatcaacataattattatatttataaaaattataaaaataataaatggatttatttagcttatgactttgatcttgatcttggtttaaatacttatgaaactgatgtaactactactcaaagtttcgatgaattatcttatccatctttagttgaaaaattaattttaaatgatttcgataaatttaataacactattaaagaaattgttactaatgcatttaatccaggagttcttttcccacatattgatgaattaaaggctttcattaaaccatatgttgaattagataaaacaccagatgaaaatggaaaatccccaggtagaattaatcttaatgatgatatattatttagtatggatcaatgggatgaatcaagtgaatttactgatat

SEQ ID NO: 20192 - DNA, 945 bp, Anaeromyces robustus
  CotH
tacctcagctcgtttaatgtctagacaaggatttaatgttaaaattcgtggtaaagataatttatatggtcgttctcactttagacttcgtcctgatgctcatgaagctacttatttaagatcaaagttagcttgtgatattcataatcgtttaggacttgaatctgtttcagcaaattatgctacattatatattaatgataaatattacggtttttacgttttacttgatgctccaaagttaacatgggttgaagaaaaatatgacgataaagacactccttacttatataaatgtaaatctggtggttgtttcttaagtcaaaattgtgcttatatctgtcaaaatgaaaatgatgaaattactgataattctgaattaatgcaatttttaagaaaattagataaagctaaatcagctgaagaaattgaagatatttttgatattgaaaaattcttatatgaaactgcttatgaatatttatcaggtgcttgggatcatttacttcacggaggtcataactttagtatatataaacaaaagaatggtaaatggactattatttattacgattttgactctgatttaggtcaagatccagtaggtgttgaatatggtatagtcaatactaatccagataaagatttcccaagttatacctttgatgaatggatgagtattcctattcatcttttagatattttagtttacaaaaatcaagatcattttaaggaaattatgaatagatttgttactgaagctttcaatccaaacattctttacccacatattgatgaattaaagaaatttattagaccatatgttgaatatgataaaacaccaggtgaaaatggtttaaacccaggtgttattaaccttcttaatacagtagaatatactcttgaagaatggaatgttaatagtgaatttactacaatttctag

SEQ ID NO: 20193 - DNA, 888 bp, Anaeromyces robustus
  CotH
tagatcaacaaaatcttattcaaagttaggttataatcttaatattaaaggggatgaacttttatatggtactaagcaattacgtttacgtgctgaagttgttgatccaactttcataagagataaattaggttatgatgtacataatttccttggtttaccaactctttctgctaattatgctagactttacattaatggtaaatttatgggactttatcttgtaagagatgctttcaaatctcaatggattaagaataattatggtgaagaaaatactaaacatttatatgaatgtgaaaaatcttatggtcagagtactatatttaattgtagaaatgatgatgaaaaaattaaaaatgatccaaattggacaacctttattgaaaaattagaaaaagccaaaacacctgatgaaataaaggaattctttgatgttgatacctttataagatggcaagttgctagatatttatttggttcatgggatcataatagtcatggacataataatgttctttatttatatcatgatactactactgataaggataaatggattccattcctttatgattttgatttaaattttggtaattatagagatactaaaccagatattacattcaatgaagttgttgttgatactaaaaataaattatattctattcttgaaattaatgaaactaatccacttattctttcacttatggaagaatttatgcaacaagttttcaatccacttttcctttttactcgtattgatagattaaaagtattccttaaaagttatgtaaagaaggatcgtacagctgatgaaaatggtaattatccaggtagatttgcaagaatgggtaatcatgttcaagattcttttgattatgaaga

SEQ ID NO: 20194 - DNA, 1035 bp, Anaeromyces robustus
  CotH
tatgtatgctcgttccaacagtaaagttggttataatatgaaacttggagaaaaaatattcggtagaaagaatttaagattaagaccagatccaaatgataaaagttttatgcgtgaaaaactttctactgatattttaaatagagctggtttaccatctgttcaatcttcttatgctagactttttattaatgatgaatactttggtttatatactattcttgattctgttaaaccagctatgattaaaaaggtatttaaacttgatgatgaaacggataatatgattctttaccaatgtaaatatgatggtatggacttttccgttggtagtgaatctcattgtattaatgctgttgatgaagaaactaatgatatgacacaattaaaagattttattcaaaaggtcaattctgctactactattgctcaatttgaagaatttttagatgttgatttattcttaaaatctgttattgtcgaatggcttattggttcatttgatcactttttaattttaggtcacaacttcaatttatataagagaccaactgatggtaaatggtgtattattctttacgattttgataatacctttggttacaatttaaatgctggttcatttaatgtcagaagaaataacaatcaaggtaataatggtttcggtggttttggtaactttggaggatttggaggatttggtatgagtaatattgattacaatactttgaatttccaagaattcaattctaaggttaaccacaaaatcttccaatatttaatttatcaagatgatactaaatttaaagctcttcttaaagatgttttagtttacgcctttaatccaactcttttaggtcaacacattagtgaattaaaaactttcttagctccatttgttgaagaagatttaactccatatgatggtgtacttccaggtagaattaaccaaagtggttatggttcaaaagctacttataatgatttcattaataacactgaacttgaaacctatattaaaaatagatttgaagc

SEQ ID NO: 20195 - DNA, 879 bp, Anaeromyces robustus
  CotH
taaatcatcacgttattttaataaacccggttataatattaaaattcgtggtaaagaagatttatatggtcgtactcaatttaaattccgtccagatgctagtgaaccaacttacttaagaagtaagttagcttctgatattcataaatcattaggcattaaaggtattagcagtaattatgctactttatatattaatgatgaatatttgggtttatttattattagtgacacttataaattgtcttggattgaatatgaatatggtgaaaaggatactacttcattatataaatgtgaaagtaatttagaatcaaattatcaatctaactcatttataaatcaaaatgaaaatattactgatttaactgaaattatggaattattgaaaacatttgatgaagcacaatctgctgcagatattgaaaatatttttgatgttgacaatttcctaaaagaacttgctattgaatatttattaggtagttgggataactttaataacgccaataatttcttcttatataaacaacctaatggtaaatggatttatttaacttatgattttgataattcctttggtgcaaatttagatacactgtattgtggagttatatatgttgatttcccagaacgtatggctgaatgtattaaggatcatctaattgatactgttgaggaatactttaaaccattatttaaagttgaagttgcccacatgattgatattttaattttgaaagatccatcccgttttgaaaagattttgtcaaatattgttaaaaaagtatttaatccagccactctttatccacatattgatgaattgaaagaattaataaaaccatttattgaaaaggaaaaaattcgtaacaaaaa

SEQ ID NO: 20196 - DNA, 918 bp, Anaeromyces robustus
  CotH
taaatctacaacttcatttacaaaaccaggttataatatcaaaattaaaggtaaagatcaaactttacatggtactaaaaactttcgtttaagaagtgatcaacgtgatgtttcaatgatgcgttctaaaattactactgatattttacaaaaaagtggtttaattgccactgaagtgggttatactgaattatacgttaatgatgaatatatgggattttgggttatatcagactctattaaaaataagtggattaaaagaaaatttggcgacaatggagaagaaatcaaaacattatatgaatgtaatggagacgaaattagatttgataatggatctgccaaaacaaaatgtgttaatgctaataaagaatactctgattatatggaaccatttcataattttgttgatcaagtaaatgcagcaaagacaagagctgaattagaagaaattatggatgttgataactttataaaatatatggcatgggaatggttaatgggttcatttgatcatttcttaagttggtatggtcataatttatattggtatcaacaaccaaatcaaaaatgggtttatattccatatgatcatgatattgaattaggtcaagatgaatatattggtttctatccaaatagaacctttaatcatggtcgtgatattgattttgcttttctttcatttaaagattttgaattagatcatccaattattcaaattttagtcaatgatgatgatactaatttccgtcaattacttggtgatattattagtaaagtttttaatcctgataccttacttcttcatattaataaaattagagattttatttcaccatatgttaaaaaagatagagaaagtggtgctggaaaaataaataaaatcggtagagattctagattcacctatgaaca

SEQ ID NO: 20197 - DNA, 882 bp, Anaeromyces robustus
  CotH
atattcaagtcatagttatggtaaacaaggttttaattttaaaattcatggaaataaagtattatatggtcgtaagcaatttcgacttcgttcagatgcacgtgaagcaactttcttaagatctaaattagtttgtgatatacaaaatcgtttaggaattccatctatttcagctaattatgctacattatatattaatgatgaatatatgggactttatgttttaatggatatatatagaccatcatggataaaatatgaatatggagaaaaagatacaaaaacattatatcaatgtaaatctactggtaattttttaactgttgaaaaatctattaatagttgtattaatagaaatgatgaagtgaaagatcattctgaatgggttaaatttattactagtttaaataaagctcaaacagttgaagaaattgaatctatttttgatgttgatctttttttaacacaaatagcccttgaattcttatttggatcatgggaccattttcttaattatggtcacaattactatttgtataaaccagttaatgataaatggaaatatttatcatatgattttgatgctgaatttggtcaagatcttgatcttcctttctttagattcatttatgaggatatgccagaattaatgataaattttaatacagattatccaaaatattcttttggaaaatggactaaaaaaaatcatttaatagaaattttaattttaaataatcctggacgatttaataaaattttaaaaaatattgttacagaagtttttaatcctactactcttttttctcatattgatgaattaaaagaatttattagaccatatgtagaattagataaaattccagataataatggtaaata

SEQ ID NO: 20198 - DNA, 705 bp, Anaeromyces robustus
  CotH
aatgtatgctcgttcaaatgataaagttggttttaatattaaattacctaaaaaatttttaggtcgtaaacaaattagattaagaccagatccaaaggatttcactcatatgcgttcaaaactttcatgtgatattgctaatagaattggtttaccatctattcaagctgcttatgcaagactttacatgaataatgaatattggggattatacacattaatggatactattaaaccatcttgggttaaacaaacatttaaaccttttgctgaagaagttactactttaattcaatgtaaatatgatggtatgacaatggttactggatcagaatctttatgtcttaatgctaatgatgattatccagatatgtctgccttttctcaatttattagtcaagttaatagtgctaaaactactagtgatcttgaaaaaattatggatgttgacgttttcttaaaatttatggctatggaatggttaattggttcattcgatcatttcttagttttaggtcataatttctatttctatcaaagagaaagtgataaaaaatggttaattattgaatatgattatgataatacttttggttgtggtttacaattcccaatgtattggaataatagaaaaccagttgctaaccaaaataatcaaaataaccaaaacaatcaaaataatcaaaataatcaaggaaaccaaca

SEQ ID NO: 20199 - DNA, 1005 bp, Anaeromyces robustus
  CotH
tagttcatcccgtcatttttctaaacaaggtttcaatattaaaattcgtggaaatcaaaatttatatggtcgtactcaacttagacttcgtccagatgttcgtgaagctactttattaagaactaaattagcttgtgatattcaaaatcgtttaggtcttccatctgtttctgcaaattatgctaaattatatcttaatgatatttttatgggtttctatgttttaactgattctattaaactttcttgggttgaaagtgtttttggtgaaaaagatactactgatttaattcaatgtggtgctatggaaaatgatttatcctatgaatattctattgatggttgtaccaatttaaatgatgatgttactgataatactgaatggggagaattattaaaggcatttgataatgctcaatctattgaagatgttgaagatttctttgatgttgatactttcttaaagaatattgcttttgaatatttaactggttcatgggatcactatcttaattatggtcataatttctatctctttagaccagctggtgataaatggaaattcttattatatgattttgatggtgaatttggtcaagatttagctcaaggtgttggtaaaagaggtgctgtcataactgattataactatgctcgtttcccatttaataaatggcataaagatcgtcacttattagatattttaatctataaaaattctactagatttgataatattcttaaacaagaagttattgatgcctttaatccagctgttgttttcccacatattgatgaattaaaaaaatttattaaaccttatatcattgaagattatactccagatgaaaatggtcaattaccaggtagaattaatttaagatctcaaaatcgttataatcttactcaatgggatgctaattgtgaatttactactgttttaactactaattataattctgcttatggtcttaagatgtggttccttgaaagatatagatttgt

SEQ ID NO: 20200 - DNA, 1005 bp, Anaeromyces robustus
  CotH
tagatcaactaaagcttattccaaattaagttataatattaatattaaaaatggtggacttttatttggttgtaaacaattacgtttacgtgctgaagttgttgatccttccttccttagagaaaaaatggcttatgatttacataatgttattggtttaccatctctttccgccaattttgcaagattatatattaatgatacttttatgggattttatcttttaagagatgcctttaaatctcaatgggtagaaaataattttggtgaaaagaataccaaacatatttataaatgtgatgaaggaagtcatagtatttataattgtaaaaatgatgatgataatattgatactaataaagataaagattataagaaatttatagaacaattagataaagctaaatctcgtgaagatttagaaaaattttttgatgttaaaacttttattagatggcaagccgcaagatatttatttggttcttgggatcataaaaccaatggtcctaataatgttatttatctttatcataataccgttaccgaaaaagatatgtggataccacttctttatgattttgatatgaattttggtcatactcatactaaaaccaatcgtaccttttcagaagaaatttatgatcccaataataaattatttaccctactaaaacttaatgatgaaaatccagaaattctttcacttttacaagaatatatgaaacaagtatttaatccattagttttagtcactcgtgtgaatcaattaaaagtatttattgaaaaatatattaaagaagatcgtacacccgatgctgaaggtaaattaccaggacgttttgataaaacatttaaatcggttagagatacttttgattataatgattttaaaaaaaatacggaatttacaacgataagagctaaacaatataattctaatattgaatatgataccaccataattcttggtataaaacaatggattattgaacgttttaaatttgt

SEQ ID NO: 20201 - DNA, 822 bp, Anaeromyces robustus
  CotH
gaaatataccaaagtatttgaaaaattaggttataatataaaaattaaaaaaggtatgctttatgaaagaaaacaatttcgtcttcgttcagaatcagttgatccatcttttattagagaaaaattatcatatgatatttgtaatttaattggattaccatcactttcatcaaattttgctcgtgtttattttaataaaaaatttatgggtttgtactcggttagggatgcttttaaacctcaatggattgaatatacttatggtgaagcttcaacaaaacatttatatacatgtgattcttcctatggtaataatgcatatttcaattgtaaaaatgatgatgatgatattaaggaagataaagaatgggataattttataaaacgtttaactaaagttaaaaatagaaaagatcttgaagaattctttgatgttgaaacatatatgaaatggcaagctattaaatatttatttggctcttgggatcatgtaacaaatgcacataatcaatttttatatatgttccatgatactacatcaggaaatgataaatggattcctttactttatgattttgatagtgaatttggtgcatataaagatcctaagcctcgccgttctttttacgatgatactcttgattcttataatcctatttataatattcttgaattaaatgacaaaaatgaagaattaatatcatatattgataaatttatgagagaagcatttaatccattgaaattgataccacgtattgatcaattaaaaactttcctttcaaaatatgttaaggaagaccgtactccagatgaaaatgg

SEQ ID NO: 20202 - DNA, 843 bp, Anaeromyces robustus
  CotH
tggttcttcacgtaattatgctaaacaaggttataatattaaaattcgtggtaataaagatttatatggacgtactcaatttaaacttcgtcctgattctcgtgaagccacttatttaagatcaaaattagtttgtgatatgcataatcgtttaggacttccatctatttctgctaattttgctactttgtatattaatgatgaatatatgggattttatgttttacttgattctattaaattacgatggattgaagctgtatatgatgatccagactccacttctttatatgaatgtaaatcaactagtaatcaattaactgttgaatcttcatcagaaggatgtgttaatgcaaatgatgaagtaaccgataatactgaatggatagaatttttaactgctttagataatgctaaatctccagaagatattgaagatatttttgatattgatcttttcttaactgaaatagcttttgaatatttatctggttcatgggatcattatctttattttggtcataattatgatgtatataaaccaaaaaatgataaatggaagattttatataatgattttgatgctgaacttggtcaagaagttgtttttattgaagatacagttcaaaatgctaataaaaatagagattattattcttactcttttgaagatttcgctgctagaaaaactcatcttcttgatattttaattttccagaatactactcgttttgataatattcttaaaaattttgttactaatgctttcaatccaacaattcttttcccacatattgatgaattaaaagaatttattagaccttatgttgaattagataaaat

SEQ ID NO: 20203 - DNA, 909 bp, Anaeromyces robustus
  CotH
tggaaattatgctagatctttcagtaaaccaaatttcaatattaagcttccaactgaatacaataacagaaaaaattttcatcttcatagtagtgttaatgataaatcacacattaaacaaaaacttgtatgtgatattcttaatagggttggtttaccatcgactcaaagtacatttgttagacttacaattaatggaaacttatatggattatatactttaatggatactcctgaaccaagtaatatcaaaagactttataacaccaaaaaagatgatttaaaaattattcaatgtaaatatactggatttacatttacttatggtactgcaaattactgtgttagtgatgatagtgatgataaatcaaatatacaagagtttaatgaatttttagcagaagttgataaagctcaaacaattgaggacttggaaaaaattatgaatattgatatatttttaaaatacattgccattgattggattattggatcctctgatcatttattaatcaatgggaataatgtctatttctataaaagcgaaattaataataaatgggatataatttattatgattttgataatacatttggtcaaggtattggtgattgggtttggactaatggtaaaaataaagatattaaggagtattataaattatctttcaaacaatttactaatgaccaaagaatttttgatgttgctgttaataatgatgatactagatttatacaaaatcttaaagatattttaacttttggttttaatccagtccttttaaatttacatattaataatatcaaagaattaattgatccatatattagagaagaattcacttctgttaatgatcaattaccaggtagaattaataaaaaaggtttatctatggagtcatcctatga

SEQ ID NO: 20204 - DNA, 858 bp, Anaeromyces robustus
  CotH
tagttcatcacgtatatttggtagacaagcattcaaccttaaaattcgtggtaaaaaagatttattcggtcgtaaacaatttagaattcgttccgatgctcgtgaagctacatatttaagatctaaattagtttgtgatatgcataatcgtttaggacttacttccatttctgctaattacatttcattatatgttaatgacgaatacattggtatgtatattttaatggatgctccaaaggtatcatgggctgaattagaatttggtgatgaaaatactggtaatttatataaatgtaaatctggaggtaatgctttaactgttaaatcatgtgctactggttgtacaaatgaaaatgatgaaattactgatactactgaatgggttgaatttttaactgctatggataatgcacaatctgctgaagatattgaagatatttttgatgttgatcaattcttatatgaaattgcttttgaatatttatctggttcatgggatcattttgttaatactggtcataatttcgatatgtataaaaacccaaaaactggtaaatggactattatttattacgattttgatggtgaacttggtcaagatgttaatagtattaatatgtttggtcaaggaaatcaagattatccatcttatactttcgaagaatatgctaacagaaagaagcatatctttgatattttaattttcaatgatccaactcgttttgaaaatattcttaagaatttcgtaactgaagttttcaatccagctactcttttcccacatattgatgaattaaagaaattcattaaaccacatattattaaggataaaactcctgatgaaaatggaaaatg

SEQ ID NO: 20205 - DNA, 963 bp, Anaeromyces robustus
  CotH
aggaaataattcacgtttatatggtaaaccagcttataatttaaaaattcacgatgataatttatatggtcgcaaacaatttaaacttcgtgctgacggttcagagccaacatatttaagaacaaagttagtttctgatattcatgatcgattaggtattccttcaatttcaacaaattatattacattatatattaataataaatatatgggattatatttattaattgatgcttttaaaccatcatggattgaaaaatcttatggagatgctgatacttcatcattatatcaatgtgaatatctttttgactttaatccagcttatactgatagttgttttaatgaaaataaagatgtagaagatgatagtgatttattccaatttttacatgatgtttacagggcaaaatcatctgcagatcttgaaaatatttttgaaattgatcatttcttaacagaaatggctatagattatttattaggttcatgggatcacgttcataatcctacaacaggtcataatttctatttatataaaaagaaaaatggtaaatggatttatttatcctatgattttgatttagattttggtattccacgtgatggttatattagtatatcatttgaacaatttacaaaacaattaaatattattgatgttttgattttaaaagatccaacacgttttgaaaaaattttaaaatatgtagttgataaagtatttaatccagcaatacttttcccacatattgatgaattaaaaaactttattaaaccttatgtaaaagctgataaaaccccagatgaaaatggtgaatatccaggtagattgaatactaaagctactgatttatattcattagaagtatgggatgctgctagtgaatttacaagagtaaaaactaaatataattatacatatggtttaaaatattggatactttatagatatagatttgt

SEQ ID NO: 20206 - DNA, 843 bp, Anaeromyces robustus
  CotH
tagttctgctcgtacctatggtagacaaggatttaacttaaagattcgtggtaaggataaattatttggacgttctcaatttagaattcgttctgatgctcgtgatgctactactatgagatcaaaacttgcttgtgatattcataatcgtttaggacttgtttctatttctgcaaattatatgcaattatatattaatgatgaatatttaggtttttatattttaatggattctccaaaattaccatggattgaagaaatatatggtgaaaaggatactcctaatttatataaatgtaaagcaggtggtcatttcttatcagaagaaacttgtgctgtaagatgtgaaaacgaaaatgatgatattacagataaaaccgaatggattaaatttttaagagcattagataatgctaaaacaccagaagatattgaaaaagtacttgaagttgatcaattcttatatgaagttgcttatgaatatttatccggtgcatgggatcacttaattcgttcaggacataattacagtttatataaacaaaaaagtaatggtaaatggattatttattattatgattttgatgctgattttggacaagatattgtttctattgaatttggtcaattcaatccaaatccagataaaaattttccaaattatacttaccaacaatggtttaatgtacctatgaacgttcttaatattttaattttcaatgatccaactcgttttgaaaatatcattagaaaaattgttactgatacttttaatccagcaactcttttcccacatattgatgaaatcaaaaaatttattcaaccatatattaaacaaattaa

SEQ ID NO: 20207 - DNA, 969 bp, Anaeromyces robustus
  CotH
aaaaaattcacgtcaatattataaaccaggatataatataaaaattcgtggtggtaaaaatttccatggtcgtaatcaatttaaacttcgtgctgacgttactgaacctacacgattaagatccaaattagcattagatatttacaatcgttcaggattactttcaatttcagcaaattatgcaattttatatattaatgatgaatatatgggtttatatattctaacggatatttataaaaaatcatgggtggaaagtgtttatggtgaaaagaatacttccaccttatataaatgtgaaaatggaagttttttatctttagaaacagttaaaggttgtgtaaatgaaaatgaagatgttaaagataatacagaacttattgaattagtaaaaactttagataatgccaaatcagaattagatatcaaaaatattttcgatgttgattatttcttacattcaatggcaattgaatatttactaggatcatgggatcatattttaaatggtcataattattatatgtataaaccaaaaaatggtaaatggctatatttaactcatgactttgattatgatataggatatacggatacaaatgattataattataaagattattcaatctcaaaattttttgttgaagataatcctcttccctttataaaaattctaattttagataatccagttcgatttcaatatattttaaaagaaattgttgaaaacgtctttaatccatccattctttttcctcatattgatgaattaaaagcatttataaaaccttatattgaattagataaaacacctaatgaaaatggtatattacccggtcaatggaatatgaataataaagatagaggaatttataccctagaacaatgggatgcatcaagtgaatttacagttgtccaaaatcatgtttatgggttaaagtattggattcttgaaagatatagaaatgt

SEQ ID NO: 20208 - DNA, 918 bp, Anaeromyces robustus
  CotH
aaaatcatcaactgaattctccagaccaggttacaatattaaaattaagggaagtgacaaaactttacatggtactaagaatttccgtttaagaagtgatcaacgtgatccaacttatatgcgtactaaactttctactgaagtcattcaaaaaagtggtttaattgctgttgaagctggttacgttgaactctttgttaatgatgactatatgggattctgggttatctctgattccattaaaaagaattggcttaagagaaagtttggagatgaaagagaagaagtcagaactttatatcaatgtaaagctgatggaattagattcgatgatggtactgccaagtctaaatgtgtaaactctaatgaagatattgctgattatatggaaccattctatacctttgttgatcaagttaatgctgccaaaactagagctgatttagaaaaaattatggatgttgataacttcttaaaatacattgcttgggaatacttaattggatcatgggatcacatcttaggtccatttggtcacaatatttattggtaccaacaaccaaatggaaaatgggtttaccttccatacgattttgatcttgatttaggttcatgtatgtgggatgatcaattcagtattaaatcctactttaagggtgaaggtgaaattgatttcccagctatttccttcaaagattttgaattagatcatccaattattaagattttagttcatgatgatgatactagattccgtgaattacttggtgatgttgttagtaaggttttcaatccagatactttacttactcgtattgaagaacttaaagaatttgttgctccatacgttaagaataatattgaaactggtgctggtaaaattaacaaaatctgtccaaagcaatgcctctggactta

SEQ ID NO: 20209 - DNA, 912 bp, Anaeromyces robustus
  CotH
aagttcttcacgtatttatggtagacaagcttttaatcttaaaattaaagataaaaaaaaggatttatatggtcgtaaacaatttagaattcgttctgatgctcgtgaagctacttatttaagatcaaaattatcctgtgatatgcataatcgtttaaatcttttatctattgctgctaattatatgttattatatattaatgatcaatattttggtatttatattataatggatgctccaaaagaatcatgggctaaattagaatttaatgatgaaaattcaaaaaatttatataaatgtaaaaatggtggagccattttatccgggatatcaacagcgaatacttgtaaaaatgaaaatgataaaattacggagaattcggaatggcttgaatttttagatagggttgaaaaagctcaaagtccagatgagattgaagatatttttgatattgatcaatttttatatgaattagtatttgagtatttaaccggttcatgggatcattttcttaatgctgcccataattttagtatgtataaaaatccaaaaaatggtaaatggaccattatttattatgattttgatgcagatataggtcaagatgtttatagtatagaaatggatttaaatcctagttctaatgataatgatcataataaacctaatgttaaagattatatagaatgtacttttaaagaatgggccaataaacctcctcaatggactaatcaatcacgtcatattcttgatcttttagtttttaataatactacacgttttgataatatacttcaaaaatttgtaaaggaagtttttaatccaagtactctttaccctcatattgatgaattaaaaaaatttataaaacctcatatattaaaagataaaactccaaatgaaaatggaaa

SEQ ID NO: 20210 - DNA, 1023 bp, Anaeromyces robustus
  CotH
tggtggtgatttctcaaagaattctgctaaattgggttataatattaaatgtaatagtggtaatttactcggaagaaaaatattccgtcttcgtgcaaatatcaatgatgcttctttaatgcgtgcaaaactttcatgtgatgttttaaatcgtttaggtcttccatcaatttcagcaaactatgttcgtcttttcattaataaagaatttatgggtttatacttacttcttgatgcttataaaacttcatggattaaaaaggtttatgatgatgataaagaagttgaaaatctctatcaatgtaaaacaatgaattctgatttaactactaataacattcgtttatgtaaaaatgctaatgatgattatgctaataaaactgatacattagaagaatttattactagtattaataaagctgaatctcgtaaagatgttgatgatcttatgaatgtcgataattttgttaagacatggatttttgaatggctcgttggttcatgggatcatactttatttaatggtaaaaattatttcttatataaaccagttaatgataaatgggaagttcttctttatgatttcgatattacatttggtaaagatttagcaatggtattaagaggtaatcaaaatggtgatgcatctattatacctttcagtgaatggcatagaaaacgttatattgttgatgttttaatagaaaatgatgaagaaacctttattaaaaatcttcaagaagttatcaatactgcctttaatccagatgtacttttcccacatattgatgcccttaaaacttggcttgcaccttatataaaagaagatcgtacacctgttgatggtaaattaccaggttatattaatgataatgcaatgggtggtttcggtggtttcggtggtaaagaagatactaaaaaggttggttttacctatgaagaatttgaagaaaatgttgaagatgtttatattaatggtggtgtaggtattaaaaaatggattcaagatcgttacaatttcgt

SEQ ID NO: 20211 - DNA, 861 bp, Anaeromyces robustus
  CotH
aggtacttcttctcgtgaatttggtaaacaaggttataatgttaaaattcgtggtggtgaaaatttatatggtcgtacacaacttagacttcgtccagatgttcgtgatgcttcatttcttagatcaaaattagtttgtgatattcataatcgtttaggtgtaccttctatctctgctaattatgctctcctttatatcaatgaggaatatatgggtgtttatgttttaatggatgccattaatttatcatggatagaatttgaatatggagataaagatactactactttatatcaatgtaaaaatactaaacaaaatttaactcttgaagcttctagtactggttgtgaaaataaaaatgaagatgttactgataattcagaatggattaaatttttaactgctttagataaggctaattctatggaagatattgatgatattttagatgttgatcttttcttaacagaaatagcttttgaatatttagttggatcttatgatcatttcactaattttggacataatttttatttatataaaccaaagaatgataaatggaaaattatattatatgattttgatagtgaatttggtcaagaagttgctatgggttataatagagttagaaaagaacaaaatattactagttcagaatattatgcttattctgtagaacaaactgtaagaagtgtacaacgtccacttcttgatgttttaattttcaataattctactcgttttgataatatacttaaaaattatattactaaagtttttaatcctgctactcttttcccacatattgatgaattaaaagaatatataagaccttatgtagaattagataaaactccaaa

SEQ ID NO: 20212 - DNA, 870 bp, Anaeromyces robustus
  CotH
tttttcatcaagattttacccaagacaagctttcaatgttaaaattcgtaatgacaaattatacggccgtaaacaattccgtattcgttctgaagctagagaagctactttcttaagatctaaacttttctgtgatattaacaatcgtcttggtcaaccagattctgtttcagctaattacatgaaaatgagtattaatggtgaagatttaggtttttatgttgttatggattctttaaagatgacatatgttaaaattgaacatgatgatccagatactactaatttaattaaatgtggtgatcttcactctgatttaactgctaatagtattaaatcctgtgaaaatgaaaatgatgataacccagatatgactaacttccgtcaattacttagtacacttgacagagctaatagagttgatcaatttgaagatatctttgatgttgaaacctttatgaaagctgttcttatggaatggcttactggttcttgggatcattatactttatatggtcataactttagtatgtacagaccaccaaatggtaaatgggaaatagttttatatgatttcgatgctacttttggtcaagatctttcttccggttttatgtttggtaccccaaaaggtattagtagtaataatatagatacttggactaaggcaaaattcgaagattggcatggtggtaaacatgttattaatgttattttacaagatagaccagaaatctttagaaaatgtcttcaggaaattattactactgctttcaatccaaaaattttatttgatcatattgataatcttaaggaatttattcgtccatatgttgaagaagataagaaaaacttaccaggtagaatgaa

SEQ ID NO: 20213 - DNA, 891 bp, Anaeromyces robustus
  CotH
gcgttcaaagattgccatggaattattatatcaatggaatatgccaactcttcaaagtacttatgtcgaattgtatgttaataatcaatattttggcttatactatcttcaaaattctcttaaaccaaattggatcaaaaaattttatgaacgtccagatgatgaagagatcactgatcttttcaattgtaaaaaagatggtgctaacatggatttaaaaactgttgatcattgcttaaatgccaatgaagattattctaattatactgaaccacttgaagaagctttctctaaaattgaaaaagctacatctattgaagaattagaaaaaattatgaatgttgatctttttatgaagaatatagcttttgaatatttattaggatcttatgatcattatattattcatggtcataattattttttttacagaaagccagacggtatatgggatatgattttagttgattttgataatgaatttggtaatggtttgtttactacttggtcatttattttacaacgtgatgcttctatcgaccttactaaaataaaatttgaagatatgccaaaaccaggaaagaaaattcttgatgttacttactttaaggatcaaactttatttaagaaagctcttcgtagacttttagttacaggtttcaatccagattttctttttaaacgtattgatgaacttaaaaaattaattacactatacgttgaaaaaactcttactccaaatgctgatggtacttatccaggtgctattaataaaaaaggtcaaccaagttctcatactttacaagattttgaagaaagttttattattgataatccaaaagatcaaattaatattggtcttaagacttggattcaaaagagatttgaatt

SEQ ID NO: 20214 - DNA, 807 bp, Anaeromyces robustus
  CotH
tagatcttccaaagataattcaaaattaagttataatattaatattaaaaatggacttttatttgaaacaaaaaatattcgtttacgtgctgattctattgatccaacttatataagagaaaaacttgcctatgatttccataaactttttgaattaccaaccattaatgctaattatgctagattatatattaatgatgaatttatgggattttatattttaagagatgctattaaaccaaaatggatccaagataattttggagaaaagaataccaaaaatatttataaatgtcatgaaagtgccgttcaattatttaaatgtgaaaatgatgatgaaaaaataactgataattcagactttgaagaatttattgaaaaattacaaaatgttaaaagtcgtgaagaattagaagaattctttgatgttaaaacttttattagatggcaagcagcaagatatttatttggatctttagatcatgataaaggtaaaaatacagtactttatatgttccataatgaaaataagaaaatttgggttccacttcattatgattttgatatgaattttggtaattataaaattccaaatgctaaaagaacttttacagaagaaattgctaataaatcaaatccattatatccaatttataaacttcttaatcttgataataataataatgaagaattaattagtattatgaatgatatggtaaccagttattataatccatttattgttttcccacgtattgataaaataaaacgttttattgctgattatgtttatgaagatcatactcc

SEQ ID NO: 20215 - DNA, 885 bp, Anaeromyces robustus
  CotH
tggatcaatatcacgtctaggtagtaagcctccacttaatcttaaaattcgtggtaaaaaggatttatatggtcgttcacaatttaaatttcgttctgatgatgcagacccttcctttttaagaacaaaattagttgctgatattcataatcgtttaggtgttccctccgtttcagcaggttatgttactatatatattaataatgaaaatatgggtttatatatattaaatgatgcctataaattatcatggattaaatctgtttatgaagaagaagataccacatctttatataaatgtgataatctttctcaattagttccacttgattcttacggttgtgaaaacgaaaatgaagatgttgaagattatacagaattacaggaaattttaaaacttttaagagaagcaaaaactgtttctgaacttgaagatgtttttgaaattgatcatttcttaactgaaatggctattgattatttattaggttcatgggatcatacaaataatttaactaatgaacataatttttatttatataaacaacctaatggtaaatggatatatttatcctttgattttagtaatgattttggtatggttcttggtaatccttttggtattcatccaataaatcaaactttttatgaatatgctaaaaaacttgatatttttgatactttaatttttaatgattctactcgttttgaaggaataatgaaacaagtaatggaaaaagttataaatcctgctactctttattctcatattgatgaattaaaacaatttattaaatctaatcttcaattggaaaaaacctctgatgataaaggtaattatccaggtagattaaataaaaatagtcaatatttctatagtatgga

SEQ ID NO: 20216 - DNA, 1023 bp, Anaeromyces robustus
  CotH
taaatcatcaacagaattttcaaaacctggttataatattaaaattaaaagtggtgataataaatcattacatggtacaaagcattttcgtttaagaagtgatcaacgtgacgcttcaatgatgcgttcaaaaattactactgatattttacaaaaaagtggtttgattgctgttgaagttggttataccgaattatatattaataataaatacatgggattttgggtagtatctgattctgttaaaagtaaatggattaaaagaaaatttggaaataataataatgaagatattaaaactttatatcaatgtaaagatgattctattagatttgatgatgaatcagcaaaaaataaatgcgtgaatgcagaaaaatcatatgctgactatatggagccatttaataattttgttgaccaagttaatgctgcaaaaactagagctgatttagaaaaaattatggatgttgataactttattaaatatatggcatgggaatggttaatgggttcctgggatcattttttaggtatatatggtcataatttatattggtatcaacaacctaatggtaaatgggtttatattccatatgatcatgatattgaattaggacaagatctttggacaaaattttatcccaataaaccatttaatcatatggaagatattgattttactaatgtttcttttaaagattttgaattaaatcatccaattattaaaattttaattcatgatgatgatactattttccgtgaattattaggtgatattattagtagagtttttaatcctgatactttattaattcatattgatgagattaaaaaattaatttctccttatgttaaaaaagatagaaacaataattcttcaaaaataaataaacgtggtaaagatttaggatttacttatgaacatttccttttaaattctgaatatacctatattaataattatattaaaggatttaaaggttatggtcttaaagattggattcgtcgtcgttatcaatttgc

SEQ ID NO: 20217 - DNA, 969 bp, Piromyces finnis
  CotH
tggtaaatcctcaaaaagtaaaccaaaattaggctacaacattaaatgtgataagggtaatttatttggaagaaaacatttccgtattcgtccaactgtagaagatgcttctttccttcgtagtaagctttcatgtgatattttaaatcgcttagatgtaccatctatttctgctaattatgcacgtgtattctttaatgatcgttttatggggctctacattatcatggatatctacaaaaaatcatgggttaaacaagtttatgatgataagaaggtttccactctctaccaatgtagtacagcaggctctgatttcactatgaataatgttaatatctgtgttaatggtaatgatgatcttgatggtgaaatgcaatcattagaagaatttattactactattaataaagctcaaacccgtaaagatttagaagacattatgaatgttgattattttgtacaagtttggatttttgaatggcttactggttcatgggatagttcattaattgatggtaaaaattattatttatataaacaaataactaatggtaaatggactattcttccatacgacttcgattctacttttggtccaaacatgggtagaggtcatggaagtgacaatgttttatttgaaaattattacaacccacgttatattgttgatgttttaactaaaaatgatacaaccacatttattaagaatcttcaatatgttttagacacagcctttaacccagatattcttttcccacatattgactcattaaaagaatggctttatccatacgttgaagaagaccgtactccaatcaatggtgtttatccaggttttgttaataaaaaaattcctaacccagacgacccatattctttagaagaatttatagataatattgaatatagcgatgtaggtgccaacaccggtattaagaagtggattgaaaaacgttataattttgc

SEQ ID NO: 20218 - DNA, 1011 bp, Piromyces finnis
  CotH
tatgtatgctcgttctaacagtaaagttggttataatatgaaatttgaagaaaaattgtttggaagaaaaagtttaagattaagaccagatccaaatgataagagttatatgcgtgaaaaactttcttcagatatcttaaatagagcaggtttaccatctgttcaagcttcatatgctagactttatatcaataacgaatttttcggtttatatactattcttgattctgttaaaccatttatggtaaaaaagattttcaaacttgatgatgaaactaatgcaatgtctctttatcaatgtaaatacgatggtatggatttaaaagtaggaagtgaatcccattgtattaatgcagttaccgaagataatactaatttaggtgaattacaagaatttatttctaaagtaaattctgctacttcattagctcaattcgaagaatttttagatgttgatttattcctaaaatctgttattgttgaatggcttattggttcttttgatcactttttaattttaggtcacaattttaacttttacaaaagaccaacagacaataaatggtgtattattctttacgattttgataatacttttggatacaatttaggtgctggttcatttaacttaaaaaacaaaaatagaaatttaggttggggtttccaaggttttggtgctaataatgtcgattataatacattatcatttaaggatttcaactcaaaggttaatcacaagatctttcaatatttaatttatcaagatgatactagattcaagtctcttcttaaggatgttttagtttcagcttttaatccaactattttaggtcaacatattaaggaattaaaggctttcttatcaccatacgttaatgaagatcttacaccaattaatggagaacttccaggaagagttaacaaaaaaggttatagttcaagagttacagctaatgatttccaaaaaagtaatgaccttgaaagttatattcaaaagagatatgattctat

SEQ ID NO: 20219 - DNA, 1005 bp, Piromyces finnis
  CotH
tagatcaaccaaagcctattcaaaattaggttataatattaatattaaaaagggtggtcttttatatggtgctaagcaattacgtttacgtgctgatgttgtagatccatcttttttaagagaaaaacttgtttatgatttatgtactcttgttgatttaccaactctttctgctaattacgttcgtttttatatcaacgatacttttatgggattattccttttaagagatgcctttaaatctcaatgggttcaaaataattttggtgaaaagaatacaaaacatatctatacctgtgataaaacttatggtaaaagtgaatttttcaactgtattaacgatgatgaagatattaaagatgataaagattggccacgcttcattgaattattaaacaactctaaatctcgtgaagacctggaaaaattctttgatgttaatacttatattagatggcaagtatctcgttacttattcggttcttgggatcacaaaactagtactcacaataatgcagtttacatgttccatagtgaatatgctgatagagatttatggattccacttctttatgattttgatatggatttcggttcctacagaaccattgatccaaaagttaagttttccgaagaagtcgttgataaaaataatccattatatactcttcttaaccttaatgatgaaagtgaagaagttagagcagtaatggatgacatcatgcgtagaggtttcaatccaaacattcttcttccacgtattgatgaattaaaaaaatttattgatccatacattaaggaagatcgtactgtaggagaaaatggtcgttttccaggtagaatggttagaatgagtgataaagcagatgatcattatcaatatgaagatttcgtcgccaataccgaatttactacccttaaagcaaaacaatattcaggagatgttcaaactggttctgctactgttttaggtcttaaagtttgggtcattgaacgtttcaagtt

SEQ ID NO: 20220 - DNA, 1017 bp, Piromyces finnis
  CotH
tggtggtaactggagtagaactaatgacagagtcggttttaatattaagcttaaggatgatgaccgcttattcgatcaaaaatacttaagattaagaccagacccaactgacttcactgtcatgcgtacaaaactttcaatggaattattatatcgttttaatgttccaacccttcaaagtgcatatgttgaagtttatgttaatgatatttacttcggtttattcttacttcaaagtacaattaaaccagaatggattcaacaagaatatgaacttccagaaaatgttgaaatgaagggtcttttcaattgtaaaaaagacagtgctgatttaaatgctgaatcaaaagatcattgtttcaatgctgttgaagaatatgctaattacactcaacctttagatgaatttataactagtcttgataatgctaagagtgttgaagaattaagaaaggtctttaatgttgatctctttatgaagaatgttgtttttgaatatttagttggttcatacgatcattatgttacaaatggtcataattactttgtttatcaaaaggaaaatggtatttgggatttaattttaaatgactttgataatacttttggtaataatctttttgtttcttatgtttacgcaatgggaaatgatccaattgatattactgaagccccatttgaaaaattagtaaaacgtaagaagcatttgcttgatttaacttactttgatgataaaaacaagacattattcaaaaaaactcttcgtgaacttttagttactggatttaatgaagaattccttttcaaccgtattgaagaaattaagaaaattattttaccatatgttaaaaaaaccattactccaaatgacgatggtacttacccaggtgctattaatcttatcggtcaaccatccgttcatactctcgaagaatttgaagaaagtttcactgtaacttccgaagatcaattcaagattggtttaaagaactggatttcaaagagaattgctttcgc

SEQ ID NO: 20221 - DNA, 945 bp, Piromyces finnis
  CotH
aaaatcaaccacatctttttcgaaaccaggctataacattaaaattaaagatggcaaaaatttacatggtactaaaaactttcgtttaagaagtgatcaacgagatgtatctatgatgagatcaaaaattactactgatattttacaaaaaagtggtttaattgctgttgagactggctacactgaattatatgtaaatgatgaatatatgggactttgggtaatttcagattccattaaaaatcattggattaaaagaaagtttggtgacaatggtgaagaaattaaaactttatatgaatgtaatggtgatgttattagatttgatgacggctctgctaaaactaaatgtattaataaaaatgatgaatattcagattatatggaaccatttaatacttttgttgatcaagttaatgctgcaaaaacaaggcaagatttagaagaaattatggatgttgataactttattaaatatatggcttgggaatggttaatgggttcatttgatcactttttgagttattatggccataatctatgttggtataaacaaccaaacgataaatggatttatattccatatgatcatgatattgaaatgggtcaagatgaatatattggattttatccaaatagaacctttaaccatggtaatgatattgattttacaaacctctcatttaaagaattcgaattagatcatccaattattcaagttttaattaatgatgatgatacagtcttccgtgaattacttgatgatattattagtaaagtatttaatcctgatactttacttctccacattgatgaagttagaagtttaattggtccatatgttaaaaaagacagagaaagtggagcaggaaaaataaataaaattggtaaagacacccgatttacttatgaccattttcttttaaatacagagtatacttatat

SEQ ID NO: 20222 - DNA, 543 bp, Piromyces finnis
  CotH
tatggcttgggaatatattactctcagctgggatcattttattggtatttttggtcataacatatattggtttaaacaaccaaatggtaaatgggtttatataccatatgactatgatttagaacttggtcaagatttatgggtagcaaacttccctggaagacctttttatattggtggtggtgatattgattttactaatatttcttttgaagattatgaattaaatcatccaatattgaaaattcttattcgtgatgatgatactttttttcgtgaatgtataggtgatattattagtaagatttttaatccagatattctacttattcatattgatgaaattagaaatttaatttcaccctatgttaaaagggatagggatttaggtgcagggaaaataaataattctggtaaagatatcagttattcatatcaacactttatagataattctgagtataaatatttatttgattataagggttcaactcgcgggtatggtttaaaagattggattagacgccgttattcttatcttgc

SEQ ID NO: 20223 - DNA, 591 bp, Piromyces finnis
  CotH
tttagaagaattctttgatactgaactctttttaagatgggaagcccttaaatatttattaggttcatgggatcatatgaccaattatcacaacaagaatatatatatgttccataataattataccaataaggacagatggatggttttactctacgattttgacagtgatttcggtgcctacaaaaaacctaatccagaaaatacttttaacactgaaatctatgaaaagtcacatccacttcataagttattaaatgttaccgatagtaatgaagaaattattcaatacatggctgaattcatgatgaatggcttcaatccaaaagaattattccaacgtattgatgaacttactgaattccttgccccatacattaaggaagatcgtactccagataagaatggaaaacttcctggtagagttccaagatctcttaacaaaatagaagattccttctcttatggcgatttccgtaataacactgaatttaccaaattgaaacttaaaaagtatgactctgacacaagttcatcctccgaatacatttatggtattaaacaatgggttcttgaacgttttagatttgc

SEQ ID NO: 20224 - DNA, 864 bp, Piromyces finnis
  CotH
ttctggtaacttttcaaaatctttcaccaaaccaggttttaatattgaactttctgaaaaatataaacaaagaaagattttccgtctccgtaccgattcaagtgatgtttctcatataagacaaaaggttgtttgtgatattgcaaacagagttggtttaccatctattcaaagtacttttgttagacttactattaatggaaaattatttggtttatttggtcttatggattctcttaagccatacaatattaaaagaatgtataacacaaagactgataaaaaagatttaaaattaattcaatgtaaagatatgggtttcagattcacttccgatactgtaaatatttgtagtagtgatggtggtgatgaaagcgcctttgaagaatttaaacaatttgttgctgaagttgaaaaagctaattcacttgaagatttagaaaaaattatgaatgttgatatatttttaaaatattttgctcttgaatgggttattggttcattcgatcacatgcttgtattaggtcacaatttctatttctataaaaacgaaatcaataataaatgggatgttatctattacgattttgataatactcttggtcaagctcaaagagttgattgggcttggtcttcaggaaaaaatcaaggtgttgaagattacactacattaacttttgaagaatttactgataaccaaagaattttcgatattgctgttaacaaggatgatacaagattcaagaaaaacttaaaggaacttttaactttcggttacaatccagttcttttaaacgaacacattgatgatcttaaatcatacatttctccatatgtaaaagaagaatacactccaataaacgg

SEQ ID NO: 20225 - DNA, 864 bp, Piromyces finnis
  CotH
aagtacctctcgccactttgctaaacaaggtttcaatttaaaaattcgtggaaaggaagatttatatggacgtactaatattagacttcgtccagatttccgtgaaccaactttcttacgttcaaaattagcttgtgatatccaaaatcgtattggtgttccatctatttctgctaactttgctagattatacattaatgataactttatgggtttatacgttttattagatgccttcaaactttcttggattgaagccgtttatggtgaaaaggattctacatctttaatccaatgtaaatacatggataacaatttaacctacaaatattccataaatggttgtatcaatgaaaatgacgaagttactgataagactgaatgggctgatttcttaactgctttagatgatgctcaaactccagaagaaatcgaaaaggttttagatgttgacattttcttaaagaatgttgcttatgaatttttagctggttcttgggatcactaccttagttacggacacaacttctatctctataagccacaaaacagcaatgtatggaaattattagaatacgactttgattctgaattcggttgtgatacttctcaaggtattggtggtccaggtgcagtcattactaactttaactttgctgagtacccattagaaaaatggcacaagagtcgtcacttacttgatgtcttagtttaccaaaactctactagatttgaaaacattcttaagcaacaagttaaagaagttttcaacccagctgttattttcccacatattgataaattaaaggaattcattaagccatatgttattgaagatttcactccagatgaaaatggcaaata

SEQ ID NO: 20226 - DNA, 372 bp, Piromyces finnis
  CotH
taaagttcgtggtaactggacttcaaattacgttaaaaaaggtctccgtattagctttgacgaatctcaaagtatgcttggtcttaatgaaggtcataagtttaagaactgggttcttttagctgaatacaaggatggatctatgcttagaaacaaatcatcattcgatctctcccgtggtttacttaatccagatggttactattcatcagatggtacattagttgaattacaaattaataacgaatactttggtgtttatcttttagctgaacaacaacaaattaatgaacacagagttaaaattactaagggtgaagaaaactacactggtactgatattggttatttacttgaatatgatactggtta

SEQ ID NO: 20227 - DNA, 687 bp, Piromyces finnis
  CotH
agctcaaaacgacttcatttccaattttgttaacaatgcttacaaaattatgtatgaagcttcttacaatcaaaagaccttaaagttcaacaataactactctgatgttgttgatgctccagaattaactccaagacaagctattgaaaacgttttagaaccagaatcattagctgatttatttattattagtgaaatgacttgtgatgctgatctttattactcaagtttctacttagatgttgactttggtccaaatggttcaaagaaacttagattcgaagctccatgggatttcgattctggtcttggtaacaaggatcgttgtgctaatggtcaaggtcattttgcagctaatattattccagataatggtaatatgggaggtcaaaagattaacccatggttagctgtaattatgtatgaagattggtaccaagaacttattagaagcagatggacaaaggcttatgatagtggtgttcttaacaaaattgttgatatgattcatactcaaactcaagttgcctctgctgcatttgatcgtaattacgctaaatggaataatattattcaaaatcaatcctttgtttctgaactttctccaggtgctaagcaatgtaaaactcaaaaggaagctgctaattatcttgctgattggttcgaatctagaattgcttttgttaa

SEQ ID NO: 20228 - DNA, 375 bp, Piromyces finnis
  CotH
taaagttcgtggtaactggacttcaaattacgttaaaaaaggtctccgtattagctttgacgaatctcaaagtatgcttggtcttaatgaaggtcataagtttaagaactgggttcttttagctgaatacaaggatggatctatgcttagaaacaaatcatcattcgatctctcccgtggtttacttaatccagatggttactattcatcagatggtacattagttgaattacaaattaataacgaatactttggtgtttatcttttagctgaacaacaacaaattaatgaacacagagttaaaattactaagggtgaagaaaactacactggtactgatattggttatttacttgaatatgatactggttattc

SEQ ID NO: 20229 - DNA, 882 bp, Piromyces finnis
  CotH
aaagtcatccccagaattttctaaaccaggttataatattaaaattaaaggagataagcaaacattacatggtactaagaatttccgtttaagaagtgatcaacgtgaagcttctatgatgcgttcaaagattaccactgatatcttacaaaaaagtggtttaatagcaattgaagttggttacaccgaattatacgttaatgacgaatatatgggattttgggttatttctgattctattaaaagcaaatggattaaaagaaagtttggagatgaaagtaaagatattaaaacattatatcaatgtaagaatgatggaattagatttaatgatggatcagctaaaaagaagtgtgtaaatgccaacagtgaatatactgattatatggaaccatttaacaactttgttgatcaagttaatgctgctactacaagagaagatttagaaaaaatcatggatgttgataactttatgaaatatatggcatgggaatggttaatgggaacatgggatcatttcttgggtccatatggtcataatttatattggtaccaacaaccaaacggaaaatgggtttatatcccatacgatcatgatattgaattaggtcaagatctctggacttcattctttaaaaataaggcttacaataaaggaagtgatattgatttttcaaacgtttctttcaaagatttcgaattagatcacccaataataaaaattttagttcacaatgatgatactagattccgtgaattacttggtgatataattagtaaagtttttaatccagatacaattcttgctcatattgatgatgttaaagaattaatttcaccatatgtcaaaaaagacagagaaactaatgcaggaagaataaa

SEQ ID NO: 20230 - DNA, 798 bp, Piromyces finnis
  CotH
taaatacacaagagctttcgaaaagcaacaatacaatattaagattaataatggtgaattatttggtagacaacaaattagattacgttctgaagtcgttgatccaagtttcattcgttcaaagttaggttatgatttatgtaatgttttagatattccttctgttgaagcaacatacactattgtatatattaatgatgataatatgggtttatatttacttcgtgatgttccaaaaagtcaatggtttgaatataactttggtatttcaaattctacttatgtttatgaatgtgatagtaaatatggtacatctaaatacttcaattgtatgaatgatgctaccgaagaagaaggtgatgctaacattcaagctttaaatgcaaaatttgaaaaggctaaaaatgctgaagaaattagccaattctttgataccgatttatatattaagtggcaagcttataagtatttaactggttcttgggatcatgttaccccacaacataaccaatatctcttctataatgaaattaatggtaaatggatgaatttcctttacgattttgatagtgattttggtgcttacaaaaaaccagatccaaatttatcttttactgaagaatcacttgaaatgactttaccactttatcaaaaacttgaattaaataaccacaatactcaattagttaatactattaaggaatttgttattaatggttttaatccagttaaacttatcccacgtattaatgaattattagattacttatatccatatgttttagaagatagattacc

SEQ ID NO: 20231 - DNA, 1014 bp, Piromyces finnis
  CotH
tcaatattctcgtcaattaagtaaaccaaattttaatttaaaaattcgtggaaagaaagatttatatggccgtagtcaattcaaattacgttccgactttgcagaacctacatttttaagatcaaaattaacttctgatatacataaccgtttaggtcttgtttcaatttcagcaaattatgtcacattatatattaataatgaaaatatgggtttatttgttttaaccgatgccattaaaaaatcatggataaaatatatttatgatgaggatgaaactacttccttgtatcaatgtggttcatctaatttatcaataagattggggtatggatgtagaaatgaaaatgatgatgtcaaagattactctgaatggatgaactttttattgaaattagatcaagcccaaacggcctcagatattgaggatatttttgatgttgatcattttcttactgaaatggtaattgaatatttaataggaggttgggatcatattcaacaaattggtcataatttctatatgtataaggaacctaatggaaaatggaaatatattacttacgactttgatcaagaatttggaattaatattgatagagtttttgttggttatattctcgaagatttaccagaacattatttaagaagaaaaactgattatgtaaactattcattctctgattggactgttcatcatcatatcattgaaattttaatcttaaataacccaagccgttttgaaaaaattttaaaaaatgttatagaaaaagttttcaatccagcaacactttttccacatattgatgaattaaaagaatttattaaaccttatgttatgatggacaaaacccctgatgaaaatggatattaccctggtagaattaattactccgcagaagaaacttattctttagctcagtgggatgcaaattcagaatttactatggttgatactattcagtataatgcttatggtataaaatattggattcttgcgaaatatagatatat

SEQ ID NO: 20232 - DNA, 339 bp, Piromyces finnis
  CotH
ggatcattatcttaactttggacataatttctatatgtataagccaaagaatgataaatggaagttccttttatacgattttgatggagaaattggacaagatgtctcattagctagtggatttggaaaacaaaatgttaacactgattatccatcatactcatttgcagaatggacaaaacaacgtcatcttattgatattttaattttaaaggattctactcgttttgataatattcttagaaactttgttacagaagttttcaatccagctactcttttcccacgtattgatgaattaaaagaattcattagaccatatgttgaattagataagat

SEQ ID NO: 20233 - DNA, 591 bp, Piromyces finnis
  CotH
agataaggatactactcatcttttcaaatgtaaatctggtggtcttactcttacttctagcactagtaattgtgaaaatgaaaatgatgaagctaccgatcgttctgaatggaatagcttcatttcaaacttagatagagctaactctgcttctgaagctgatagattctttgatgttgatcaattcctttatgaaatggcttatgaatatttatctggttcatgggatcattatcttaacacaggtcacaactttgctgtatacaagaagccagacaattacggtggtaaatggactatggttcactatgattttgatggtgatttcggtcaagatgtttgtgctgtcgaatttgcaggatctattaattctaataaggattacccatcatggtctttcgaagattggtctactaaaaagagtcatcttcttgatatctgtattaagaaggatagaactcgtttcaacaaggtaatgcaaaaatttgttgaagaagctttcaacccagatcttcttttcccacatattgatgatttaaaggatatgattagaccatacattaagaaagataagactccaggtagtaatgg

SEQ ID NO: 20234 - DNA, 810 bp, Piromyces finnis
  CotH
taaatatacaaagatttttgaaaaattgggttacaacattaaagttaaaaagggtgaatttttagagagaaaacaacttcgtttacgtacagaagctgttgatccatctttccttagagaaaaattagcatatgatatttgtaatgttgttggtttaccatcattatccgcaaattatgttcgtgtattctttaatgaaaaatatatgggtttatatgttttaagagatgcttttaaatctcaatggattgaatatacttttggtgaaaaatccaccaagcatttatatacttgtgatagaaaatatggtgataattcctatttcaattgtattaatgatgatgaaactatcaccgaagataaggattgggaaaatttccttattcgtttagcagaaactaaaacaagagaagaacttgaagaattttttgacgttaaaacttttattaaatggcaagcccttaaatacttattcggttcctgggatcatattactaatgctcataatcaagttttatatatgtaccatgatacctctaatgatagagatatgtggattccattactttatgattttgatagtgaatttggtgcttacaaagatattaaaactaacagatcttttgatgaagaagcccttgattctccaaacccactctacaaacttcttaaattacacgatgataatgaagaactcctttcctacattgatgaaatcatgagaaaagctttcaatccaggtaacttatttgcacgtattgatcaattaaaggaattcctttcaccttacgttaaagaggaccgtactcc

SEQ ID NO: 20235 - DNA, 996 bp, Piromyces finnis
  CotH
taaatataccaagagttttgaaaaattaggttataatatcaagattaaaaagggtcaattatttgaaagaaaacaacttcgtttacgttctgaagctgtagatccatccttccttagagaaaaattagcctatgatatttgtaatttagttgaattaccatctctttctttaaactatgctgaagtttacattaataaaaagtttatgggtttatttgctctaagagatgcttttaaatctcaatggattgaatatacttttggtgaaaaaggtactgatcatttatatacttgtgatagaagtcatggaaataatgaattcttcaattgtattaatgatgatgaagaaattactaatgattctacttttaaggaattccaagatcgtttagctaaaactaaaactagagaagaattagaagaattctttgatgtcaaaacatttatgcaatggcaagctttaaaatatttatttggttcatgggatcatatcaccaatgctcataatagttatctttacatgtatcaaaatgaatttactggtaaaagtatgtggattcctttactttatgattttgatagtgaatttggtgcttataaaaatgcaaatccacgtaagacttttgataattcaatttatgatcgtttaaatccattatttgatattcttaatatcaaggaatccaatccagaaattattggatatatgagtgatattatgaaaaaggcattcaatccaaagaaattacttccaagaattgataaacttaaagaatttattgctccatacattaaaaaggatcgtactccagatgctgatggtaatcttcaaggtcgtgtcaaaagagtcaacatcaagattgaagattattttacctataatgatttcgaaaaaaattcagaattcaccaaaattactcttagaaagtatcaaagtaaatatttctctactgatgattatattcttggattaaaacaatggattattgaaagatt

SEQ ID NO: 20236 - DNA, 996 bp, Piromyces finnis; identical to SEQ ID NO: 20235
  CotH

SEQ ID NO: 20237 - DNA, 810 bp, Piromyces finnis
  CotH
taaatataccaagagttttgaaaaattaggttataatatcaagattaaaaagggtcaattatttgaaagaaaacaacttcgtttacgttctgaagctgtagatccatccttccttagagaaaaattagcctatgatatttgtaatttagttgaattaccatctctttctttaaactatgctgaagtttacattaataaaaagtttatgggtttatttgctctaagagatgcttttaaatctcaatggattgaatatacttttggtgaaaaaggtactgatcatttatatacttgtgatagaagtcatggaaataatgaattcttcaattgtattaatgatgatgaagaaattactaatgattctacttttaaggaattccaagatcgtttagctaaaactaaaactagagaagaattagaagaattctttgatgtcaaaacatttatgcaatggcaagctttaaaatatttatttggttcatgggatcatatcaccaatgctcataatagttatctttacatgtatcaaaatgaatttactggtaaaagtatgtggattcctttactttatgattttgatagtgaatttggtgcttacaaagatattaaaactaacagatcttttgatgaagaagcccttgattctccaaacccactctacaaacttcttaaattacacgatgataatgaagaactcctttcctacattgatgaaatcatgagaaaagctttcaatccaggtaacttatttgcacgtattgatcaattaaaggaattcctttcaccttacgttaaagaggaccgtactcc

SEQ ID NO: 20238 - DNA, 810 bp, Piromyces finnis
  CotH
taaatataccaagaattttgagaaattaggatataatattaaaataaaaaagggtcttcttttcgatagaaaacaattacgtttacgttcagaagctgttgatccatctttccttagagaaaaattagcttatgatatttgtaatattttagaattaccatcactttcatctaattttgctcgtttttaccttaatgatgaatttatgggtttatattctttaagagatgcttacaaatctcaatggattgaatatacttttggtgaaaaatccaccaagcatttatatacttgtgatagaaaatatggtgataattcctatttcaattgtattaatgatgatgaaactatcaccgaagataaggattgggaaaatttccttattcgtttagcagaaactaaaacaagagaagaacttgaagaattttttgacgttaaaacttttattaaatggcaagcccttaaatacttattcggttcctgggatcatattactaatgctcataatcaagttttatatatgtaccatgatacctctaatgatagagatatgtggattccattactttatgattttgatagtgaatttggtgcttacaaagatattaaaactaacagatcttttgatgaagaagcccttgattctccaaacccactctacaaacttcttaaattacacgatgataatgaagaactcctttcctacattgatgaaatcatgagaaaagctttcaatccaggtaacttatttgcacgtattgatcaattaaaggaattcctttcaccttacgttaaagaggaccgtactcc

SEQ ID NO: 20239 - DNA, 996 bp, Piromyces finnis
  CotH
taaatataccaagaattttgagaaattaggatataatattaaaataaaaaagggtcttcttttcgatagaaaacaattacgtttacgttcagaagctgttgatccatctttccttagagaaaaattagcttatgatatttgtaatattttagaattaccatcactttcatctaattttgctcgtttttaccttaatgatgaatttatgggtttatattctttaagagatgcttacaaatctcaatggattgaatatacttttggtgaaaaatccaccaagcatttatatacttgtgatagaaaatatggtgataattcctatttcaattgtattaatgatgatgaaactatcaccgaagataaggattgggaaaatttccttattcgtttagcagaaactaaaacaagagaagaacttgaagaattttttgacgttaaaacttttattaaatggcaagcccttaaatacttattcggttcctgggatcatattactaatgctcataatcaagttttatatatgtaccatgatacctctaatgatagagatatgtggattccattactttatgattttgatagtgaatttggtgcttataaaaatgcaaatccacgtaagacttttgataattcaatttatgatcgtttaaatccattatttgatattcttaatatcaaggaatccaatccagaaattattggatatatgagtgatattatgaaaaaggcattcaatccaaagaaattacttccaagaattgataaacttaaagaatttattgctccatacattaaaaaggatcgtactccagatgctgatggtaatcttcaaggtcgtgtcaaaagagtcaacatcaagattgaagattattttacctataatgatttcgaaaaaaattcagaattcaccaaaattactcttagaaagtatcaaagtaaatatttctctactgatgattatattcttggattaaaacaatggattattgaaagatt

SEQ ID NO: 20240 - DNA, 996 bp, Piromyces finnis
  CotH
tagatctactaaacaatatgaaaagttaggttttaacattaaaattaaaaagggtaaattatatgatagaaaacaaattcgtttacgtactgaagctgttgatccatcttttattagagaaaaattaatttatgatatggcaaatattcttgaaataccttctctttccctcaactattgtaaggtatatttcaatgataaatttatgggtttttatgctatgagagattcttttaaatctcaatggattgaatatacttttggtgaaaaaggtactgatcatttatatacttgtgatagaagtcatggaaataatgaattcttcaattgtattaatgatgatgaagaaattactaatgattctacttttaaggaattccaagatcgtttagctaaaactaaaactagagaagaattagaagaattctttgatgtcaaaacatttatgcaatggcaagctttaaaatatttatttggttcatgggatcatatcaccaatgctcataatagttatctttacatgtatcaaaatgaatttactggtaaaagtatgtggattcctttactttatgattttgatagtgaatttggtgcttataaaaatgcaaatccacgtaagacttttgataattcaatttatgatcgtttaaatccattatttgatattcttaatatcaaggaatccaatccagaaattattggatatatgagtgatattatgaaaaaggcattcaatccaaagaaattacttccaagaattgataaacttaaagaatttattgctccatacattaaaaaggatcgtactccagatgctgatggtaatcttcaaggtcgtgtcaaaagagtcaacatcaagattgaagattattttacctataatgatttcgaaaaaaattcagaattcaccaaaattactcttagaaagtatcaaagtaaatatttctctactgatgattatattcttggattaaaacaatggattattgaaagatt

SEQ ID NO: 20241 - DNA, 996 bp, Piromyces finnis
  CotH
taaatatacaaagatttttgaaaaattgggttacaacattaaagttaaaaagggtgaatttttagagagaaaacaacttcgtttacgtacagaagctgttgatccatctttccttagagaaaaattagcatatgatatttgtaatgttgttggtttaccatcattatccgcaaattatgttcgtgtattctttaatgaaaaatatatgggtttatatgttttaagagatgcttttaaatctcaatggattgaatatacttttggtgaaaaatccaccaagcatttatatacttgtgatagaaaatatggtgataattcctatttcaattgtattaatgatgatgaaactatcaccgaagataaggattgggaaaatttccttattcgtttagcagaaactaaaacaagagaagaacttgaagaattttttgacgttaaaacttttattaaatggcaagcccttaaatacttattcggttcctgggatcatattactaatgctcataatcaagttttatatatgtaccatgatacctctaatgatagagatatgtggattccattactttatgattttgatagtgaatttggtgcttataaaaatgcaaatccacgtaagacttttgataattcaatttatgatcgtttaaatccattatttgatattcttaatatcaaggaatccaatccagaaattattggatatatgagtgatattatgaaaaaggcattcaatccaaagaaattacttccaagaattgataaacttaaagaatttattgctccatacattaaaaaggatcgtactccagatgctgatggtaatcttcaaggtcgtgtcaaaagagtcaacatcaagattgaagattattttacctataatgatttcgaaaaaaattcagaattcaccaaaattactcttagaaagtatcaaagtaaatatttctctactgatgattatattcttggattaaaacaatggattattgaaagatt

SEQ ID NO: 20242 - DNA, 810 bp, Piromyces finnis; identical to SEQ ID NO: 20237
  CotH

SEQ ID NO: 20243 - DNA, 810 bp, Piromyces finnis
  CotH
tagatctactaaacaatatgaaaagttaggttttaacattaaaattaaaaagggtaaattatatgatagaaaacaaattcgtttacgtactgaagctgttgatccatcttttattagagaaaaattaatttatgatatggcaaatattcttgaaataccttctctttccctcaactattgtaaggtatatttcaatgataaatttatgggtttttatgctatgagagattcttttaaatctcaatggattgaatatacttttggtgaaaaaggtactgatcatttatatacttgtgatagaagtcatggaaataatgaattcttcaattgtattaatgatgatgaagaaattactaatgattctacttttaaggaattccaagatcgtttagctaaaactaaaactagagaagaattagaagaattctttgatgtcaaaacatttatgcaatggcaagctttaaaatatttatttggttcatgggatcatatcaccaatgctcataatagttatctttacatgtatcaaaatgaatttactggtaaaagtatgtggattcctttactttatgattttgatagtgaatttggtgcttacaaagatattaaaactaacagatcttttgatgaagaagcccttgattctccaaacccactctacaaacttcttaaattacacgatgataatgaagaactcctttcctacattgatgaaatcatgagaaaagctttcaatccaggtaacttatttgcacgtattgatcaattaaaggaattcctttcaccttacgttaaagaggaccgtactcc

SEQ ID NO: 20244 - DNA, 858 bp, Piromyces finnis
  CotH
tagttcctctcgtaactatgcaagacaagcctttaaccttaagattcgtggtaagaatgatttatatggtagacaacaattcagaattcgttctgaagctcgtgaagctacctatttaagatcaaaacttgcctgtgatttacataaccgtttaggtcttacttccatttctgctaattacattactttatacgtcaacaacgaatactggggattttatgttcttatggatgctccaaaaccatcttgggctgaacttgaatttggagataaggatactactcatcttttcaaatgtaaatctggtggtcttactcttacttctagcactagtaattgtgaaaatgaaaatgatgaagctaccgatcgttctgaatggaatagcttcatttcaaacttagatagagctaactctgcttctgaagctgatagattctttgatgttgatcaattcctttatgaaatggcttatgaatatttatctggttcatgggatcattatcttaacacaggtcacaactttgctgtatacaagaagccagacaattacggtggtaaatggactatggttcactatgattttgatggtgatttcggtcaagatgtttgtgctgtcgaatttgcaggatctattaattctaataaggattacccatcatggtctttcgaagattggtctactaaaaagagtcatcttcttgatatctgtattaagaaggatagaactcgtttcaacaaggtaatgcaaaaatttgttgaagaagctttcaacccagatcttcttttcccacatattgatgatttaaaggatatgattagaccatacattaagaaagataagactccaggtagtaatgg

SEQ ID NO: 20245 - DNA, 858 bp, Piromyces finnis; identical to SEQ ID NO: 20244
  CotH

SEQ ID NO: 20246 - DNA, 969 bp, Piromyces finnis
  CotH
tggtcattatactcgctattacagtaaacctggatataacatcaaacttgaaaatggttcactttttgatgtaaaaacacttcgtttacgttctatggcaaatgatgtatcttttatgagagaaaaactttcatgtgatatgctctataaaatgggtgtaccaacaacttccgctaattatgttaatgttgaaattaataatgaaaatgtaggtctttatgttattactgataaagttaaaaaggatatgattaaaagatactttaatgaaaaaaacactgacaacttttatgaatgccaaaatattgctgtcagatttgaagataattctattgctaatgaatgtgttaattcaaaggaagaacttgccaattacaaggatgatcttcaaaaattagtagatgctgtcaatttagctaaaacaattgatgatattaaagatattattgatgttgattcatttttaaaggtaattgcttttgaatatattcttcttgctaacgataactttttactttatggtcacaatttctatttatacaaaaagcaagatggtaaatggattatgattcttaatgactttaatagaacttttgcccaagatatttgggtcaacaacttcgaaggtgatgatagatatattaaaaagcattatttcccagatcttcaaagaattaatttaccaaatatttctattcgtgatatggatcttggtcataaaattgtcaaattacttattcatgacgatgacacacgtttccgtgaaattcttggagaaattgtcaaagaaatatttaatccaaagattcttaacgctcgtattgatgatattgctgatttaatacgtgatgatcttgctatttctcgtgaagtccaagaagatggatatccaattggtagtttcaatactcctggtatgaatccattatggaatatgacccaatttgaagattgcattaactatatggg

SEQ ID NO: 20247 - DNA, 195 bp, Anaeromyces robustus
  Cystine-knot_cytokine
aacaaagtttgaagttgcattaaagaattatggtttaaatgaaagtgatataagtagttcagctttaagttatactccaaagagttttgattattgtaatggtagctgtaataatactaaagatgatgatgataacagtaccaataacaataataacactaacaataacacaaacaataacactaataataataa

SEQ ID NO: 20248 - DNA, 303 bp, Neocallimastix californiae
  CYTH-like phosphatases
aattgaaagaaaatggttacttgacaaagaaaagattccatatgacttaacaacaaactttattggtatagcatttaaaataaagcaaacatatatttgttttgatccagagataagagtaagagaatatacaagtgtaagtaataatggattatcgtatgaaatgactataaaaactaatttaactgaagatggtcttattagggatgaagttaatattccaattaataaagaacaatatgataatatgataaaaaaacaggaaggtaatgtaatatataaaacaagatatcaattatttga

SEQ ID NO: 20249 - DNA, 465 bp, Anaeromyces robustus
  CYTH-like phosphatases
aattgaaaaaaaatggttaattgataaagaaaaaattccatatgatttatcagctattaccgttttaaaggcggatataaaacaaacctatatttgttttgatccagaaattagagtaagagaatacacagatgaaactccagatcatacttacgaaatgaccataaaaactaatttatctgaagatggtcttattagagatgaaactaatatagatcttaatcaagaacaatacaataatatggcaaaaaaacaagaaggaaatgtaatctataaaacaagatatcaacttttagataatcatgaaatattagcaattgatattttccatggtgatcttgatggattagcataccttgaaattgaattttctactaaagaagaaagtgatgcttataaaactcctgattgggccattaaagatgttaccaatgatattagatacaaaaacggccatttagcaag

SEQ ID NO: 20250 - DNA, 300 bp, Neocallimastix californiae
  CYTH-like_domain
agaaattgaaagaaaatggttacttgacaaagaaaagattccatatgacttaacaacaaactttattggtatagcatttaaaataaagcaaacatatatttgttttgatccagagataagagtaagagaatatacaagtgtaagtaataatggattatcgtatgaaatgactataaaaactaatttaactgaagatggtcttattagggatgaagttaatattccaattaataaagaacaatatgataatatgataaaaaaacaggaaggtaatgtaatatataaaacaagatatcaatt

SEQ ID NO: 20251 - DNA, 474 bp, Anaeromyces robustus
  CYTH-like_domain
agaaattgaaaaaaaatggttaattgataaagaaaaaattccatatgatttatcagctattaccgttttaaaggcggatataaaacaaacctatatttgttttgatccagaaattagagtaagagaatacacagatgaaactccagatcatacttacgaaatgaccataaaaactaatttatctgaagatggtcttattagagatgaaactaatatagatcttaatcaagaacaatacaataatatggcaaaaaaacaagaaggaaatgtaatctataaaacaagatatcaacttttagataatcatgaaatattagcaattgatattttccatggtgatcttgatggattagcataccttgaaattgaattttctactaaagaagaaagtgatgcttataaaactcctgattgggccattaaagatgttaccaatgatattagatacaaaaacggccatttagcaagatatgg

SEQ ID NO: 20252 - DNA, 93 bp, Neocallimastix californiae; identical to SEQ ID NO: 17635
  Dockerin_dom

SEQ ID NO: 20253 - DNA, 114 bp, Neocallimastix californiae
  Dockerin_dom
atgctgggctaagaagttaggatattcttgctgtacttcaacctctagagttgaatacactgataatgatggtaagtggggtattgaaaatggtaactggtgtggtattgttga

SEQ ID NO: 20254 - DNA, 99 bp, Neocallimastix californiae
  Dockerin_dom
ttaccaatgctgtaactcttgtactactacctacactgataatgatggtagatggggttatgaaaatggtgactggtgtggtattaagtactcttgtcc

SEQ ID NO: 20255 - DNA, 126 bp, Neocallimastix californiae
  Dockerin_dom
ttgggctcaaagccaaggttacaaatgttgtgataacccaggtagcactaaagttgaattctctgatggcagtggtcaatggggtattcaaaatggtgattggtgtggtattgactacagttacaa

SEQ ID NO: 20256 - DNA, 96 bp, Neocallimastix californiae
  Dockerin_dom
cccatgctgtaatacttgtactgctacttataccgatggtgaaggtaagtgggccattgaaaatggtaactggtgtggtattaaaaattcttgtgg

SEQ ID NO: 20257 - DNA, 120 bp, Neocallimastix californiae
  Dockerin_dom
tgccaatgttattgctcaaggttacaattgctgtaaatcttgtggtactgtttacttcgaagatggtgatggcaaatggggtgttgaaaacaataactggtgtggtatgccattaaactg

SEQ ID NO: 20258 - DNA, 120 bp, Neocallimastix californiae
  Dockerin_dom
agcctctatcactcgtcaaggttacaaatgttgtagagttggatgtactgttgaatacactgataatgatggtgaatggggtgttgaagatggtgactggtgtggttgtggtaaggctac

SEQ ID NO: 20259 - DNA, 117 bp, Neocallimastix californiae
  Dockerin_dom
ttccgctgctattactgctcaaggttacaagtgctgttctaacaactgtgaagttgtttactctgatgatgatggtgactggggtgttgaaaacaaccaatggtgtggttgtggtgg

SEQ ID NO: 20260 - DNA, 112 bp, Neocallimastix californiae
  Dockerin_dom
taccaaccaaggttacaaatgctgttcaacctgtggtaccgtttactacactgatgctgatggtgattggggtgttgaaaacaacgactggtgtggtatgccaaccaactgt

SEQ ID NO: 20261 - DNA, 121 bp, Neocallimastix californiae
  Dockerin_dom
agcttctatcaccaaccaaggttacccatgctgttcatcctgtggtaccgtctactacactgataatgatggtttatggggtgttgaaaacaatgactggtgtggtatgccaacagactgt

SEQ ID NO: 20262 - DNA, 117 bp, Neocallimastix californiae
  Dockerin_dom
ttctgctgctattactgctcaaggttacaagtgctgttctgccaactgtgttgttgaatacaccgatgctgacggtgactggggtgttgaaaacggtcaatggtgtggttgtggtgg

SEQ ID NO: 20263 - DNA, 117 bp, Neocallimastix californiae; identical to SEQ ID NO: 17647
  Dockerin_dom

SEQ ID NO: 20264 - DNA, 112 bp, Neocallimastix californiae
  Dockerin_dom
taccaaccaaggttacaagtgctgttcttcatgttccactgtttactacagcgataatgatggtgattggggtgttgaaaacaatgactggtgtggtatgccaaccagttgt

SEQ ID NO: 20265 - DNA, 121 bp, Neocallimastix californiae
  Dockerin_dom
agcttctatcaccaatcaaggctataagtgctgttcttcatgttccactgtttactacaccgataatgatggtgcttggggtgttgaaaataatgactggtgtggtatgccaaccaattgt

SEQ ID NO: 20266 - DNA, 117 bp, Neocallimastix californiae; identical to SEQ ID NO: 17649
  Dockerin_dom

SEQ ID NO: 20267 - DNA, 112 bp, Neocallimastix californiae; identical to SEQ ID NO: 20264
  Dockerin_dom

SEQ ID NO: 20268 - DNA, 117 bp, Neocallimastix californiae; identical to SEQ ID NO: 17647
  Dockerin_dom

SEQ ID NO: 20269 - DNA, 76 bp, Neocallimastix californiae; identical to SEQ ID NO: 15099
  Dockerin_dom

SEQ ID NO: 20270 - DNA, 123 bp, Neocallimastix californiae
  Dockerin_dom
ttcctgtttcagtgtaaaccttggctacagttgttgtaacggttgtgaagttgcttacactgattctgatggtaaatggggtgttgaaaatggtaattggtgtggaataaagtcatcatgtaa

SEQ ID NO: 20271 - DNA, 117 bp, Neocallimastix californiae; identical to SEQ ID NO: 17655
  Dockerin_dom

SEQ ID NO: 20272 - DNA, 114 bp, Neocallimastix californiae
  Dockerin_dom
aagctgttggtctgaaagccttggttttccatgctgccaaaacaccaaagaagtttactacactgataatgatggtaattggggtgttgaaaataataactggtgtggtatcat

SEQ ID NO: 20273 - DNA, 123 bp, Neocallimastix californiae; identical to SEQ ID NO: 17656
  Dockerin_dom

SEQ ID NO: 20274 - DNA, 117 bp, Neocallimastix californiae
  Dockerin_dom
agcctctatcactcgtcaaggttacaaatgttgtagagttggatgtactgttgaatacactgataatgatggtgaatggggtgttgaagatggtgactggtgtggttgtggtaaggc

SEQ ID NO: 20275 - DNA, 120 bp, Neocallimastix californiae; identical to SEQ ID NO: 17658
  Dockerin_dom

SEQ ID NO: 20276 - DNA, 114 bp, Neocallimastix californiae; identical to SEQ ID NO: 17659
  Dockerin_dom

SEQ ID NO: 20277 - DNA, 115 bp, Neocallimastix californiae
  Dockerin_dom
ttgggctaatgcctatggttatgactgctgtgttgatggtactcttacatacttagaagatgaaactggaaaatggggtgttacctctgactaccaatggtgtggtattaagaat

SEQ ID NO: 20278 - DNA, 129 bp, Neocallimastix californiae
  Dockerin_dom
ttgttgggcagaagctttaggttacaagtgttgtactccaggtgcctacactccagttcttttaactgatgaaagtggtgattggagtgctgaaaatggtgaatggtgtggtctcttaaagagtgaatg

SEQ ID NO: 20279 - DNA, 111 bp, Neocallimastix californiae
  Dockerin_dom
ttttgccaaatctgatggatacgactgttgtttcgataatgaagttgtttatgaagatgaaacaggtaaatggggtattaatgatgaaggtgaatggtgtggtgttgaaca

SEQ ID NO: 20280 - DNA, 87 bp, Neocallimastix californiae; identical to SEQ ID NO: 17664
  Dockerin_dom

SEQ ID NO: 20281 - DNA, 120 bp, Neocallimastix californiae; identical to SEQ ID NO: 17663
  Dockerin_dom

SEQ ID NO: 20282 - DNA, 129 bp, Neocallimastix californiae
  Dockerin_dom
taaatgtatctccgaatttctcggttatccatgttgtagtagcagtaatactcctgtttattacaaagatgatgatggtgattggggtattgattcagctactggtgattggtgtggtattaccaaaat

SEQ ID NO: 20283 - DNA, 123 bp, Neocallimastix californiae; identical to SEQ ID NO: 17665
  Dockerin_dom

SEQ ID NO: 20284 - DNA, 117 bp, Neocallimastix californiae
  Dockerin_dom
ctgttggtcaactaaattaggttatccatgttgtaaaaagacatgtactgctattgaaaaagataacgatggtgcatgggctattgaaggatcacactggtgtggtattccagctat

SEQ ID NO: 20285 - DNA, 129 bp, Neocallimastix californiae
  Dockerin_dom
taaatgtgtctccgaatttctcggttatccatgttgtagtagcagtaacactcttgtttattacaaagatgatgatggtgattggggtgttgatccagctactggtgattggtgtggtattaccaaaat

SEQ ID NO: 20286 - DNA, 120 bp, Neocallimastix californiae; identical to SEQ ID NO: 17669
  Dockerin_dom

SEQ ID NO: 20287 - DNA, 120 bp, Neocallimastix californiae
  Dockerin_dom
atgttggtctaataaattcggttacccatgctgtgatacctgtgacgttttcttaactgatgaatctggtgattggggtgttaaagaccttgattggtgtggtgttccatccacttgtaa

SEQ ID NO: 20288 - DNA, 120 bp, Neocallimastix californiae; identical to SEQ ID NO: 17672
  Dockerin_dom

SEQ ID NO: 20289 - DNA, 120 bp, Neocallimastix californiae
  Dockerin_dom
ttgttggtctgaaagcttaggttacccatgctgttcttccaatactggtgttgcatacattgataatgatggtgaatggggtgttgaaaatggtggctggtgtggtattaaaggagatag

SEQ ID NO: 20290 - DNA, 117 bp, Neocallimastix californiae; identical to SEQ ID NO: 17673
  Dockerin_dom

SEQ ID NO: 20291 - DNA, 123 bp, Neocallimastix californiae; identical to SEQ ID NO: 17674
  Dockerin_dom

SEQ ID NO: 20292 - DNA, 117 bp, Neocallimastix californiae; identical to SEQ ID NO: 17676
  Dockerin_dom

SEQ ID NO: 20293 - DNA, 120 bp, Neocallimastix californiae; identical to SEQ ID NO: 17675
  Dockerin_dom

SEQ ID NO: 20294 - DNA, 64 bp, Neocallimastix californiae
  Dockerin_dom
ctgttgggctactaaattaggttacccttgctgtaaaactaccaccactactgaatacactgat

SEQ ID NO: 20295 - DNA, 93 bp, Neocallimastix californiae
  Dockerin_dom
tccatgctgtagtgatccaaatactactcctatagaaactgatgatagtggtgaatggggattagaaaatggtgattggtgtggtattattag

SEQ ID NO: 20296 - DNA, 120 bp, Neocallimastix californiae
  Dockerin_dom
ttggtcaatgaaattaaatccacctattccatgttgtacaggaaaagatttaaaagttatcgaagaagattcaaatggaaaatggtctgaagaaaatggggaaaagtgtggtattccagt

SEQ ID NO: 20297 - DNA, 129 bp, Neocallimastix californiae; identical to SEQ ID NO: 17679
  Dockerin_dom

SEQ ID NO: 20298 - DNA, 102 bp, Neocallimastix californiae
  Dockerin_dom
tccatgctgtagtgatccaaatactactcctatagaaattgatggtagtggtgaatggggtgttgaaaatggtgaatggtgtggtattcgtaagaataataa

SEQ ID NO: 20299 - DNA, 126 bp, Neocallimastix californiae
  Dockerin_dom
ttggtcattggaattagctaatcctttcccatgttgttctgatccaaatgcaactgttgaatatactaatgataaaggagattggggtgttgaaaatggtcaatggtgtggtataattaaaacatc

SEQ ID NO: 20300 - DNA, 132 bp, Neocallimastix californiae
  Dockerin_dom
ctgttgggcttcaggtttaggttacaaatgctgttctggctgtgatgtcattttatctgacagtaatggaaagtggggatttgattttgaaactaatgattggtgtggtattattgaatctaaatgtaatac

SEQ ID NO: 20301 - DNA, 111 bp, Neocallimastix californiae; identical to SEQ ID NO: 17682
  Dockerin_dom

SEQ ID NO: 20302 - DNA, 120 bp, Neocallimastix californiae; identical to SEQ ID NO: 17683
  Dockerin_dom

SEQ ID NO: 20303 - DNA, 117 bp, Neocallimastix californiae; identical to SEQ ID NO: 17687
  Dockerin_dom

SEQ ID NO: 20304 - DNA, 120 bp, Neocallimastix californiae; identical to SEQ ID NO: 17686
  Dockerin_dom

SEQ ID NO: 20305 - DNA, 84 bp, Neocallimastix californiae
  Dockerin_dom
ctgttgggcttcaggtttaggttacaaatgctgttctggctgtgatgtcattttatctgacagtaatggaaagtgggcagcctc

SEQ ID NO: 20306 - DNA, 114 bp, Neocallimastix californiae; identical to SEQ ID NO: 17688
  Dockerin_dom

SEQ ID NO: 20307 - DNA, 117 bp, Neocallimastix californiae
  Dockerin_dom
ttgctggtcaacaagtttaggttatccatgttgttcatcttctagtgcccaagtttactacactgataatgacggaaagtggggtgttgaaaataatgactggtgtggtattccaac

SEQ ID NO: 20308 - DNA, 120 bp, Neocallimastix californiae; identical to SEQ ID NO: 17690
  Dockerin_dom

SEQ ID NO: 20309 - DNA, 120 bp, Neocallimastix californiae
  Dockerin_dom
ttgttgggctgctgctgaaggttacccatgttgtactagtaccactactgttgaaattgttgacagtaaaggtaaatggggtattgaaaatggaaactggtgtggtattgttgaaaactc

SEQ ID NO: 20310 - DNA, 126 bp, Neocallimastix californiae
  Dockerin_dom
ctgttgggcttcatctcaaggttataattgttgttctggttgtgacccaattctcactgatggtagtggaaagtggggttttgaaaatggtaactggtgtggtattattgaatctaaatgtaaagc

SEQ ID NO: 20311 - DNA, 111 bp, Neocallimastix californiae
  Dockerin_dom
ttcaaaggacggttacccatgctgtaagggttgttccgttgttgatcaagatggttccggtaaatggggtattgaaaatggtaattggtgtggtattgactcttcatgtga

SEQ ID NO: 20312 - DNA, 121 bp, Neocallimastix californiae
  Dockerin_dom
atgttggtctgaaaagttaggatataaatgttgttcaacatgtacccaagtttattataatgatcaagatggtagttggggtgttgaaaacaatgactggtgtggtattccaaccaactgt

SEQ ID NO: 20313 - DNA, 117 bp, Neocallimastix californiae
  Dockerin_dom
ttgggctacttctttgggctacaagtgttgtagtaatccaaacactgaaagtgtttatgaagatgaaagtggtgaatggggtgttgaaaataatgactggtgtggtattgttaaagc

SEQ ID NO: 20314 - DNA, 123 bp, Neocallimastix californiae
  Dockerin_dom
atgttggtctattgcattaggctacccatgttgtgaggttaatgattttgttgttcaaactgatgaaaatggtgactggagtgttgaaaacaacgattggtgtggtattaagaactcttcttc

SEQ ID NO: 20315 - DNA, 120 bp, Neocallimastix californiae
  Dockerin_dom
ttgttggtctactgtattgggttacccatgttgtgaagttaacgattttattgttaacactgatgaatacggaagttggagtgttgaaaataacgattggtgcggtattaaaaacgcttc

SEQ ID NO: 20316 - DNA, 129 bp, Neocallimastix californiae
  Dockerin_dom
atgtttctcacttaatcttggttatccatgctgtgaaaatgatagtgacgataatattattttcaccgatgaaaatggtgattggggtattgaaaacaataattggtgtggcattggtaaatcttcatc

SEQ ID NO: 20317 - DNA, 123 bp, Neocallimastix californiae; identical to SEQ ID NO: 17699
  Dockerin_dom

SEQ ID NO: 20318 - DNA, 111 bp, Neocallimastix californiae; identical to SEQ ID NO: 15148
  Dockerin_dom

SEQ ID NO: 20319 - DNA, 120 bp, Neocallimastix californiae
  Dockerin_dom
atgtttctctattgctcttggttatccatgttgtaaaggtaatgacattgtttatacagatgatgacggtaattggggtgttgaaaacaacgaatggtgtggtattaatgatagtgaacc

SEQ ID NO: 20320 - DNA, 109 bp, Neocallimastix californiae; identical to SEQ ID NO: 17701
  Dockerin_dom

SEQ ID NO: 20321 - DNA, 117 bp, Neocallimastix californiae; identical to SEQ ID NO: 17704
  Dockerin_dom

SEQ ID NO: 20322 - DNA, 123 bp, Neocallimastix californiae; identical to SEQ ID NO: 17703
  Dockerin_dom

SEQ ID NO: 20323 - DNA, 111 bp, Neocallimastix californiae; identical to SEQ ID NO: 15155
  Dockerin_dom

SEQ ID NO: 20324 - DNA, 117 bp, Neocallimastix californiae; identical to SEQ ID NO: 17706
  Dockerin_dom

SEQ ID NO: 20325 - DNA, 123 bp, Neocallimastix californiae
  Dockerin_dom
ctgttgggctagatctcttggttacaactgttgtagcacttctacttgtagaaatgctcaattctctgataatgatggtcaatgggatattgaaaacggtaactggtgtggtatcgcaactac

SEQ ID NO: 20326 - DNA, 117 bp, Neocallimastix californiae
  Dockerin_dom
ctgttgggctaaagctttaggttacccatgttgtactcaagctactgaagttgtttacactgattctaatggtcaatggggtatccaaaataacgactggtgtggtaagccagattc

SEQ ID NO: 20327 - DNA, 114 bp, Neocallimastix californiae; identical to SEQ ID NO: 17709
  Dockerin_dom

SEQ ID NO: 20328 - DNA, 105 bp, Neocallimastix californiae; identical to SEQ ID NO: 15161
  Dockerin_dom

SEQ ID NO: 20329 - DNA, 102 bp, Neocallimastix californiae
  Dockerin_dom
ttacaagtgctgtactcaatctaaccctaccgttgtatacactgatgcttctggagaatgggctgttgaaaacggagattggtgtattattaagaagcaaga

SEQ ID NO: 20330 - DNA, 117 bp, Neocallimastix californiae
  Dockerin_dom
ttgtttcgctaaagctttaggttatgaatgttgtaatgataatgaaattgttacatctgatgaatctggtgattggggtgttaaggatggtgaatggtgtggtattggtggatcttc

SEQ ID NO: 20331 - DNA, 96 bp, Neocallimastix californiae
  Dockerin_dom
cccatgctgtaatgaatgtgacgttgtttatacagatgattctggtgactggggtattgaaaacaatgattggtgtttactcaagaaatcttgtaa

SEQ ID NO: 20332 - DNA, 100 bp, Neocallimastix californiae
  Dockerin_dom
aggttacagtaaatgtagtaactgtgatgttcaatactctgatggatccggtgattggggtgttgaaaatggtgactggtgtggtatcagcagtaaatgt

SEQ ID NO: 20333 - DNA, 123 bp, Neocallimastix californiae
  Dockerin_dom
ttcttgtttcagtgtaaaccttggctacagttgttgtaacggttgtgaagttgtttacactgattctgatggtaaatggggagttgaaaatggaaattggtgtggaataaagtcatcttgtaa

SEQ ID NO: 20334 - DNA, 111 bp, Neocallimastix californiae; identical to SEQ ID NO: 15165
  Dockerin_dom

SEQ ID NO: 20335 - DNA, 123 bp, Neocallimastix californiae
  Dockerin_dom
ttcttgtttcagtgtaaaccttggctacagttgttgtaacggttgtgaagttgtttacactgattctgatggtaaatggggagttgaaaatggtaattggtgtggaataaagtcatcttgtaa

SEQ ID NO: 20336 - DNA, 111 bp, Neocallimastix californiae; identical to SEQ ID NO: 15165
  Dockerin_dom

SEQ ID NO: 20337 - DNA, 93 bp, Neocallimastix californiae
  Dockerin_dom
tccatgctgtgtcggtagtaaggtaattgaaacagacaaacaaggtgattggggttatgaagataatcactggtgtggtatagttaagaagga

SEQ ID NO: 20338 - DNA, 126 bp, Neocallimastix californiae
  Dockerin_dom
ttgctggtcaacagtcctgggatatgactgttgtaaaggatgtcatgtttatgaagaagatactgacggaaaatggggttatgaaaataaaaaatggtgtggtattgatgatgaagtatgcaataa

SEQ ID NO: 20339 - DNA, 93 bp, Neocallimastix californiae
  Dockerin_dom
tccatgttgtaaaggtaatgatattataacaacagatagtcaaggagattggggttatgaagataaacattggtgtggtataataaagaaaac

SEQ ID NO: 20340 - DNA, 93 bp, Neocallimastix californiae; identical to SEQ ID NO: 20337
  Dockerin_dom

SEQ ID NO: 20341 - DNA, 126 bp, Neocallimastix californiae
  Dockerin_dom
ttgctggtcgacagtcttgggatatgactgttgtaaaggatgtcatgtttatgaagaagatactgacggaaaatggggttatgaaaataaaaaatggtgtggtattgatgatgaagtatgcaataa

SEQ ID NO: 20342 - DNA, 93 bp, Neocallimastix californiae; identical to SEQ ID NO: 20339
  Dockerin_dom

SEQ ID NO: 20343 - DNA, 111 bp, Neocallimastix californiae; identical to SEQ ID NO: 17727
  Dockerin_dom

SEQ ID NO: 20344 - DNA, 126 bp, Neocallimastix californiae
  Dockerin_dom
ttgctgggcagaagctgaaggtttcagatgctgtaaaggttgcgaagctatctatattgatggtgataaaagatggggtgttgaaaatatggaatggtgtggtattatcgaatctaattgtaaagc

SEQ ID NO: 20345 - DNA, 117 bp, Neocallimastix californiae; identical to SEQ ID NO: 17726
  Dockerin_dom

SEQ ID NO: 20346 - DNA, 121 bp, Neocallimastix californiae; identical to SEQ ID NO: 17728
  Dockerin_dom

SEQ ID NO: 20347 - DNA, 117 bp, Neocallimastix californiae; identical to SEQ ID NO: 17729
  Dockerin_dom

SEQ ID NO: 20348 - DNA, 121 bp, Neocallimastix californiae; identical to SEQ ID NO: 17730
  Dockerin_dom

SEQ ID NO: 20349 - DNA, 117 bp, Neocallimastix californiae; identical to SEQ ID NO: 17731
  Dockerin_dom

SEQ ID NO: 20350 - DNA, 105 bp, Neocallimastix californiae
  Dockerin_dom
ttttggctacaagtgctgtgaaacatgtgaagttcaatactctgatgatactggatcttggggtattgaaaataatgattggtgtggtattccagattcatgcaa

SEQ ID NO: 20351 - DNA, 87 bp, Neocallimastix californiae
  Dockerin_dom
cccaacatgttcagctaatattgaaattgcttacgttgatgacagaatttggggtattgaaaatggcgactggtgtattattaaatc

SEQ ID NO: 20352 - DNA, 111 bp, Neocallimastix californiae; identical to SEQ ID NO: 17735
  Dockerin_dom

SEQ ID NO: 20353 - DNA, 120 bp, Neocallimastix californiae; identical to SEQ ID NO: 17734
  Dockerin_dom

SEQ ID NO: 20354 - DNA, 105 bp, Neocallimastix californiae
  Dockerin_dom
ctatccatgttgtgataaaacaactgaagttgtttatgaagatgaagatggtaaatggggtgttcaaaatggtgatgaatggtgtttaataaaggaaaataaagc

SEQ ID NO: 20355 - DNA, 108 bp, Neocallimastix californiae
  Dockerin_dom
tcaagaatatggtgaatgtacttcttgtgttgttcaatataaggatcaagatggtaactggggttatgaaaatgatgactggtgcttaattaatgataaaaaatgtga

SEQ ID NO: 20356 - DNA, 117 bp, Neocallimastix californiae
  Dockerin_dom
atgttggagtaaagcccttggatatccatgctgtactactacaaaggaagttgtatataccgatgaaagcggtaaatggggtcttgaaggaaatgatgaatggtgtggtattgttga

SEQ ID NO: 20357 - DNA, 99 bp, Neocallimastix californiae
  Dockerin_dom
tccatgttgtagctcttgtactgttgtctacaatgacagtgatggtgattggggtgttgaaaatggtaactggtgtaagattaaggccgataaatgtgg

SEQ ID NO: 20358 - DNA, 111 bp, Neocallimastix californiae; identical to SEQ ID NO: 17741
  Dockerin_dom

SEQ ID NO: 20359 - DNA, 118 bp, Neocallimastix californiae
  Dockerin_dom
ttgtactggaaagagtgaaggttataagtgctgtgacaactgtgatgtagtttacactgatgactctggtgcttggggtattatgaatggagattggtgtggtattaagagtacttgt

SEQ ID NO: 20360 - DNA, 105 bp, Neocallimastix californiae; identical to SEQ ID NO: 17744
  Dockerin_dom

SEQ ID NO: 20361 - DNA, 96 bp, Neocallimastix californiae; identical to SEQ ID NO: 17743
  Dockerin_dom

SEQ ID NO: 20362 - DNA, 117 bp, Neocallimastix californiae; identical to SEQ ID NO: 17742
  Dockerin_dom

SEQ ID NO: 20363 - DNA, 114 bp, Neocallimastix californiae; identical to SEQ ID NO: 17745
  Dockerin_dom

SEQ ID NO: 20364 - DNA, 117 bp, Neocallimastix californiae
  Dockerin_dom
ctgttggtctcttaagttaggttacccatgttgtcaaaacactaatgtcgtctattacacagatgatgatggtgattggagtgttgaaaataatgactggtgtggtattgttaaggg

SEQ ID NO: 20365 - DNA, 114 bp, Neocallimastix californiae
  Dockerin_dom
ctggtctactgcattaggttacccatgttgtaaaaactctagtattgtttatttcactgataatgatggtaaatggagtgttgaaaataatgattggtgtggtattattgaagg

SEQ ID NO: 20366 - DNA, 114 bp, Neocallimastix californiae; identical to SEQ ID NO: 17747
  Dockerin_dom

SEQ ID NO: 20367 - DNA, 117 bp, Neocallimastix californiae
  Dockerin_dom
tttttctgaagcattaggttatccttgttgtagtagtggtgtagcagtcgtatacactgataatgatggaccatggggtgtggaaaacaatgattggtgtggtattactaataattc

SEQ ID NO: 20368 - DNA, 117 bp, Neocallimastix californiae; identical to SEQ ID NO: 17750
  Dockerin_dom

SEQ ID NO: 20369 - DNA, 96 bp, Neocallimastix californiae
  Dockerin_dom
cccatgttgtagtacttgtgaagcttcctatgttgataatgaaggtggttggaatgttgaaaataatgactggtgtaagattgatgacaaaaaaat

SEQ ID NO: 20370 - DNA, 114 bp, Neocallimastix californiae
  Dockerin_dom
ctgtttcgcccttgatttaggtttcaaatgttgtaataataatgaagttgtctataccgatcaagatggtaagtggggatataccgatgactggtgtggtattggtggttccag

SEQ ID NO: 20371 - DNA, 120 bp, Neocallimastix californiae; identical to SEQ ID NO: 17753
  Dockerin_dom

SEQ ID NO: 20372 - DNA, 120 bp, Neocallimastix californiae; identical to SEQ ID NO: 17754
  Dockerin_dom

SEQ ID NO: 20373 - DNA, 126 bp, Neocallimastix californiae; identical to SEQ ID NO: 17755
  Dockerin_dom

SEQ ID NO: 20374 - DNA, 123 bp, Neocallimastix californiae
  Dockerin_dom
ttgttggtcagaagcattaggatattcatgttgtactaattcatcttctccagtagtttatactgatgatgatggtcaatggagtgttgaaaataatgaatggtgtggtattttgaaaaataa

SEQ ID NO: 20375 - DNA, 73 bp, Neocallimastix californiae; identical to SEQ ID NO: 15207
  Dockerin_dom

SEQ ID NO: 20376 - DNA, 117 bp, Neocallimastix californiae; identical to SEQ ID NO: 17758
  Dockerin_dom

SEQ ID NO: 20377 - DNA, 109 bp, Neocallimastix californiae
  Dockerin_dom
tcaaggatatccatgctgccaaaattcttgtattgtatactctaccgatgctgacggtagatggagtattgaaaatggtgactggtgtttaataaaaaataacagttgt

SEQ ID NO: 20378 - DNA, 123 bp, Neocallimastix californiae
  Dockerin_dom
ttcttgctggtcttctagattaggttatccatgttgtaagagctgcaatgttgttttcactgataatgatggaaaatggggtgttgaaaatgatgactggtgtggtatttccagtacttgtaa

SEQ ID NO: 20379 - DNA, 123 bp, Neocallimastix californiae
  Dockerin_dom
ctgttgggcttctgctttaggtttcaactgttgtaagactactaagactgttgtctttgaagatcaagatggtagttggggtgttgaagatgatttctggtgtggtatcgttgaagataagga

SEQ ID NO: 20380 - DNA, 123 bp, Neocallimastix californiae
  Dockerin_dom
tgcttcttcaattattgctcaaggttataaatgctgttcttctaattgtgaagtagtttatgtagatgatgatggtaactggggtgttgaaaatggacaatggtgtggttgtggtgtgagtgt

SEQ ID NO: 20381 - DNA, 99 bp, Neocallimastix californiae; identical to SEQ ID NO: 17762
  Dockerin_dom

SEQ ID NO: 20382 - DNA, 70 bp, Neocallimastix californiae; identical to SEQ ID NO: 15214
  Dockerin_dom

SEQ ID NO: 20383 - DNA, 108 bp, Neocallimastix californiae
  Dockerin_dom
aaattctggttaccaatgttgtgataattgtgacgttgtttatgaagatgaatctggaaaatggggtattaaggataatgattggtgtgttctttctgataaatgtaa

SEQ ID NO: 20384 - DNA, 103 bp, Neocallimastix californiae
  Dockerin_dom
tgatggatatgaatgttgtagtggatgcagtgttgttgataactcagatggaatcaaatggggtgttgaaaatgacaactggtgtattatcaagaacacttgt

SEQ ID NO: 20385 - DNA, 120 bp, Neocallimastix californiae; identical to SEQ ID NO: 17767
  Dockerin_dom

SEQ ID NO: 20386 - DNA, 123 bp, Neocallimastix californiae; identical to SEQ ID NO: 17769
  Dockerin_dom

SEQ ID NO: 20387 - DNA, 99 bp, Neocallimastix californiae
  Dockerin_dom
caattgctgtaattcttgtgacgttgtatacactgataatgaaggtgaatggggtgtcgaaaataacaattggtgttttataaatgatgcaaagtgtca

SEQ ID NO: 20388 - DNA, 114 bp, Neocallimastix californiae; identical to SEQ ID NO: 17771
  Dockerin_dom

SEQ ID NO: 20389 - DNA, 114 bp, Neocallimastix californiae; identical to SEQ ID NO: 17770
  Dockerin_dom

SEQ ID NO: 20390 - DNA, 120 bp, Neocallimastix californiae; identical to SEQ ID NO: 17773
  Dockerin_dom

SEQ ID NO: 20391 - DNA, 117 bp, Neocallimastix californiae
  Dockerin_dom
ggcttctgctttaggtttcaactgttgtaagactactaagactgttgtctttgaagatcaagatggtagttggggtgttgaagatgatttctggtgtggtatcgttgaagataagga

SEQ ID NO: 20392 - DNA, 108 bp, Neocallimastix californiae; identical to SEQ ID NO: 15223
  Dockerin_dom

SEQ ID NO: 20393 - DNA, 123 bp, Neocallimastix californiae; identical to SEQ ID NO: 17776
  Dockerin_dom

SEQ ID NO: 20394 - DNA, 111 bp, Neocallimastix californiae
  Dockerin_dom
ttgtttctctgaaagattaggttatccatgttgttctggtgacgaagttgtttacactgataatgatggtaagtggggtgttgaaaatggtaattggtgtggtattgccga

SEQ ID NO: 20395 - DNA, 111 bp, Neocallimastix californiae
  Dockerin_dom
ttgtttctctgaaagattaggttatccatgttgttctggtaacgaagttgtttacactgataatgatggtaaatggggtgttgaaaatggtaattggtgtggtattgccga

SEQ ID NO: 20396 - DNA, 120 bp, Neocallimastix californiae; identical to SEQ ID NO: 17778
  Dockerin_dom

SEQ ID NO: 20397 - DNA, 120 bp, Neocallimastix californiae; identical to SEQ ID NO: 17780
  Dockerin_dom

SEQ ID NO: 20398 - DNA, 111 bp, Neocallimastix californiae
  Dockerin_dom
ttgtttctctgaaagattaggttatccatgttgttctggtaacgaagttgtttacactgataatgatggtaagtggggtgttgaaaatggtaactggtgtggtattgccga

SEQ ID NO: 20399 - DNA, 111 bp, Neocallimastix californiae; identical to SEQ ID NO: 17781
  Dockerin_dom

SEQ ID NO: 20400 - DNA, 120 bp, Neocallimastix californiae; identical to SEQ ID NO: 17782
  Dockerin_dom

SEQ ID NO: 20401 - DNA, 111 bp, Neocallimastix californiae; identical to SEQ ID NO: 17781
  Dockerin_dom

SEQ ID NO: 20402 - DNA, 76 bp, Neocallimastix californiae; identical to SEQ ID NO: 15233
  Dockerin_dom

SEQ ID NO: 20403 - DNA, 120 bp, Neocallimastix californiae; identical to SEQ ID NO: 17785
  Dockerin_dom

SEQ ID NO: 20404 - DNA, 126 bp, Neocallimastix californiae
  Dockerin_dom
atgttgggctaaggcattaggatttgagtgttgtacttcagaagatattgaagttcaatacactgacaaagatggaaaatggggaattgaaaattatgaatggtgtggtattattgaagataaacc

SEQ ID NO: 20405 - DNA, 120 bp, Neocallimastix californiae
  Dockerin_dom
ttgctggtctcttgcttatggttacgattgctgtaaaggttgtgaagtttctttcattgataatgatggtaaatggggttttgaaaatgaagaatggtgtggtattaaagaagattgtgc

SEQ ID NO: 20406 - DNA, 120 bp, Neocallimastix californiae; identical to SEQ ID NO: 17788
  Dockerin_dom

SEQ ID NO: 20407 - DNA, 96 bp, Neocallimastix californiae
  Dockerin_dom
cagtacttgtaaaaacacttgcgaaattgaatatgaagatgataataaatggggtattgaaaataatgaatggtgtattcttccaggttcatgctt

SEQ ID NO: 20408 - DNA, 90 bp, Neocallimastix californiae
  Dockerin_dom
tccatgttgtagttcaggtattgaagttgcatatgttgatgatcaaggtgaatggggtgttgaaaacggtgaatggtgtggtattgagcc

SEQ ID NO: 20409 - DNA, 111 bp, Neocallimastix californiae
  Dockerin_dom
ctggtctgatccatatccatgctgtgaaggaactacagttgaatatgttgatgatcaaggagaatggggtgttgaaaatggtgaatggtgtggtattgttaagagtaaaaa

SEQ ID NO: 20410 - DNA, 96 bp, Neocallimastix californiae
  Dockerin_dom
tccatgttgtaaaaatactagatattcttactacactgatagtgcaggtaatgaatggggtgttgaaaatggtgattggtgtggtattattccaca

SEQ ID NO: 20411 - DNA, 102 bp, Neocallimastix californiae
  Dockerin_dom
ttacaactgttgtagaaatacttgtgatatctcttacgtagatgaggatggtaactggggtgttgaaaatggtaattggtgtggtgtaccattctcttgttt

SEQ ID NO: 20412 - DNA, 120 bp, Neocallimastix californiae; identical to SEQ ID NO: 17795
  Dockerin_dom

SEQ ID NO: 20413 - DNA, 96 bp, Neocallimastix californiae
  Dockerin_dom
tccatgctgtacctcatgtgatgttgttgaatcggatggtgatcaaagatggggtattgaaaataatgaatggtgtggtataccagattcttgtcc

SEQ ID NO: 20414 - DNA, 96 bp, Neocallimastix californiae
  Dockerin_dom
cccatgttgtaatagttgtgatgtttcttactcagacagtattggtgattggggtattgaaaataatgattggtgcggtatcaagtcgtcttgcaa

SEQ ID NO: 20415 - DNA, 112 bp, Neocallimastix californiae
  Dockerin_dom
agctcaaggttatccatgttgtaagagtagttgtgccatttacagtagcgatagtgatggtgactggagtattgaaaatggtgattggtgtttaattgacaagaaggcttgt

SEQ ID NO: 20416 - DNA, 126 bp, Neocallimastix californiae
  Dockerin_dom
cacttgctgggctaaggctttaggttatgaatgttgtaagtcttgtcttccagttgttaccactgatggtgatggttcatggagtgttgtaaatgatgactggtgtggtcttccaactagctgtaa

SEQ ID NO: 20417 - DNA, 126 bp, Neocallimastix californiae; identical to SEQ ID NO: 20416
  Dockerin_dom

SEQ ID NO: 20418 - DNA, 112 bp, Neocallimastix californiae; identical to SEQ ID NO: 20415
  Dockerin_dom

SEQ ID NO: 20419 - DNA, 120 bp, Neocallimastix californiae
  Dockerin_dom
ttcctctaagattacttctcaaggttacagttgctgttctgctagctgtgaaattgtctacactgatgatgatggtacttggggtgtcgaaaatggtgactggtgtggatgtggaggagg

SEQ ID NO: 20420 - DNA, 99 bp, Neocallimastix californiae; identical to SEQ ID NO: 17801
  Dockerin_dom

SEQ ID NO: 20421 - DNA, 117 bp, Neocallimastix californiae
  Dockerin_dom
agcttcaattaccaaccaaggatatgcttgctgtgctgttggttgtgaagttgtttacactgataatgatggtgaatggggagttgaaaacaatgaatggtgtggatgtggtaaagc

SEQ ID NO: 20422 - DNA, 124 bp, Neocallimastix californiae
  Dockerin_dom
ttctagtgctattcttgctcaaggatattcatgctgttcttcatgtggtaccgtttactacaccgatgctgatggtgactggggtgttgaaaacaatgactggtgtggtatgccaaccaaatgt

SEQ ID NO: 20423 - DNA, 82 bp, Neocallimastix californiae; identical to SEQ ID NO: 15255
  Dockerin_dom

SEQ ID NO: 20424 - DNA, 112 bp, Neocallimastix californiae
  Dockerin_dom
agctcaaggatatccatgctgtcaaaaaacatgtgaagtatattccacagatagtgatggtagttggaatattgaaaataatgactggtgtttaattgacaaatcaaagtgt

SEQ ID NO: 20425 - DNA, 123 bp, Neocallimastix californiae; identical to SEQ ID NO: 17806
  Dockerin_dom

SEQ ID NO: 20426 - DNA, 114 bp, Neocallimastix californiae; identical to SEQ ID NO: 17809
  Dockerin_dom

SEQ ID NO: 20427 - DNA, 129 bp, Neocallimastix californiae
  Dockerin_dom
ctgttggtctgaaacttacggttacccatgctgtcaatctacttgtgcccgtcttattgaagatgaaagtggtgcctggggtgctgaaaatggtgaatggtgtggtattcaagctgaaaattgtaagaa

SEQ ID NO: 20428 - DNA, 129 bp, Neocallimastix californiae; identical to SEQ ID NO: 20427
  Dockerin_dom

SEQ ID NO: 20429 - DNA, 114 bp, Neocallimastix californiae; identical to SEQ ID NO: 17809
  Dockerin_dom

SEQ ID NO: 20430 - DNA, 120 bp, Neocallimastix californiae; identical to SEQ ID NO: 17812
  Dockerin_dom

SEQ ID NO: 20431 - DNA, 126 bp, Neocallimastix californiae
  Dockerin_dom
aagctgctggtcgacttcacttggttatccatgttgtaaaactaattgtgaagttcttgatacagatgataatggtaattggggtgttgaaaatgatgaatggtgtggtatttctgaatcttgtgg

SEQ ID NO: 20432 - DNA, 99 bp, Neocallimastix californiae
  Dockerin_dom
cgattgttgtaaaggatgtcaaaccattttaactgatgaagaaggcaattggggttctgaaaatggtcagtggtgttttgttgatgaaaaaaaatgtga

SEQ ID NO: 20433 - DNA, 120 bp, Neocallimastix californiae; identical to SEQ ID NO: 17814
  Dockerin_dom

SEQ ID NO: 20434 - DNA, 117 bp, Neocallimastix californiae
  Dockerin_dom
ttgctggtccgagccagattatccatgctgtaaggataatagtaacattgtatactctgatggtcaaggtgattggggttatgaaaatgaaaactggtgtggaattgtaaaagatag

SEQ ID NO: 20435 - DNA, 114 bp, Neocallimastix californiae
  Dockerin_dom
ctggtctcttccaagttatccatgttgtacagaagaacaagaaccagtttatgttgatgatcttggtaaatggggtattgaaaataatgactggtgtggtattaagccaactca

SEQ ID NO: 20436 - DNA, 120 bp, Neocallimastix californiae; identical to SEQ ID NO: 17816
  Dockerin_dom

SEQ ID NO: 20437 - DNA, 99 bp, Neocallimastix californiae
  Dockerin_dom
tttatgttgtaaggaaggaacagaagttatttatactgatgaggaaggtgattggggcttagatggaaagaactggtgtaaaataaagaaggctaagga

SEQ ID NO: 20438 - DNA, 118 bp, Neocallimastix californiae
  Dockerin_dom
ttgtacaggttcaaatgatggttactcatgttgtaaaacctgtaatgttgcttacactgatgatcaaggtgattggggttttgaaaatgatgaatggtgtggtatcaaatcttcttgt

SEQ ID NO: 20439 - DNA, 120 bp, Neocallimastix californiae; identical to SEQ ID NO: 17819
  Dockerin_dom

SEQ ID NO: 20440 - DNA, 120 bp, Neocallimastix californiae; identical to SEQ ID NO: 17823
  Dockerin_dom

SEQ ID NO: 20441 - DNA, 96 bp, Neocallimastix californiae
  Dockerin_dom
cccatgctgtaagggttgcgatgttgcattctctgacactactggtgattggggtgttgaaaataatgaatggtgtggtattaaatccacttgtaa

SEQ ID NO: 20442 - DNA, 96 bp, Neocallimastix californiae
  Dockerin_dom
cccatgttgtacttcatgtaatgttgtagaaactgatggtaatcaaagatggggtattgaaaataatgaatggtgtggtattccagactcttgccc

SEQ ID NO: 20443 - DNA, 96 bp, Neocallimastix californiae; identical to SEQ ID NO: 17825
  Dockerin_dom

SEQ ID NO: 20444 - DNA, 114 bp, Neocallimastix californiae
  Dockerin_dom
ctgggctaaggctttaggttatgaatgttgtaaaacttgccaagcttctcaattaaaggatgaaagtggtgattggggtattgaaaatggtgaatggtgtggtattaccggtga

SEQ ID NO: 20445 - DNA, 105 bp, Neocallimastix californiae; identical to SEQ ID NO: 17827
  Dockerin_dom

SEQ ID NO: 20446 - DNA, 96 bp, Neocallimastix californiae
  Dockerin_dom
tccatgctgttcaagctgtcaaactatatacagtgataatgatggagattggggatacgaagacgataaatggtgtggtattaaggatagttgtaa

SEQ ID NO: 20447 - DNA, 120 bp, Neocallimastix californiae; identical to SEQ ID NO: 17829
  Dockerin_dom

SEQ ID NO: 20448 - DNA, 120 bp, Neocallimastix californiae; identical to SEQ ID NO: 17828
  Dockerin_dom

SEQ ID NO: 20449 - DNA, 117 bp, Neocallimastix californiae
  Dockerin_dom
ctggtctcttccagactatccatgttgtgaagaaagtaccgatgtagtatattcagatgaaagtggtgattggagtgttgaaaatgatgattggtgtggtatcattaaatccacctc

SEQ ID NO: 20450 - DNA, 126 bp, Neocallimastix californiae
  Dockerin_dom
ttgctggtcagaaagtcaaggctacaattgctgttctggctgtgaagttgtttatgaagacgattctggtaagtggggtgttgaaaatgatgattggtgtggtattgaagactctgtctgtaatcc

SEQ ID NO: 20451 - DNA, 117 bp, Neocallimastix californiae; identical to SEQ ID NO: 17833
  Dockerin_dom

SEQ ID NO: 20452 - DNA, 117 bp, Neocallimastix californiae; identical to SEQ ID NO: 17834
  Dockerin_dom

SEQ ID NO: 20453 - DNA, 120 bp, Neocallimastix californiae; identical to SEQ ID NO: 17835
  Dockerin_dom

SEQ ID NO: 20454 - DNA, 114 bp, Neocallimastix californiae
  Dockerin_dom
tgctgctggttacccatgctgtgccagatcctgcattgttgtcactaaagatgatgatggctactggggtattgaaaataataactggtgtctcattgataaggacctctgtat

SEQ ID NO: 20455 - DNA, 112 bp, Neocallimastix californiae; identical to SEQ ID NO: 15287
  Dockerin_dom

SEQ ID NO: 20456 - DNA, 108 bp, Neocallimastix californiae; identical to SEQ ID NO: 15289
  Dockerin_dom

SEQ ID NO: 20457 - DNA, 96 bp, Neocallimastix californiae
  Dockerin_dom
ttatccatgttgtaaaggaaatactgtaatttatactgatgagcaaggtgcatggggtattgaaaatgataactggtgtggaatagaatcatcatc

SEQ ID NO: 20458 - DNA, 117 bp, Neocallimastix californiae
  Dockerin_dom
atgttggtcagaaaaattgggctatccatgctgtaaatcaacaaatgatgtttattacgaagatgatgatggtcaatggggtgttgaaaacaatgattggtgcggcatccaaagtat

SEQ ID NO: 20459 - DNA, 123 bp, Neocallimastix californiae
  Dockerin_dom
atgctggtctgaaaaattaggttatccatgttgcaattcaactaatgaagttgtttatgaagataatgatggaccatggggagttgaaaacaataattggtgtggtattatcaacaataaacc

SEQ ID NO: 20460 - DNA, 111 bp, Neocallimastix californiae
  Dockerin_dom
ttggtctcttccagaatatccatgttgtgaaggtaattctattgttacttcagacagtcaaggagattggggatatgaaaataatcattggtgtggtattatcaagaagga

SEQ ID NO: 20461 - DNA, 93 bp, Neocallimastix californiae
  Dockerin_dom
tccatgttgtgaaggtaataccatcgttactacagatagtcatggagattggggttatgaaaataaccattggtgtggtatactaaagcaaac

SEQ ID NO: 20462 - DNA, 123 bp, Neocallimastix californiae; identical to SEQ ID NO: 17842
  Dockerin_dom

SEQ ID NO: 20463 - DNA, 120 bp, Neocallimastix californiae
  Dockerin_dom
ttgctggtctgaaccagattacaaatgctgttctacttgtgatattgtttacactgatgatcataattggggtgttgaagatgatgaatggtgtggtattgatgatgccaaatgtaattc

SEQ ID NO: 20464 - DNA, 118 bp, Neocallimastix californiae
  Dockerin_dom
atgtggagctgctgctatcggttacccatgttgtgaaaatacctgtactgaagtctacactgatgaatacagatggggtgttgaaaacaatgactggtgtggtcttaaggattcatgc

SEQ ID NO: 20465 - DNA, 129 bp, Neocallimastix californiae; identical to SEQ ID NO: 17848
  Dockerin_dom

SEQ ID NO: 20466 - DNA, 115 bp, Neocallimastix californiae
  Dockerin_dom
tccaggttcaaatcaaggttattcatgctgtaaaacctgtgaagtttatatgacggatgaaactggaccatggaatattgaaaatgatgagtggtgtagtgtaaaaactaattgt

SEQ ID NO: 20467 - DNA, 99 bp, Neocallimastix californiae; identical to SEQ ID NO: 17850
  Dockerin_dom

SEQ ID NO: 20468 - DNA, 123 bp, Neocallimastix californiae
  Dockerin_dom
ttctgccaagattgttcaacaaggttacaagtgttgtggtaacaactgtattgttgtttaccaagataatgatggttactggggtgttgaaaacaaccaatggtgtggatgtggaactgaagc

SEQ ID NO: 20469 - DNA, 117 bp, Neocallimastix californiae; identical to SEQ ID NO: 17852
  Dockerin_dom

SEQ ID NO: 20470 - DNA, 117 bp, Neocallimastix californiae; identical to SEQ ID NO: 17851
  Dockerin_dom

SEQ ID NO: 20471 - DNA, 120 bp, Neocallimastix californiae; identical to SEQ ID NO: 17853
  Dockerin_dom

SEQ ID NO: 20472 - DNA, 123 bp, Neocallimastix californiae
  Dockerin_dom
tgagtgtgtcgtcgcttctttgggttatgcctgttgttctccaggtaacactgtagtctactaccaagatgaaaatggtgattggggtgttgaaaatgatgactggtgtggtattactagagc

SEQ ID NO: 20473 - DNA, 123 bp, Neocallimastix californiae
  Dockerin_dom
ctcctgctggtctaaggctttaggatataactgctgtacctcaacttcagatgtaatcttcgaagacagtgatggtcaatggggtattgaaaacgacgattggtgtggtattgttaaaaacaa

SEQ ID NO: 20474 - DNA, 120 bp, Neocallimastix californiae; identical to SEQ ID NO: 17855
  Dockerin_dom

SEQ ID NO: 20475 - DNA, 132 bp, Neocallimastix californiae; identical to SEQ ID NO: 17857
  Dockerin_dom

SEQ ID NO: 20476 - DNA, 96 bp, Neocallimastix californiae; identical to SEQ ID NO: 15309
  Dockerin_dom

SEQ ID NO: 20477 - DNA, 129 bp, Neocallimastix californiae; identical to SEQ ID NO: 17859
  Dockerin_dom

SEQ ID NO: 20478 - DNA, 99 bp, Neocallimastix californiae
  Dockerin_dom
tgaatgttgcagtaactgtgaagttatatattcagatgatgaaggtgattggggtgtagaaaattatgattggtgttttattgataaatctaaatgtga

SEQ ID NO: 20479 - DNA, 105 bp, Neocallimastix californiae
  Dockerin_dom
tggatacccaaaatgtagttcttgtgtagtatattacactgatgagaatggcgattggggtgtagaaaacaatgattggtgtcttattcaaaaaagtagatgtgg

SEQ ID NO: 20480 - DNA, 120 bp, Neocallimastix californiae; identical to SEQ ID NO: 17863
  Dockerin_dom

SEQ ID NO: 20481 - DNA, 120 bp, Neocallimastix californiae; identical to SEQ ID NO: 17862
  Dockerin_dom

SEQ ID NO: 20482 - DNA, 117 bp, Neocallimastix californiae; identical to SEQ ID NO: 17864
  Dockerin_dom

SEQ ID NO: 20483 - DNA, 117 bp, Neocallimastix californiae
  Dockerin_dom
cagcattactgatcaaggttacaaatgttgttcaacttgtggtaccgtttactacactgatgacgatggtgattggggtgttgaaaacaatgaatggtgtggtatgccatgcaattg

SEQ ID NO: 20484 - DNA, 118 bp, Neocallimastix californiae
  Dockerin_dom
cagcattactgatcaaggttacagttgttgttcagtttgtggtaccgtttactacactgatggcgatggtgattggggtgttgaaaacaatcaatggtgtggtatgccatatgattgt

SEQ ID NO: 20485 - DNA, 117 bp, Neocallimastix californiae; identical to SEQ ID NO: 17866
  Dockerin_dom

SEQ ID NO: 20486 - DNA, 117 bp, Neocallimastix californiae
  Dockerin_dom
ttggtctgaacagttaggttatccatgttgtcaaggatgtaccgtttttgaaactgatgctgatggctcttggggttacgaaagtaatcactggtgtggtattcaatcttactgcaa

SEQ ID NO: 20487 - DNA, 126 bp, Neocallimastix californiae; identical to SEQ ID NO: 17868
  Dockerin_dom

SEQ ID NO: 20488 - DNA, 120 bp, Neocallimastix californiae; identical to SEQ ID NO: 17871
  Dockerin_dom

SEQ ID NO: 20489 - DNA, 114 bp, Neocallimastix californiae; identical to SEQ ID NO: 17870
  Dockerin_dom

SEQ ID NO: 20490 - DNA, 120 bp, Neocallimastix californiae; identical to SEQ ID NO: 17873
  Dockerin_dom

SEQ ID NO: 20491 - DNA, 108 bp, Neocallimastix californiae; identical to SEQ ID NO: 15323
  Dockerin_dom

SEQ ID NO: 20492 - DNA, 120 bp, Neocallimastix californiae
  Dockerin_dom
ttgggcttctgctttaggtttcaactgttgtaagactactaagactgttgtctttgaagatcaagatggtagttggggtgttgaagatgatttctggtgtggtatcgttgaagataagga

SEQ ID NO: 20493 - DNA, 111 bp, Neocallimastix californiae
  Dockerin_dom
ttgtttctctgaaagattaggttatccatgttgttctggtaatgaagttgtttacactgataatgatggtaagtggggtgttgaaaatggtaattggtgtggtattgctga

SEQ ID NO: 20494 - DNA, 120 bp, Neocallimastix californiae; identical to SEQ ID NO: 17876
  Dockerin_dom

SEQ ID NO: 20495 - DNA, 118 bp, Neocallimastix californiae
  Dockerin_dom
atgttttgctgaaaaattaggttacccatgttgtagttcatgtgatgttctttacactgataatgatggtgaatggggtgttgaaaatgataattggtgtggtattaaggattcttgt

SEQ ID NO: 20496 - DNA, 117 bp, Neocallimastix californiae; identical to SEQ ID NO: 17878
  Dockerin_dom

SEQ ID NO: 20497 - DNA, 123 bp, Neocallimastix californiae; identical to SEQ ID NO: 17879
  Dockerin_dom

SEQ ID NO: 20498 - DNA, 123 bp, Neocallimastix californiae; identical to SEQ ID NO: 17881
  Dockerin_dom

SEQ ID NO: 20499 - DNA, 123 bp, Neocallimastix californiae
  Dockerin_dom
ttcatcaaagattactgatctcggttacaagtgttgttcctctggttgtcaagttgtttacactgatgatgatggaacatggggtgttgaaaatgaagaatggtgtggatgtggacaagaagt

SEQ ID NO: 20500 - DNA, 120 bp, Neocallimastix californiae; identical to SEQ ID NO: 17883
  Dockerin_dom

SEQ ID NO: 20501 - DNA, 111 bp, Neocallimastix californiae
  Dockerin_dom
ttggtctcttccaagttatccatgttgttctagtggaattgaatctgcttatgaagatgatcttggtaagtggggtatagaaaatggtgattggtgtggtattaaacctac

SEQ ID NO: 20502 - DNA, 114 bp, Neocallimastix californiae
  Dockerin_dom
atgttggtctgaaccagattacccatgttgttctggtaatactgaaattatttattctgatgcttctggcgattggggttatgaaaataacaattggtgtggtattataagtac

SEQ ID NO: 20503 - DNA, 114 bp, Neocallimastix californiae; identical to SEQ ID NO: 20502
  Dockerin_dom

SEQ ID NO: 20504 - DNA, 120 bp, Neocallimastix californiae; identical to SEQ ID NO: 17883
  Dockerin_dom

SEQ ID NO: 20505 - DNA, 111 bp, Neocallimastix californiae; identical to SEQ ID NO: 20501
  Dockerin_dom

SEQ ID NO: 20506 - DNA, 120 bp, Neocallimastix californiae; identical to SEQ ID NO: 17888
  Dockerin_dom

SEQ ID NO: 20507 - DNA, 129 bp, Neocallimastix californiae
  Dockerin_dom
ctgttgggcaagtactattggattcccatgttgtaagagtagttgtgaagttgcttacactgataatgacggtgattgggctattgaaaatgatgaatggtgtggaattgatccttctaaatgtaagaa

SEQ ID NO: 20508 - DNA, 120 bp, Neocallimastix californiae; identical to SEQ ID NO: 17893
  Dockerin_dom

SEQ ID NO: 20509 - DNA, 120 bp, Neocallimastix californiae; identical to SEQ ID NO: 17892
  Dockerin_dom

SEQ ID NO: 20510 - DNA, 123 bp, Neocallimastix californiae
  Dockerin_dom
ttggtccgaaaatttaggagaaaaatcacgtccatgttgtaaaaatgatgatggaatagttgtgttaaaggatatgaatggatcatggggtttagaagaggatggaatgtgtggttatagaaa

SEQ ID NO: 20511 - DNA, 120 bp, Neocallimastix californiae
  Dockerin_dom
ttggtctgaaccacttggttatccatgttgtaaagaaacaaagaaaatcgaatactatgatgataatggaccatggggaatggaaaatgatgattggtgtggtattgatgatgagaagtg

SEQ ID NO: 20512 - DNA, 114 bp, Neocallimastix californiae
  Dockerin_dom
ttgggcctataagttaggttatccatgttgtgaaggtaatactataatagaaattaatgaagatggaaaatggggtattgaaaatgatgaatggtgtggtgtcattgaagaaac

SEQ ID NO: 20513 - DNA, 120 bp, Neocallimastix californiae
  Dockerin_dom
ttgctggactttagatcaaagttatccatgttgttcaagtttgagcgcaaaggttgatggatacagtgataaatggggttatgaaaacggagattggtgtggtttaactgatgaacaaat

SEQ ID NO: 20514 - DNA, 126 bp, Neocallimastix californiae
  Dockerin_dom
aagctgctggtcgacttcacttggttacccatgttgtaaaactaattgtgacgtcgttgttactgatggagatggtgattggggtgttgaaaatgatgaatggtgcggtatttctaactcttgtgg

SEQ ID NO: 20515 - DNA, 120 bp, Neocallimastix californiae; identical to SEQ ID NO: 17896
  Dockerin_dom

SEQ ID NO: 20516 - DNA, 126 bp, Neocallimastix californiae
  Dockerin_dom
ctgctggtcagaaaaattaggttggccatgttgtagtaagggtaacactgaagtttactatgttgatgatgatggtgattggggtgttgaaaatgacgattggtgtggtatggaaaaagaacaacc

SEQ ID NO: 20517 - DNA, 108 bp, Neocallimastix californiae
  Dockerin_dom
gggattaggcttcccttgttgtcaagaatgtacggtagtcaccagtgatgatgatggtgattggggtgttgaaaacaacgaatggtgtggtatccctaacagttgtta

SEQ ID NO: 20518 - DNA, 126 bp, Neocallimastix californiae
  Dockerin_dom
atgttgggctaaagatttaggcttctcctgttgtcaagcctgtgaagttacctatacagataatgatggtgattggggtttcgaaaatggcgattggtgtggtattattgaacaaaattgtaaaca

SEQ ID NO: 20519 - DNA, 126 bp, Neocallimastix californiae
  Dockerin_dom
tttcactgaagaaaagggaatggacttcccttgttgtcaaggttgtgaagtttactacactgatgatgatggtgaatggggattcgaaaataatcaatggtgtggtattaatagtgaaacttgtag

SEQ ID NO: 20520 - DNA, 126 bp, Neocallimastix californiae
  Dockerin_dom
ttcctgctggtctactgccttaggctatccatgttgtgatacctgcgttagtgtttctttcgaagacggtgatggtaaatggggtattcaaaatgatgactggtgtggtttacaaaagagttgttt

SEQ ID NO: 20521 - DNA, 115 bp, Neocallimastix californiae; identical to SEQ ID NO: 17902
  Dockerin_dom

SEQ ID NO: 20522 - DNA, 126 bp, Neocallimastix californiae; identical to SEQ ID NO: 20520
  Dockerin_dom

SEQ ID NO: 20523 - DNA, 115 bp, Neocallimastix californiae; identical to SEQ ID NO: 17902
  Dockerin_dom

SEQ ID NO: 20524 - DNA, 126 bp, Neocallimastix californiae
  Dockerin_dom
ttcttcaaaaatcacagcccaaggttacaaatgctgttcagccaactgtgaagttgtttacactgatgatgatggtaactggggtgtagaaaacaacaactggtgtggatgtggtactgaaaagaa

SEQ ID NO: 20525 - DNA, 96 bp, Neocallimastix californiae; identical to SEQ ID NO: 15356
  Dockerin_dom

SEQ ID NO: 20526 - DNA, 123 bp, Neocallimastix californiae; identical to SEQ ID NO: 17907
  Dockerin_dom

SEQ ID NO: 20527 - DNA, 120 bp, Neocallimastix californiae
  Dockerin_dom
ttctaaaaagataactagtcaaggttattcatgctgtccagctaattgtcaaatcgtttatacagattctgatggtacttggggtgttcataatgatcaatggtgtggatgtggtgaagg

SEQ ID NO: 20528 - DNA, 124 bp, Neocallimastix californiae
  Dockerin_dom
ctcttcctccttcacatctcaaggttatggatgctgctccagatgtggtgaagtttactttaccgatgaatctggtaattggggaattgaaaatggtgactggtgtggattaccaagtaattgt

SEQ ID NO: 20529 - DNA, 96 bp, Neocallimastix californiae; identical to SEQ ID NO: 17910
  Dockerin_dom

SEQ ID NO: 20530 - DNA, 117 bp, Neocallimastix californiae; identical to SEQ ID NO: 17911
  Dockerin_dom

SEQ ID NO: 20531 - DNA, 108 bp, Neocallimastix californiae
  Dockerin_dom
tggttacgaatgttgtaaatcatgtgatgttgtatttactgatgatgatggtgaatggggtgtagaagacggtcaatggtgtggtattgataaagaaaaatgtaatgg

SEQ ID NO: 20532 - DNA, 106 bp, Neocallimastix californiae; identical to SEQ ID NO: 15363
  Dockerin_dom

SEQ ID NO: 20533 - DNA, 120 bp, Neocallimastix californiae; identical to SEQ ID NO: 17914
  Dockerin_dom

SEQ ID NO: 20534 - DNA, 120 bp, Neocallimastix californiae; identical to SEQ ID NO: 17915
  Dockerin_dom

SEQ ID NO: 20535 - DNA, 120 bp, Neocallimastix californiae
  Dockerin_dom
ttgctggtctgttggtttaggttaccaatgttgtaaatcttgtaatgtcgaatacaaagataatgatggtgaatggggtattgaaaacaataaatggtgtggtatttctaaagactgtgc

SEQ ID NO: 20536 - DNA, 115 bp, Neocallimastix californiae; identical to SEQ ID NO: 17916
  Dockerin_dom

SEQ ID NO: 20537 - DNA, 115 bp, Neocallimastix californiae; identical to SEQ ID NO: 17919
  Dockerin_dom

SEQ ID NO: 20538 - DNA, 120 bp, Neocallimastix californiae; identical to SEQ ID NO: 17918
  Dockerin_dom

SEQ ID NO: 20539 - DNA, 114 bp, Neocallimastix californiae; identical to SEQ ID NO: 17920
  Dockerin_dom

SEQ ID NO: 20540 - DNA, 114 bp, Neocallimastix californiae; identical to SEQ ID NO: 17922
  Dockerin_dom

SEQ ID NO: 20541 - DNA, 96 bp, Neocallimastix californiae
  Dockerin_dom
tggttatccaccatgtcaagaaactactgaagttctctacactgatgatagtgaatggggtgttgaaaatgacggttggtgcgtcatttgtaaaaa

SEQ ID NO: 20542 - DNA, 123 bp, Neocallimastix californiae
  Dockerin_dom
atgctggtcagaaagattaggttggccttgttgtagtaaggaaaacactgatgtctactatgtggatgacgatggtgaatggggggttgaaaatgatgactggtgtggtatgagcactgaaga

SEQ ID NO: 20543 - DNA, 109 bp, Neocallimastix californiae
  Dockerin_dom
tcaaggttatccatgttgtcaatcctcatgtaatgttatatccactgatagtgatggtaaatggagtgttgaaaatgatgactggtgtttaattgacagttctaaatgt

SEQ ID NO: 20544 - DNA, 120 bp, Neocallimastix californiae; identical to SEQ ID NO: 17925
  Dockerin_dom

SEQ ID NO: 20545 - DNA, 126 bp, Neocallimastix californiae; identical to SEQ ID NO: 17928
  Dockerin_dom

SEQ ID NO: 20546 - DNA, 120 bp, Neocallimastix californiae
  Dockerin_dom
ttggtcagaaaaattaggttacccttgctgtacttccgaaaaagctaaagtttcttattctgatgaaaatggtcactggggcattgagaataatcaatggtgtggtattataaataatga

SEQ ID NO: 20547 - DNA, 126 bp, Neocallimastix californiae; identical to SEQ ID NO: 17927
  Dockerin_dom

SEQ ID NO: 20548 - DNA, 120 bp, Neocallimastix californiae
  Dockerin_dom
ttcagctaaaattcttgctcagggatacagttgctgtccaaaaggatgtagagtttatgtaactgatgatgatggtgattggggttatgtaaacaatgaatggtgtggttgcaaagtaga

SEQ ID NO: 20549 - DNA, 99 bp, Neocallimastix californiae
  Dockerin_dom
tgctcaaggttacccatgttgtaagggtaaatctgaaatctattttgttgataaagatggtaactggggatatgaaaacggagattggtgtttacttgc

SEQ ID NO: 20550 - DNA, 117 bp, Neocallimastix californiae
  Dockerin_dom
agcatccattactgatcaaggctacccatgctgttcaacaggatgtactgtttattacactgataatgatggtgattggggtgttgaaaacaaccaatggtgtggttgtggtaatgg

SEQ ID NO: 20551 - DNA, 117 bp, Neocallimastix californiae
  Dockerin_dom
agcttctattactagtcaaggttatgaatgctgctctgaaaattgtgaaattgtttatactgatgatgatggtaattggggtgttgaaaataaccaatggtgtggttgtggaaatgg

SEQ ID NO: 20552 - DNA, 123 bp, Neocallimastix californiae; identical to SEQ ID NO: 17938
  Dockerin_dom

SEQ ID NO: 20553 - DNA, 123 bp, Neocallimastix californiae; identical to SEQ ID NO: 17937
  Dockerin_dom

SEQ ID NO: 20554 - DNA, 126 bp, Neocallimastix californiae
  Dockerin_dom
atgttggtctagtggttacggttatccatgttgtaacaattgtaaggtttacttcattgatgaaactggagaatggggtattcaagatggtaactggtgtggtattgtcgacagtaaatgtaacgg

SEQ ID NO: 20555 - DNA, 123 bp, Neocallimastix californiae; identical to SEQ ID NO: 17933
  Dockerin_dom

SEQ ID NO: 20556 - DNA, 123 bp, Neocallimastix californiae; identical to SEQ ID NO: 17935
  Dockerin_dom

SEQ ID NO: 20557 - DNA, 120 bp, Neocallimastix californiae
  Dockerin_dom
ttggtcagaatctaagggttatccatgttgtaaatcttgtgatgttgtaaccgtcgatagacatggttcatggggtattgaaaatggtcaatggtgtggtgtaaagtctgaagcttgtca

SEQ ID NO: 20558 - DNA, 124 bp, Neocallimastix californiae
  Dockerin_dom
ctcttcttccattaccgctcaaggttacaagtgctgttcttcctgcggtaccgtctactacactgatggtgatggtgattggggtgttgaaaacggtaactggtgtggtatgccaaccaactgt

SEQ ID NO: 20559 - DNA, 117 bp, Neocallimastix californiae
  Dockerin_dom
ttctgcttccatcactgctcaaggttacaagtgttgttctgctaattgtgaagtcgtttacactgataatgatggtgactggggtgttgaaaacaatgaatggtgtggttgtggtgg

SEQ ID NO: 20560 - DNA, 124 bp, Neocallimastix californiae
  Dockerin_dom
ctgttgggctactaagcttggttataagtgttgtaccgctgaatgtccagttgtctactacactgatgatgatggtaagtggagtgttgaaaatgatgactggtgtggtattattaagacttgt

SEQ ID NO: 20561 - DNA, 114 bp, Neocallimastix californiae; identical to SEQ ID NO: 17942
  Dockerin_dom

SEQ ID NO: 20562 - DNA, 99 bp, Neocallimastix californiae
  Dockerin_dom
tcaaggttatccatgctgtaaatcaaccaagcaagtttactacactgatgatgatggtagttggggtattgaagatggtgactggtgtattattagaaa

SEQ ID NO: 20563 - DNA, 120 bp, Neocallimastix californiae; identical to SEQ ID NO: 17944
  Dockerin_dom

SEQ ID NO: 20564 - DNA, 120 bp, Neocallimastix californiae; identical to SEQ ID NO: 17945
  Dockerin_dom

SEQ ID NO: 20565 - DNA, 120 bp, Neocallimastix californiae; identical to SEQ ID NO: 17946
  Dockerin_dom

SEQ ID NO: 20566 - DNA, 96 bp, Neocallimastix californiae
  Dockerin_dom
cacttgctgtgaaggctgtaatgttattgaagaagatggatctggtaagtggggtattgaaaataaccaatggtgtggtattaaagattcatgtaa

SEQ ID NO: 20567 - DNA, 99 bp, Neocallimastix californiae
  Dockerin_dom
ttacagcgaatgcaggggttgcgctgtatattatgttgaggatggtgttaattggggtgttgaaaacgacgactggtgtttaataccatcaagatgtga

SEQ ID NO: 20568 - DNA, 96 bp, Neocallimastix californiae
  Dockerin_dom
cggttatggttgctgtgtcttcaaaaataccattgttgaaaccgtggatgaaagtggtaaatggggacatgaaggtaatgaatggtgtcttgtagt

SEQ ID NO: 20569 - DNA, 96 bp, Neocallimastix californiae
  Dockerin_dom
ttactcttgctgtaagaaatgtgatgttatctacactgatgaatacaaatggggtgttgaaggtggagattggtgtattattccatactcttgtga

SEQ ID NO: 20570 - DNA, 129 bp, Neocallimastix californiae
  Dockerin_dom
ctgttggtctcttgccgatggttatccatgttgtagaaaggaaaccactaaaattgaatatgtcagtaagagttccggtaaggaatggggtcttgaaaatggtgactggtgtggtatcaccgatagaca

SEQ ID NO: 20571 - DNA, 118 bp, Neocallimastix californiae
  Dockerin_dom
aggtgcccaaggttacccatgctgtaagaagagttgtgctatttacagtactgatggtgatggtgattggagtattgaaaataatgattggtgtttaattgataactctatttgcaaa

SEQ ID NO: 20572 - DNA, 123 bp, Neocallimastix californiae; identical to SEQ ID NO: 17952
  Dockerin_dom

SEQ ID NO: 20573 - DNA, 120 bp, Neocallimastix californiae; identical to SEQ ID NO: 17690
  Dockerin_dom

SEQ ID NO: 20574 - DNA, 120 bp, Neocallimastix californiae; identical to SEQ ID NO: 17955
  Dockerin_dom

SEQ ID NO: 20575 - DNA, 121 bp, Neocallimastix californiae
  Dockerin_dom
atgttggtctgataaattaggtttcccatgttgtagcggttgtattgatactgtttacactgataatgatggtaaatggggtgttcaaaatgatgactggtgtggtattccaactaattgt

SEQ ID NO: 20576 - DNA, 132 bp, Neocallimastix californiae; identical to SEQ ID NO: 17957
  Dockerin_dom

SEQ ID NO: 20577 - DNA, 123 bp, Neocallimastix californiae; identical to SEQ ID NO: 17958
  Dockerin_dom

SEQ ID NO: 20578 - DNA, 106 bp, Neocallimastix californiae; identical to SEQ ID NO: 17959
  Dockerin_dom

SEQ ID NO: 20579 - DNA, 111 bp, Neocallimastix californiae
  Dockerin_dom
ttgctttgctgaaagattaggttacccatgttgttctggtaacgaagttgtttacaccgataacgatggaaagtggggtgtagaaaacggtaattggtgtggtattgccga

SEQ ID NO: 20580 - DNA, 127 bp, Neocallimastix californiae
  Dockerin_dom
ttcatcagctgttacctcccaaggttacaagtgctgtagtgctaacaattgtaatgtctacttcactgatgatgctggtaagtggggtattgaaaacgacgattggtgtggtatttccaaccaatgt

SEQ ID NO: 20581 - DNA, 111 bp, Neocallimastix californiae
  Dockerin_dom
tatcttaaagcaaggatacaagtgctgtgcctccggttgttctgttatctatactgatgatgatggtacttggggtgttgaaaatggtgaatggtgtggatgttccgctgc

SEQ ID NO: 20582 - DNA, 126 bp, Neocallimastix californiae; identical to SEQ ID NO: 17963
  Dockerin_dom

SEQ ID NO: 20583 - DNA, 117 bp, Neocallimastix californiae; identical to SEQ ID NO: 17964
  Dockerin_dom

SEQ ID NO: 20584 - DNA, 114 bp, Neocallimastix californiae; identical to SEQ ID NO: 17965
  Dockerin_dom

SEQ ID NO: 20585 - DNA, 120 bp, Neocallimastix californiae; identical to SEQ ID NO: 17966
  Dockerin_dom

SEQ ID NO: 20586 - DNA, 99 bp, Neocallimastix californiae; identical to SEQ ID NO: 17967
  Dockerin_dom

SEQ ID NO: 20587 - DNA, 96 bp, Neocallimastix californiae
  Dockerin_dom
ttcatgttgtaaaagttgtactgtaattgccgaagatgataatggtcaatggggtattgaagatgatgaatggtgtggtattagagatagttgtag

SEQ ID NO: 20588 - DNA, 102 bp, Neocallimastix californiae
  Dockerin_dom
atatacatgttgtgaaggttgtaaagtatctgaaatagatggtgatggtattagttggggtatagaaaacggtgaatggtgtattgtacctttatcttgtaa

SEQ ID NO: 20589 - DNA, 87 bp, Neocallimastix californiae
  Dockerin_dom
ttctacctgtagagcagttacagtagaagatggtattagttggggtgtagaaaacaatgactggtgcattgttcctgcatcttgttt

SEQ ID NO: 20590 - DNA, 120 bp, Neocallimastix californiae; identical to SEQ ID NO: 17970
  Dockerin_dom

SEQ ID NO: 20591 - DNA, 126 bp, Neocallimastix californiae
  Dockerin_dom
ttgtttctctactagacttggcttcccatgctgtagtagctggaacaagaaagtcgaatttagcgatggtgatggtaactggggtattgaaaatggtagttggtgtggtattggtaaccaacaaca

SEQ ID NO: 20592 - DNA, 123 bp, Neocallimastix californiae; identical to SEQ ID NO: 17972
  Dockerin_dom

SEQ ID NO: 20593 - DNA, 121 bp, Neocallimastix californiae; identical to SEQ ID NO: 17973
  Dockerin_dom

SEQ ID NO: 20594 - DNA, 99 bp, Neocallimastix californiae
  Dockerin_dom
tgaatgttgtaagagttgcaaagttaagcatatttctaaatctggaaatacatggggtgtagaagatggtaaatggtgttctattccatacagatgtga

SEQ ID NO: 20595 - DNA, 123 bp, Neocallimastix californiae
  Dockerin_dom
gtgttggtctttagctgaaggttatccatgttgtgaaaagaagggaactaaagttagacatgtttctaagaatggtaatgaatggggtgttgaacatggtgactggtgtggtattaccgatct

SEQ ID NO: 20596 - DNA, 120 bp, Neocallimastix californiae; identical to SEQ ID NO: 17976
  Dockerin_dom

SEQ ID NO: 20597 - DNA, 123 bp, Neocallimastix californiae; identical to SEQ ID NO: 17975
  Dockerin_dom

SEQ ID NO: 20598 - DNA, 111 bp, Neocallimastix californiae
  Dockerin_dom
ttggtctcttccagattttccatgctgtaacggaaacactgttgtttatactgatatccaaggtgattggggttatgaaaacgataattggtgtggtattgtcaaaaagtc

SEQ ID NO: 20599 - DNA, 123 bp, Neocallimastix californiae; identical to SEQ ID NO: 17978
  Dockerin_dom

SEQ ID NO: 20600 - DNA, 117 bp, Neocallimastix californiae
  Dockerin_dom
ttgttggtctcttccagaatacccatgttgtaatggtgacactgttgtttatactgatggtcaaggagactggggttatgaaaatggagactggtgtggtattaaaaaacaacaacc

SEQ ID NO: 20601 - DNA, 96 bp, Neocallimastix californiae
  Dockerin_dom
taaatgttgtgaaagttgtaaagtttggtacactgatgaacaaggcgattggggtgttgaaaataatgattggtgttccattaaatattcatgttc

SEQ ID NO: 20602 - DNA, 126 bp, Neocallimastix californiae; identical to SEQ ID NO: 17981
  Dockerin_dom

SEQ ID NO: 20603 - DNA, 120 bp, Neocallimastix californiae; identical to SEQ ID NO: 17690
  Dockerin_dom

SEQ ID NO: 20604 - DNA, 123 bp, Neocallimastix californiae; identical to SEQ ID NO: 17983
  Dockerin_dom

SEQ ID NO: 20605 - DNA, 123 bp, Neocallimastix californiae
  Dockerin_dom
ctggtctgaagttcttggctatccatgttgtaaaggttgtactatttttgaggaggatgaagatggtcaatggggttatgatttcaaggaagctacctggtgtggtattcaaaccttctgtaa

SEQ ID NO: 20606 - DNA, 109 bp, Neocallimastix californiae; identical to SEQ ID NO: 15436
  Dockerin_dom

SEQ ID NO: 20607 - DNA, 123 bp, Neocallimastix californiae; identical to SEQ ID NO: 17986
  Dockerin_dom

SEQ ID NO: 20608 - DNA, 93 bp, Neocallimastix californiae
  Dockerin_dom
tccatgttgtaaagaatgtaacgtttattacacggataccgaagattggggtattgaaaatggagaatggtgttccattccacatacttgtga

SEQ ID NO: 20609 - DNA, 105 bp, Neocallimastix californiae
  Dockerin_dom
caccgggtataattgttgtcttttcacaaccaccgttataacatcagattcggttggtgattggggtgttgaaaatgatgattggtgtctcattgaaagtagttt

SEQ ID NO: 20610 - DNA, 99 bp, Neocallimastix californiae
  Dockerin_dom
cagatgttgtcttaagacttgtaaggcctcttatactgattctactggtgattgggctgtcgaaagtaataattggtgtttaattccttacacttgtaa

SEQ ID NO: 20611 - DNA, 114 bp, Neocallimastix californiae
  Dockerin_dom
catcttaaagcaaggttacaagtgttgttcaaaggattgtaccatcatttatactgatgatgatggttcatggggtgtagaaaatgatgaatggtgtggatgttctaatactgc

SEQ ID NO: 20612 - DNA, 124 bp, Neocallimastix californiae
  Dockerin_dom
atcctctattacctctcaaggctataaatgctgtagtagtgataactgtaatgtatatgctactgatgatgatggtaaatggggtattgaagatggtgattggtgtggtatttctaagaattgt

SEQ ID NO: 20613 - DNA, 109 bp, Neocallimastix californiae; identical to SEQ ID NO: 15442
  Dockerin_dom

SEQ ID NO: 20614 - DNA, 63 bp, Neocallimastix californiae; identical to SEQ ID NO: 17994
  Dockerin_dom

SEQ ID NO: 20615 - DNA, 120 bp, Neocallimastix californiae; identical to SEQ ID NO: 17993
  Dockerin_dom

SEQ ID NO: 20616 - DNA, 90 bp, Neocallimastix californiae
  Dockerin_dom
tccatgttgtagtgctggagcggaagtagtttatgaagatgatcaaggccaatggggtgttgaaaatggtgaatggtgtggtattgaacc

SEQ ID NO: 20617 - DNA, 102 bp, Neocallimastix californiae
  Dockerin_dom
tgctccatatccatgttgtaagggaaatgaagttgtatatactgatgatcaaggtgattggggagttgaagatggtgattggtgtggtattgtaaaggataa

SEQ ID NO: 20618 - DNA, 120 bp, Neocallimastix californiae; identical to SEQ ID NO: 17998
  Dockerin_dom

SEQ ID NO: 20619 - DNA, 123 bp, Neocallimastix californiae
  Dockerin_dom
tgaatgttggtctaagaagtatggttatccatgctgtgatacctgtaatgtattcatcattgataaatatggtgaatggggtatcaaggacaatgattggtgtggtattccatctacctgtaa

SEQ ID NO: 20620 - DNA, 120 bp, Neocallimastix californiae; identical to SEQ ID NO: 17999
  Dockerin_dom

SEQ ID NO: 20621 - DNA, 120 bp, Neocallimastix californiae; identical to SEQ ID NO: 18000
  Dockerin_dom

SEQ ID NO: 20622 - DNA, 111 bp, Neocallimastix californiae
  Dockerin_dom
tttcgcaaagtctgatggttatgactgttgtttcgataatgaagttgtttatgaagatgatagtggtaaatggggtataaatgatgaaggtgaatggtgcggtgttgaaca

SEQ ID NO: 20623 - DNA, 121 bp, Neocallimastix californiae
  Dockerin_dom
tacttgttggtctaagacatatggttatgattgttgtgctgaaggaactgctgtatatctcgaagatgaaagtggtaaatggggtgtcaccgatgattaccaatggtgtggtattaaaaac

SEQ ID NO: 20624 - DNA, 129 bp, Neocallimastix californiae
  Dockerin_dom
ttgctgggctgaagcattaggatacaagtgttgtagtgctgatgccttcaccccagttattttcactgatagtgatggtgattggagtgctgaaaatggtgaatggtgtggtattttaaagagtgaaaa

SEQ ID NO: 20625 - DNA, 120 bp, Neocallimastix californiae; identical to SEQ ID NO: 18004
  Dockerin_dom

SEQ ID NO: 20626 - DNA, 96 bp, Neocallimastix californiae; identical to SEQ ID NO: 18005
  Dockerin_dom

SEQ ID NO: 20627 - DNA, 117 bp, Neocallimastix californiae
  Dockerin_dom
ctgttggtcagaaccagattacccatgctgtaagtatagttgtgaagtttacttcactgatgatcataaatggggtattgaaaatggtgaatggtgtggtatttctgattcttgtgg

SEQ ID NO: 20628 - DNA, 106 bp, Neocallimastix californiae; identical to SEQ ID NO: 15457
  Dockerin_dom

SEQ ID NO: 20629 - DNA, 114 bp, Neocallimastix californiae; identical to SEQ ID NO: 18009
  Dockerin_dom

SEQ ID NO: 20630 - DNA, 123 bp, Neocallimastix californiae
  Dockerin_dom
atgctgggctaatgaattaggttacgcatgttgtaagtcagcaaaaactgtttatgcaacagataaggatggcaaatggagtgtagaaaataatgaatggtgtggtatcgtagaaagcaataa

SEQ ID NO: 20631 - DNA, 114 bp, Neocallimastix californiae
  Dockerin_dom
tattaacaatttaggttatccatgttgtgaaggttgtgaaattctgtatacagatgatgatggtgattggggggttgaaaatgaagattggtgtggcattccatatcattgtac

SEQ ID NO: 20632 - DNA, 121 bp, Neocallimastix californiae
  Dockerin_dom
ttgttggtcacacagatacggttatccttgttgtactaaaacaaatgaagtattgtatagtgattcggatggtgattggggtatagaaaatggtgaatggtgtggtgttgctagaagttgc

SEQ ID NO: 20633 - DNA, 126 bp, Neocallimastix californiae; identical to SEQ ID NO: 18012
  Dockerin_dom

SEQ ID NO: 20634 - DNA, 93 bp, Neocallimastix californiae
  Dockerin_dom
tccatattgtaataattgtgtgactgtttacgaagacgatcaaaaatggggtattttaaataatcaatggtgtagaattttacctaattgtga

SEQ ID NO: 20635 - DNA, 126 bp, Neocallimastix californiae
  Dockerin_dom
ctgtttttctactagacttggttatccatgttgtagtagttggaataagcaagttgcatacacagataatgacggaaattggggtgttgaaaatggtaattggtgtggtataagtaatcaacaaag

SEQ ID NO: 20636 - DNA, 120 bp, Neocallimastix californiae; identical to SEQ ID NO: 18014
  Dockerin_dom

SEQ ID NO: 20637 - DNA, 117 bp, Neocallimastix californiae; identical to SEQ ID NO: 18016
  Dockerin_dom

SEQ ID NO: 20638 - DNA, 117 bp, Neocallimastix californiae; identical to SEQ ID NO: 18017
  Dockerin_dom

SEQ ID NO: 20639 - DNA, 120 bp, Neocallimastix californiae
  Dockerin_dom
atctaccattaaggatcaaggttatccttgctgtaaatcatgtaacgttattcttactgatgaaagtggtgattggggtgttgaaaataatgattggtgtggcatttcagaaacttgtaa

SEQ ID NO: 20640 - DNA, 117 bp, Neocallimastix californiae
  Dockerin_dom
taaggcagaagctcttggttacaagtgttgctccacctgtgtcagtattcttgaagacgaaaatggcttatggggtgctgaaaatggtgaatggtgtggaattactgataaatgtat

SEQ ID NO: 20641 - DNA, 123 bp, Neocallimastix californiae
  Dockerin_dom
tgaatgctggtctactcaatttggttatccatgttgtgacacttgtgatgtattcttatctgatgaatctggtgattggggtgttaaagatttagattggtgtggtattccatccacttgtaa

SEQ ID NO: 20642 - DNA, 96 bp, Neocallimastix californiae
  Dockerin_dom
caaatgttgtaaagattgtcaagttgtatatgaagacgaagatggcaaatggggatatgaaaatgatgaatggtgtggtatgaaaagtagttgctt

SEQ ID NO: 20643 - DNA, 129 bp, Neocallimastix californiae
  Dockerin_dom
tgaatgctggtctgaaagtttaggttttccatgttgtccatctgactactgtgaagttgcaaaaaccgatagtagtggttcttggggtatctttgacaataattggtgtggtattagcactgattgtga

SEQ ID NO: 20644 - DNA, 96 bp, Neocallimastix californiae
  Dockerin_dom
tccttgctgtgaaagttgtaacatttattctgaagaagaaggtgataagtggggtattgaaaacaacgattggtgtagtataaaattcaaatgtta

SEQ ID NO: 20645 - DNA, 117 bp, Neocallimastix californiae
  Dockerin_dom
ttgttggtctgaaccagattacccatgttgtaaatctagctgtgaagtttactatactgatgaacataagtggggtgttgaaaatggagattggtgtggtattactgattcttgtgg

SEQ ID NO: 20646 - DNA, 114 bp, Neocallimastix californiae; identical to SEQ ID NO: 18027
  Dockerin_dom

SEQ ID NO: 20647 - DNA, 117 bp, Neocallimastix californiae; identical to SEQ ID NO: 18028
  Dockerin_dom

SEQ ID NO: 20648 - DNA, 114 bp, Neocallimastix californiae; identical to SEQ ID NO: 18025
  Dockerin_dom

SEQ ID NO: 20649 - DNA, 123 bp, Neocallimastix californiae; identical to SEQ ID NO: 18026
  Dockerin_dom

SEQ ID NO: 20650 - DNA, 102 bp, Neocallimastix californiae
  Dockerin_dom
attatatccttgctgtaatggttgtgatgttattgaagaaactgaagaaggtaaatggggtgttgaaaatgacgaatggtgtggtttgaaggattcatgctt

SEQ ID NO: 20651 - DNA, 102 bp, Neocallimastix californiae
  Dockerin_dom
ctttgcttacgaagaatgtaaaggttgtggagtagtttatgaagatgatatgaaatggggtgttgaaaatgatgattggtgtattatacctgcaaaatgtga

SEQ ID NO: 20652 - DNA, 123 bp, Neocallimastix californiae
  Dockerin_dom
atgcttttcacaaaaattaaatccatcttatccatgttgtaaaggaaatgaagtcgtctatactgatgaaagtggtgattggggtgtagaaaataatagctggtgtggtattagtaatgataa

SEQ ID NO: 20653 - DNA, 120 bp, Neocallimastix californiae; identical to SEQ ID NO: 18033
  Dockerin_dom

SEQ ID NO: 20654 - DNA, 114 bp, Neocallimastix californiae; identical to SEQ ID NO: 18031
  Dockerin_dom

SEQ ID NO: 20655 - DNA, 114 bp, Neocallimastix californiae
  Dockerin_dom
atgttgggcatttgaattaggttacacatgttgtaagaaaacaaagactgttcaaaaaattgatgaaaataaaagaaaatggggttatgaatatagtggtttatgtggattcag

SEQ ID NO: 20656 - DNA, 123 bp, Neocallimastix californiae; identical to SEQ ID NO: 18035
  Dockerin_dom

SEQ ID NO: 20657 - DNA, 120 bp, Neocallimastix californiae
  Dockerin_dom
ttggtcattagatctaggttatccatgttgtaatcctaaaaataccaatgtagtatacacggatggaactggtaaatggggtgttgaaaatggtgattggtgtggtattattaataacat

SEQ ID NO: 20658 - DNA, 120 bp, Neocallimastix californiae
  Dockerin_dom
gtcttggtcaaatgaacttggttatccaagttgccaatctactaaagagattaaattttatgctgaacaaggaggctttggttatgaaaatggttcatggtgtggtttagaaaatgattt

SEQ ID NO: 20659 - DNA, 126 bp, Neocallimastix californiae
  Dockerin_dom
ttggtccgaattattatctaatccattcccttgttgtaaaaatgatgacgtcaaagaaattggaaaggatatggatggagcatggggtgaagaaaatggaacgaaatgcggtattagaaataaacg

SEQ ID NO: 20660 - DNA, 108 bp, Neocallimastix californiae
  Dockerin_dom
ttgttggtcattagaccaaggctatccatgttgtgaaggtcaataccaaaagtatgatgatgattggggttatcaaaataatgaatggtgtggtattatagaacaagc

SEQ ID NO: 20661 - DNA, 120 bp, Neocallimastix californiae
  Dockerin_dom
atgctttgctaaaagattaggatattcttgctgtactactactaaagaggtagtttccattgatcctaacggtaaatggggaatagaaaatggacacatttgcggaattgaagaaaaatt

SEQ ID NO: 20662 - DNA, 120 bp, Neocallimastix californiae
  Dockerin_dom
atgtttatctgaatttattggatatccatgttgttcacctgaatttactaccatttatgcacaagatgaatatggagattggagctatgatttcgttaagaatgaatggtgtggtttaac

SEQ ID NO: 20663 - DNA, 121 bp, Neocallimastix californiae
  Dockerin_dom
atgttggtcagaagaattaggatatccatgttgtaaaggatgcagagtctatgaaacggattctgatggatcctggggatatgagtttaatcaatggtgtggtattatttcagctcaatgc

SEQ ID NO: 20664 - DNA, 121 bp, Neocallimastix californiae; identical to SEQ ID NO: 18042
  Dockerin_dom

SEQ ID NO: 20665 - DNA, 90 bp, Neocallimastix californiae
  Dockerin_dom
ttcacctgaatttactaccatttatgcacaagatgaatatggagattggagctatgatttcgttaagaatgaatggtgtggtttaactgt

SEQ ID NO: 20666 - DNA, 100 bp, Neocallimastix californiae; identical to SEQ ID NO: 15493
  Dockerin_dom

SEQ ID NO: 20667 - DNA, 114 bp, Neocallimastix californiae; identical to SEQ ID NO: 18044
  Dockerin_dom

SEQ ID NO: 20668 - DNA, 120 bp, Neocallimastix californiae
  Dockerin_dom
atgcttttcacaaaaattaaatccatcttatccatgttgtacaggaaatgaagtcgtctatactgatgaaaatggagattggggtgtagaaaataatagctggtgtggtattagtaatgg

SEQ ID NO: 20669 - DNA, 114 bp, Neocallimastix californiae; identical to SEQ ID NO: 18044
  Dockerin_dom

SEQ ID NO: 20670 - DNA, 120 bp, Neocallimastix californiae
  Dockerin_dom
atgcttttcacaaaaattaaatccatcttatccatgttgtacaggaaatgaagtcgtctatactgatgaaagtggagattggggtgtagaaaataatagctggtgtggtattagtaatgg

SEQ ID NO: 20671 - DNA, 120 bp, Neocallimastix californiae; identical to SEQ ID NO: 18046
  Dockerin_dom

SEQ ID NO: 20672 - DNA, 114 bp, Neocallimastix californiae; identical to SEQ ID NO: 18044
  Dockerin_dom

SEQ ID NO: 20673 - DNA, 120 bp, Neocallimastix californiae; identical to SEQ ID NO: 20668
  Dockerin_dom

SEQ ID NO: 20674 - DNA, 120 bp, Neocallimastix californiae; identical to SEQ ID NO: 18046
  Dockerin_dom

SEQ ID NO: 20675 - DNA, 120 bp, Neocallimastix californiae; identical to SEQ ID NO: 18053
  Dockerin_dom

SEQ ID NO: 20676 - DNA, 111 bp, Neocallimastix californiae
  Dockerin_dom
ttggtctcttccaagttatccatgttgttctactagtaccagtgtggtttatgaagatgaacttggtaagtggggtattgaaaatgatgattggtgtggtattaagccaac

SEQ ID NO: 20677 - DNA, 114 bp, Neocallimastix californiae; identical to SEQ ID NO: 18052
  Dockerin_dom

SEQ ID NO: 20678 - DNA, 123 bp, Neocallimastix californiae; identical to SEQ ID NO: 18056
  Dockerin_dom

SEQ ID NO: 20679 - DNA, 124 bp, Neocallimastix californiae
  Dockerin_dom
atgctggtccactaagcttggttatggatgttgtgaaggatgtcatacttatgaagttgatgacaatggaaaatggggttatgaaaacggaaagtggtgtggtattgttgaagataaatgccaa

SEQ ID NO: 20680 - DNA, 120 bp, Neocallimastix californiae; identical to SEQ ID NO: 18057
  Dockerin_dom

SEQ ID NO: 20681 - DNA, 120 bp, Neocallimastix californiae
  Dockerin_dom
ttgttggtctgaatcatataattatgaatgttgtagaggaagaaatttagaaattgttgaaaaatttggagattattactggtctgaagaaaatggtatacgttgtggaattcccgttac

SEQ ID NO: 20682 - DNA, 126 bp, Neocallimastix californiae; identical to SEQ ID NO: 18058
  Dockerin_dom

SEQ ID NO: 20683 - DNA, 102 bp, Neocallimastix californiae
  Dockerin_dom
tccatgttgtagtaatgagaataccgctgttataacaactgatgaacaaggtgattggggtgttgagaatggtgattggtgcggtattattaataaaaaaga

SEQ ID NO: 20684 - DNA, 118 bp, Neocallimastix californiae
  Dockerin_dom
cattacttctcaaggctacaaatgttgtaaggataacaactgttctgttattgaaacagatgatgctggtaaatggggtattgaagatgacgattggtgtggtatttctaacaaatgt

SEQ ID NO: 20685 - DNA, 120 bp, Neocallimastix californiae
  Dockerin_dom
ttctcaagctatcttaagtcaaggatataaatgctgttcaagcgattgtgttgtcatctttacggatgatgatggaacatggggtatagaaaacgatgaatggtgtggatgtaacacagt

SEQ ID NO: 20686 - DNA, 117 bp, Neocallimastix californiae; identical to SEQ ID NO: 17729
  Dockerin_dom

SEQ ID NO: 20687 - DNA, 120 bp, Neocallimastix californiae
  Dockerin_dom
ttgttggtcacttccatttggatacccatgttgtccacattgtaaggttcttactgaggatgagaatggtaaatggggagaattaaatggagaatggtgtggtattgttgctgataaggt

SEQ ID NO: 20688 - DNA, 123 bp, Neocallimastix californiae
  Dockerin_dom
ttgctgggcagatgctctcggatacaactgttgtatttatacaaaagaagtaatttacacagatgaaagtggagattggggtgtagaaaataatgaatggtgtggtattattgaaacaaaaga

SEQ ID NO: 20689 - DNA, 120 bp, Neocallimastix californiae
  Dockerin_dom
ttgttgggcaaatatacttggttatcaatgctgtgaaaatactaaagaagtatttttaaaggatgaaagtggtagttggggtattgaaaatgacgattggtgtggtatagttcaagaagc

SEQ ID NO: 20690 - DNA, 129 bp, Neocallimastix californiae
  Dockerin_dom
ctgctggtctaaggctcttggttacccatgttgtaagagtagttgtgaagttatttactctgatgatgatggtgaatggggtgttgaagatgctgattggtgtggtattgaagcttcaaaatgtaaaaa

SEQ ID NO: 20691 - DNA, 117 bp, Neocallimastix californiae
  Dockerin_dom
tttctctgaagaaatgggttacccatgctgtagtgactgttccgtagtctacaccgatagtgatggtggttggggtgttgaaggtgatgactggtgtggtattaaggataaatgtta

SEQ ID NO: 20692 - DNA, 123 bp, Neocallimastix californiae; identical to SEQ ID NO: 18069
  Dockerin_dom

SEQ ID NO: 20693 - DNA, 121 bp, Neocallimastix californiae
  Dockerin_dom
ctggtctaagaagtttggttacgactgttgtaacggatgtacttcttatgaagaagattctaatggtaaatggggttatgaagaaaataaatggtgtggtattgtttcagaaaactgtaat

SEQ ID NO: 20694 - DNA, 124 bp, Neocallimastix californiae
  Dockerin_dom
ctcagttcgtattacttctcaaggttacgaatgctgctcatcttgtggtaccgtttactacaccgatgatgatggtgaatggggtgttgaaaacaacaattggtgtggtatgccaactaactgc

SEQ ID NO: 20695 - DNA, 117 bp, Neocallimastix californiae
  Dockerin_dom
ctctgcttccattttagctcaaggatatgaatgctgttctgataactgtgaagttgtttatactgatgctgatggtgattggggtgttgaaaatgaacaatggtgtggttgtggtgg

SEQ ID NO: 20696 - DNA, 124 bp, Neocallimastix californiae
  Dockerin_dom
atcaaacattgctgctcaaggatatcaatgttgtagtcctggtaactgtagtatctatcttgaagatgatactggtagatggggtattgaaaatgatgaatggtgtggtactccaagtaactgt

SEQ ID NO: 20697 - DNA, 123 bp, Neocallimastix californiae; identical to SEQ ID NO: 18073
  Dockerin_dom

SEQ ID NO: 20698 - DNA, 120 bp, Neocallimastix californiae
  Dockerin_dom
atgtatggctgaaattattggttacccatgttgtgataaaaatgttaagactgtctatgaaaaagatgtctatggggattggggttatgacttcaagaagggtgaatggtgtggtcttac

SEQ ID NO: 20699 - DNA, 120 bp, Neocallimastix californiae
  Dockerin_dom
atgttggtctgaagtatttggttatccatgttgtaagggatgttacgtctatgaaactgatgacgatggtaaatggggttatgaaaatcaacattggtgcggtattcaatcctactgttc

SEQ ID NO: 20700 - DNA, 120 bp, Neocallimastix californiae; identical to SEQ ID NO: 18076
  Dockerin_dom

SEQ ID NO: 20701 - DNA, 108 bp, Neocallimastix californiae; identical to SEQ ID NO: 18078
  Dockerin_dom

SEQ ID NO: 20702 - DNA, 103 bp, Neocallimastix californiae
  Dockerin_dom
agatggatatgaatgttgtaatggttgtagtgttgttgaacaatcagatggttataagtggggtgttgaaaataataaatggtgtattatcaaaaacacttgt

SEQ ID NO: 20703 - DNA, 117 bp, Neocallimastix californiae; identical to SEQ ID NO: 18079
  Dockerin_dom

SEQ ID NO: 20704 - DNA, 106 bp, Neocallimastix californiae
  Dockerin_dom
aaaccaaggctattcatattgtaatttatgtgatgttatttacaatgacaatgatggccgatggggtattgaaaatggggaatggtgtggtattaaaagtacttgt

SEQ ID NO: 20705 - DNA, 120 bp, Neocallimastix californiae
  Dockerin_dom
ttgtttttccattaatcttggatatccatgttgtaatggtaatacagtctactatactgataatgatggtcaatggggttacgaaaacaacaactggtgtggtattaaggaatctaaaca

SEQ ID NO: 20706 - DNA, 123 bp, Neocallimastix californiae; identical to SEQ ID NO: 18082
  Dockerin_dom

SEQ ID NO: 20707 - DNA, 120 bp, Neocallimastix californiae; identical to SEQ ID NO: 18085
  Dockerin_dom

SEQ ID NO: 20708 - DNA, 117 bp, Neocallimastix californiae
  Dockerin_dom
tttctcagaggagcttggttatccctgctgttccagtggcgttttagtctatgaaaaggatgaacatggatcatggggtattgaaaataatgactggtgtggtattattggtagtga

SEQ ID NO: 20709 - DNA, 109 bp, Neocallimastix californiae; identical to SEQ ID NO: 18084
  Dockerin_dom

SEQ ID NO: 20710 - DNA, 120 bp, Neocallimastix californiae; identical to SEQ ID NO: 18085
  Dockerin_dom

SEQ ID NO: 20711 - DNA, 117 bp, Neocallimastix californiae; identical to SEQ ID NO: 20708
  Dockerin_dom

SEQ ID NO: 20712 - DNA, 109 bp, Neocallimastix californiae; identical to SEQ ID NO: 18084
  Dockerin_dom

SEQ ID NO: 20713 - DNA, 102 bp, Neocallimastix californiae
  Dockerin_dom
cccatgttgtgataactgtgaagtttattatactgataatgaaggtaaatggggtattttaaacaatgactggtgtaaaatcaatgataaccgctgtaatgc

SEQ ID NO: 20714 - DNA, 123 bp, Neocallimastix californiae
  Dockerin_dom
tagtagtagaattacctctcaaggttataaatgctgtagtaactgtatcgtttactacactgataatgatggtgaatggggtgttgaagatggtaactggtgtggaacaccagacaaatgtaa

SEQ ID NO: 20715 - DNA, 114 bp, Neocallimastix californiae
  Dockerin_dom
ctggtcggaaaaattaggttatccctgttgtaagccaacgaataccgaaattttagaagtagataaatacggtgaatggggtatggaaaatggtgaaagatgtggaattcatat

SEQ ID NO: 20716 - DNA, 114 bp, Neocallimastix californiae; identical to SEQ ID NO: 18093
  Dockerin_dom

SEQ ID NO: 20717 - DNA, 111 bp, Neocallimastix californiae; identical to SEQ ID NO: 15541
  Dockerin_dom

SEQ ID NO: 20718 - DNA, 114 bp, Neocallimastix californiae; identical to SEQ ID NO: 20715
  Dockerin_dom

SEQ ID NO: 20719 - DNA, 120 bp, Neocallimastix californiae
  Dockerin_dom
taatgccaatattattgctcaaggttacaaatgttgtagagttggatgtactgttgaatacactgataatgatggtgaatggggtgttgaagatggtgactggtgtggttgtggtaaggc

SEQ ID NO: 20720 - DNA, 120 bp, Neocallimastix californiae
  Dockerin_dom
tccatcctctatcactcgtcaaggttacaaatgttgtagagttggatgtactgttgaatacactgataatgatggtgaatggggtgttgaagatggtgactggtgtggttgtggtaaggc

SEQ ID NO: 20721 - DNA, 93 bp, Neocallimastix californiae
  Dockerin_dom
tccatgctgtactggaaatgaagttgtttacacagatagtgatggcgattggggttacgaaaataatcaatggtgtggtattgctaaaaagga

SEQ ID NO: 20722 - DNA, 117 bp, Neocallimastix californiae
  Dockerin_dom
tttctcggaatctcttggatataattgttgtaaaggatgtgatataattttaactgatgattatggttcatggggtgttgaaaataatgattggtgtggtattaacgattcttgtaa

SEQ ID NO: 20723 - DNA, 117 bp, Neocallimastix californiae
  Dockerin_dom
atgttggtcacttccagaatataaatgttgttcagaaggtatagaatctatttttgaagattccattggtaagtggggtatagaagataatgaatggtgtggtattaaagctaataa

SEQ ID NO: 20724 - DNA, 84 bp, Neocallimastix californiae
  Dockerin_dom
taaatgctgtggaaattgtgatgtttattatgttgatgattttgaatggggtgtggaagatggtaagtggtgtttaacaccatt

SEQ ID NO: 20725 - DNA, 129 bp, Neocallimastix californiae
  Dockerin_dom
gtgttgggcacttgctgaaggttatccatgttgtaagaataaggatgccaaagtgtattctactgataagcatggtaaaaaatggggtattgaagataataattggtgtggtattattgaggaagaaag

SEQ ID NO: 20726 - DNA, 102 bp, Neocallimastix californiae
  Dockerin_dom
ttctggttatagctgttgtgtattaactaagaaggttgaattaactgataacgttggtcagtggggtgttgaaaatggtgaatggtgtctttttgaagagga

SEQ ID NO: 20727 - DNA, 120 bp, Neocallimastix californiae; identical to SEQ ID NO: 18103
  Dockerin_dom

SEQ ID NO: 20728 - DNA, 123 bp, Neocallimastix californiae
  Dockerin_dom
ttgggctaaggctcttggttcaaactgttgtagtactagtagctgtagaaatgttgtttactttgactacgatggtcaatgggatgttgaaaatggtgaatggtgtggtatctctaccgaaaa

SEQ ID NO: 20729 - DNA, 120 bp, Neocallimastix californiae; identical to SEQ ID NO: 18104
  Dockerin_dom

SEQ ID NO: 20730 - DNA, 117 bp, Neocallimastix californiae
  Dockerin_dom
tgaatgtacatttgaatctattggttacaaatgctgttcaaattcatgtactgtagtttatacagatgaaagtggtgattggggtgtagaaaatggtgaatggtgtggtattatacc

SEQ ID NO: 20731 - DNA, 123 bp, Neocallimastix californiae; identical to SEQ ID NO: 18106
  Dockerin_dom

SEQ ID NO: 20732 - DNA, 124 bp, Neocallimastix californiae
  Dockerin_dom
ttcatgcagcggtgcccaaggttatccttgctgtaaatccacttgttcatcatatttccaagataacgatggtgaatggggtgttgaaaatgatgattggtgtttaattaataaatctatttgt

SEQ ID NO: 20733 - DNA, 117 bp, Neocallimastix californiae; identical to SEQ ID NO: 18109
  Dockerin_dom

SEQ ID NO: 20734 - DNA, 109 bp, Neocallimastix californiae; identical to SEQ ID NO: 18108
  Dockerin_dom

SEQ ID NO: 20735 - DNA, 120 bp, Neocallimastix californiae; identical to SEQ ID NO: 18110
  Dockerin_dom

SEQ ID NO: 20736 - DNA, 120 bp, Neocallimastix californiae
  Dockerin_dom
atgttggtcagaaaaattaggttattcatgctgttcagaaaacaacactagggttgtcttaactgatgatgatggtaaatggggagctgaaaacggtgaatggtgtggtattagagctaa

SEQ ID NO: 20737 - DNA, 126 bp, Neocallimastix californiae; identical to SEQ ID NO: 18111
  Dockerin_dom

SEQ ID NO: 20738 - DNA, 111 bp, Neocallimastix californiae; identical to SEQ ID NO: 18115
  Dockerin_dom

SEQ ID NO: 20739 - DNA, 126 bp, Neocallimastix californiae
  Dockerin_dom
atgttgggctacatcacaaggttatccatgctgtactggatgtgatgcaatttacactgacggtagtggaaagtggggttttgaaaataataactggtgtggtattgtcgattctcaatgtaattc

SEQ ID NO: 20740 - DNA, 120 bp, Neocallimastix californiae; identical to SEQ ID NO: 18113
  Dockerin_dom

SEQ ID NO: 20741 - DNA, 114 bp, Neocallimastix californiae; identical to SEQ ID NO: 15568
  Dockerin_dom

SEQ ID NO: 20742 - DNA, 111 bp, Neocallimastix californiae
  Dockerin_dom
taccggctatcattgttgttctgatccaaataccacagtatatacttccgattcctcaggtgattggggtgttgaaggtgattactggtgtttaattgttaaggaagaaca

SEQ ID NO: 20743 - DNA, 120 bp, Neocallimastix californiae; identical to SEQ ID NO: 18118
  Dockerin_dom

SEQ ID NO: 20744 - DNA, 102 bp, Neocallimastix californiae
  Dockerin_dom
ttatccaaattgtaaaaataaggatacagaaatattatatagttcagatgatactaaaaaagaatggggagaagaaaatgatgattggtgtattattactga

SEQ ID NO: 20745 - DNA, 114 bp, Neocallimastix californiae
  Dockerin_dom
tccaggtgaaaatttaggttataattgttgtagttcttgtatagaaccatatgaagaagatgaaaatggaaaatgggctgttgtagatgaaagctggtgttctcttccatatta

SEQ ID NO: 20746 - DNA, 93 bp, Neocallimastix californiae
  Dockerin_dom
cccatgttgtacttccactacagaagttgttgaagtcgatgaaaatggagaatggggaattgaaaatggaaactggtgtggtattagatctgt

SEQ ID NO: 20747 - DNA, 120 bp, Neocallimastix californiae
  Dockerin_dom
atgtttttctaatggtttaggttatccatgttgtaactcttgtgatattatttacattgatgaaagtggtaactggggtgttgaaaatggagattggtgtggtattaaggatacttgtga

SEQ ID NO: 20748 - DNA, 120 bp, Neocallimastix californiae
  Dockerin_dom
ttgctttgctatatcattaggctattcatgttgtgagggaagtgaaattgtatataccgatgatgatggtgattggggttacgaaaatgacaattggtgtggaattgagaataataacaa

SEQ ID NO: 20749 - DNA, 118 bp, Neocallimastix californiae
  Dockerin_dom
atgcccaggaaaatctgaaggatatcaatgctgttcatcatgtaacgttgtttttacagatgaaaacggttcatggggtgttgaaaataatgaatggtgtggtatcagaaatacatgt

SEQ ID NO: 20750 - DNA, 123 bp, Neocallimastix californiae; identical to SEQ ID NO: 18124
  Dockerin_dom

SEQ ID NO: 20751 - DNA, 105 bp, Neocallimastix californiae; identical to SEQ ID NO: 18126
  Dockerin_dom

SEQ ID NO: 20752 - DNA, 117 bp, Neocallimastix californiae
  Dockerin_dom
ttgggctaaggctttaggttatgaatgttgtaagacttgtcaaactactgtatcaaaagatgaaaatggtgaatggggtattgaaaatgatgaatggtgtggtattacaaccgatat

SEQ ID NO: 20753 - DNA, 103 bp, Neocallimastix californiae
  Dockerin_dom
tgaaggatacagtaaatgtgataactgtgaagttgtttacagtgatgattctggtaactggggtgtccaaaacaatgattggtgtggtattagcaacaaatgt

SEQ ID NO: 20754 - DNA, 96 bp, Neocallimastix californiae
  Dockerin_dom
cccatgctgttctgaatgtaattctgtctactctgatgaatctggtgaatggggtgttgaaaacaatgattggtgtttattaaagaaatcttgtgg

SEQ ID NO: 20755 - DNA, 117 bp, Neocallimastix californiae
  Dockerin_dom
ttgtttcgcaaaggcacaaggttttgaatgttgtaatgacagtgaagtagtatattctgatgattctggtgactggggtgttgttaatggacaatggtgtggtattggtggatcttc

SEQ ID NO: 20756 - DNA, 102 bp, Neocallimastix californiae
  Dockerin_dom
tcaagaatataattgttgtaaaggatgtgatgttatttataccgatacttcagattggggagttgaagatgatgattggtgttctattccatatacttgcga

SEQ ID NO: 20757 - DNA, 126 bp, Neocallimastix californiae
  Dockerin_dom
atgttgggcaacagaacttggttatccatgttgtgaattaaaaactacaaaaatcgaatttacagatagtggttctggtaaacaatttggtgttgaaaataatcatatttgtggtattaatagtat

SEQ ID NO: 20758 - DNA, 126 bp, Neocallimastix californiae
  Dockerin_dom
ctctgaaaagattcttgctcaaggatataaatgctgttctgacaagaattgtattgtatactatgaagatagcgatggttactggggaattgaaaatgatgattggtgtggttgtggaacagaagc

SEQ ID NO: 20759 - DNA, 103 bp, Neocallimastix californiae
  Dockerin_dom
tgtccaaggttatccttgttgtaaaaatacatctactgtcttctatactgatgatgatggtgactggggtgttgaaaacaataactggtgtgtaatcaaaaaa

SEQ ID NO: 20760 - DNA, 120 bp, Neocallimastix californiae
  Dockerin_dom
atgtacatcagaaaaattaggttacccatgttgttcctctaataataataaagtttattatactgataatgatggagattggggctttgatgaaaataccaataactggtgtggtttaac

SEQ ID NO: 20761 - DNA, 121 bp, Neocallimastix californiae; identical to SEQ ID NO: 18135
  Dockerin_dom

SEQ ID NO: 20762 - DNA, 117 bp, Neocallimastix californiae; identical to SEQ ID NO: 18136
  Dockerin_dom

SEQ ID NO: 20763 - DNA, 123 bp, Neocallimastix californiae; identical to SEQ ID NO: 18139
  Dockerin_dom

SEQ ID NO: 20764 - DNA, 99 bp, Neocallimastix californiae
  Dockerin_dom
ttacccatgttgctctaagtgtaacgttgtatatactgatgaagagggcgaatggggatacgaaaaaggatcatggtgtggtattaaagatacttgtaa

SEQ ID NO: 20765 - DNA, 123 bp, Neocallimastix californiae; identical to SEQ ID NO: 18138
  Dockerin_dom

SEQ ID NO: 20766 - DNA, 111 bp, Neocallimastix californiae
  Dockerin_dom
ttggtctaaaaaatttaatattccatgttgtaaatcaactgatgctgttgtaagatcaacttatgatggtgaatggggtttagaaaatggtgaatggtgtggtcttggttt

SEQ ID NO: 20767 - DNA, 124 bp, Neocallimastix californiae
  Dockerin_dom
atgctggtcaaagaaatttggctatggctgttgtgaaggatgccgtgcctatgaagaagatgctgatggtaaatggggttatgaaaacaatgaatggtgtggtattgttgaacaaaattgtcaa

SEQ ID NO: 20768 - DNA, 123 bp, Neocallimastix californiae; identical to SEQ ID NO: 18141
  Dockerin_dom

SEQ ID NO: 20769 - DNA, 120 bp, Neocallimastix californiae
  Dockerin_dom
ttggtctaaggcattaggctataattgttgtactaccacttccgtcgtccagtacgaagatcaagatggtccttggggtattgaaaataatgattggtgtggtatcataaaaaataataa

SEQ ID NO: 20770 - DNA, 120 bp, Neocallimastix californiae
  Dockerin_dom
ttgttggtcttcccgattaggttacccatgctgtacttccaccaatagtatctacttttcggacggtgatggagattggggtatcgaaaataatcagtggtgtggccttccaaaacaagt

SEQ ID NO: 20771 - DNA, 117 bp, Neocallimastix californiae; identical to SEQ ID NO: 18145
  Dockerin_dom

SEQ ID NO: 20772 - DNA, 93 bp, Neocallimastix californiae
  Dockerin_dom
caattgttgtcaaggttgtaaggtaaaatatgttgattctgaaaaatggggttatgaaaatggtgaatggtgttccattccatatagctgtga

SEQ ID NO: 20773 - DNA, 123 bp, Neocallimastix californiae
  Dockerin_dom
atgttggtctatagaagaaggatatccatgttgccaaaagaaaacaaccaaagttaaacatgtttctaaaaatggaaatgaatggggtgttgaaaacaataattggtgtggtattactgatct

SEQ ID NO: 20774 - DNA, 120 bp, Neocallimastix californiae; identical to SEQ ID NO: 18148
  Dockerin_dom

SEQ ID NO: 20775 - DNA, 99 bp, Neocallimastix californiae
  Dockerin_dom
taaaaagaatactttaccatgttgtactacctgtgatatttatttaattgatgctactggtagatatggttatgaaaatggtgaatggtgtaatactcc

SEQ ID NO: 20776 - DNA, 123 bp, Neocallimastix californiae
  Dockerin_dom
ttggtctcgttccattggttttgtttgttgtgataaatgtaatgttctttacgttgatgaacaaggtcaatggggtgttgaagatggctactggtgtggtatcaacccaagcaaatgtaaata

SEQ ID NO: 20777 - DNA, 117 bp, Neocallimastix californiae; identical to SEQ ID NO: 18151
  Dockerin_dom

SEQ ID NO: 20778 - DNA, 114 bp, Neocallimastix californiae
  Dockerin_dom
ttggtcagaacgtttaggttacccatgctgtgtcggatatactgatactatatttgctgatgctgatggtgaatggggcttacaaaatgatgattggtgtggtattactgatgc

SEQ ID NO: 20779 - DNA, 120 bp, Neocallimastix californiae
  Dockerin_dom
atgctggtctgaaagttatggttacaaatgttgtactgatccagatgctaaaatagaatatgatggtgatggtaatttatggggtgttgaaaatggtgaatggtgtggtattaaaaaagt

SEQ ID NO: 20780 - DNA, 114 bp, Neocallimastix californiae
  Dockerin_dom
ttggtctgaaccagaatatagatgttgtaatccagaaactcaagtcttttattctgatgatcaaggaaagtggggtattgaaaatggtgaatggtgtggtattattgaaaatat

SEQ ID NO: 20781 - DNA, 120 bp, Neocallimastix californiae; identical to SEQ ID NO: 18152
  Dockerin_dom

SEQ ID NO: 20782 - DNA, 114 bp, Neocallimastix californiae; identical to SEQ ID NO: 18156
  Dockerin_dom

SEQ ID NO: 20783 - DNA, 111 bp, Neocallimastix californiae; identical to SEQ ID NO: 18158
  Dockerin_dom

SEQ ID NO: 20784 - DNA, 111 bp, Neocallimastix californiae
  Dockerin_dom
ttgggctgttaaatatggttattcctgctgtaaggaaactactgttattgaagaagttgatgaaaatggcagatggggttttgaaaatggtggaagatgtggttttattga

SEQ ID NO: 20785 - DNA, 123 bp, Neocallimastix californiae
  Dockerin_dom
ttcaccaaaaattctcgcacaaggatatagttgttgtccaaaaggatgtagagtttacgaaactgatgaagatggtgattggggttatgtagacaatgaatggtgtggttgtaaagtagacta

SEQ ID NO: 20786 - DNA, 102 bp, Neocallimastix californiae; identical to SEQ ID NO: 18160
  Dockerin_dom

SEQ ID NO: 20787 - DNA, 123 bp, Neocallimastix californiae; identical to SEQ ID NO: 18161
  Dockerin_dom

SEQ ID NO: 20788 - DNA, 123 bp, Neocallimastix californiae; identical to SEQ ID NO: 18166
  Dockerin_dom

SEQ ID NO: 20789 - DNA, 123 bp, Neocallimastix californiae; identical to SEQ ID NO: 18165
  Dockerin_dom

SEQ ID NO: 20790 - DNA, 123 bp, Neocallimastix californiae; identical to SEQ ID NO: 18164
  Dockerin_dom

SEQ ID NO: 20791 - DNA, 123 bp, Neocallimastix californiae
  Dockerin_dom
ttggtcagaatctaaaggttatccatgttgtaaatattgtgatgttgtttctgttgatagatatggttcatggggtattgaaaacggtaaatggtgtggtgtaaaatccgatgtttgtaacat

SEQ ID NO: 20792 - DNA, 123 bp, Neocallimastix californiae; identical to SEQ ID NO: 18163
  Dockerin_dom

SEQ ID NO: 20793 - DNA, 120 bp, Neocallimastix californiae
  Dockerin_dom
atgttttgccacaaaattaggatatccttgttgtagtgttggttatccaactgttttaaaagatgaaagtggtagttggagtgttgaaaatggggaatggtgtggtgtttctgatgatga

SEQ ID NO: 20794 - DNA, 117 bp, Neocallimastix californiae; identical to SEQ ID NO: 18168
  Dockerin_dom

SEQ ID NO: 20795 - DNA, 121 bp, Neocallimastix californiae; identical to SEQ ID NO: 18170
  Dockerin_dom

SEQ ID NO: 20796 - DNA, 114 bp, Neocallimastix californiae; identical to SEQ ID NO: 15621
  Dockerin_dom

SEQ ID NO: 20797 - DNA, 114 bp, Neocallimastix californiae
  Dockerin_dom
atgttggtcacttaagctgaattacccttgttgtgaccgtaataataccatttctttttataggaatgattatggtgcatggggtaatgtagataataaatggtgtgggttata

SEQ ID NO: 20798 - DNA, 123 bp, Neocallimastix californiae; identical to SEQ ID NO: 18173
  Dockerin_dom

SEQ ID NO: 20799 - DNA, 114 bp, Neocallimastix californiae; identical to SEQ ID NO: 18172
  Dockerin_dom

SEQ ID NO: 20800 - DNA, 120 bp, Neocallimastix californiae; identical to SEQ ID NO: 18175
  Dockerin_dom

SEQ ID NO: 20801 - DNA, 114 bp, Neocallimastix californiae
  Dockerin_dom
tacttttgaatcaattggatataattgctgttcatctacaactgatgttatataccaagatgaaaatggtgattggggtgtagaaaataacgactggtgcggtatcatcccatc

SEQ ID NO: 20802 - DNA, 126 bp, Neocallimastix californiae; identical to SEQ ID NO: 18176
  Dockerin_dom

SEQ ID NO: 20803 - DNA, 117 bp, Neocallimastix californiae
  Dockerin_dom
ttggtctgatgctttaggatacccatgttgtcatggttgtactgtttatgaaacagatgctgatggttcttggggttatgaaagtaatcaatggtgtggtattcaatcttactgcca

SEQ ID NO: 20804 - DNA, 117 bp, Neocallimastix californiae; identical to SEQ ID NO: 18178
  Dockerin_dom

SEQ ID NO: 20805 - DNA, 120 bp, Neocallimastix californiae; identical to SEQ ID NO: 18179
  Dockerin_dom

SEQ ID NO: 20806 - DNA, 93 bp, Neocallimastix californiae
  Dockerin_dom
taagtgttgtagtcactgtaacgtatcctacacagattcaacaaaatggggaattgaaaataaccattggtgtcatattccatccacttgtga

SEQ ID NO: 20807 - DNA, 135 bp, Neocallimastix californiae
  Dockerin_dom
ctgttggtccgaggcctacggttatcactgctgtaagaatccagataccgtattaattgaacctcgtagtaaatccaatccaggacgtgaatggtatggcgtcgaagataataaatggtgtggtattgcagaata

SEQ ID NO: 20808 - DNA, 102 bp, Neocallimastix californiae
  Dockerin_dom
atataattgttgtgtcttctcaactacggaaaatgttcaaaccaccgaagaaggtaaatggggagtagaatttaataaatggtgtcttatcgacgatgattt

SEQ ID NO: 20809 - DNA, 99 bp, Neocallimastix californiae
  Dockerin_dom
tgaatgttgtagcggttgtgatgtattttattctgataatgaagccttatggggtgttgaaaatggtaattggtgtgtaattcaaaattctgtatgtgg

SEQ ID NO: 20810 - DNA, 102 bp, Neocallimastix californiae
  Dockerin_dom
ttatccaaattgtaattcatgtgatgtttattatacagatgccactggtaagtggggtgttgagaacagaaattggtgtattattcaagaaagtagatgtgg

SEQ ID NO: 20811 - DNA, 108 bp, Neocallimastix californiae
  Dockerin_dom
tgcctatgaagattgtgaaggttgttatgttgtaactgaagaagatggtatcaaatggggtgttgagaacaatgattggtgtaaaattgtttcctccaagtgtaataa

SEQ ID NO: 20812 - DNA, 99 bp, Neocallimastix californiae
  Dockerin_dom
ttatatgtgttgtgaaggttgtgatgtttacgatcaaactgaagaaggaatgtggggtattgaaaatgacaactggtgtggtattaaggattcttgttt

SEQ ID NO: 20813 - DNA, 99 bp, Neocallimastix californiae
  Dockerin_dom
ttataaatgttgtcaaggttgtaacgtcattgaagaagatgcttccggaaaatggggtattgaaaacaatgaatggtgtggtattaaagattcctgctt

SEQ ID NO: 20814 - DNA, 118 bp, Neocallimastix californiae
  Dockerin_dom
ggctactaagcttggttacaagtgttgtaccgctaagtgtccagttgaagaatacgtcgataatgatggtagctggggtattgaaaacaataattggtgtggtattactaagtcatgt

SEQ ID NO: 20815 - DNA, 126 bp, Neocallimastix californiae; identical to SEQ ID NO: 18188
  Dockerin_dom

SEQ ID NO: 20816 - DNA, 123 bp, Neocallimastix californiae
  Dockerin_dom
tgaatgctctgcatcaaaattcggttatccatgttgtaaaggttgtactgtttatgaaaaagatgaagttggcgaatggggttatgaaaatgatgaatggtgtagtataaaagctacatgttc

SEQ ID NO: 20817 - DNA, 129 bp, Neocallimastix californiae; identical to SEQ ID NO: 18190
  Dockerin_dom

SEQ ID NO: 20818 - DNA, 123 bp, Neocallimastix californiae
  Dockerin_dom
ttgttgggctgctaaattaggtttcaactgttgtaagactactaagactgttgtctatgaagatgctgatggtaattggggtgttgaagatgattactggtgtggtattattgaagataaaga

SEQ ID NO: 20819 - DNA, 108 bp, Neocallimastix californiae
  Dockerin_dom
atgtgaatttagtacaattggttactcttgctgtccagataatgaagttatctttgaagatgatcacaaatggggtgtcaatagcaatggtcaatggtgtggtgtttc

SEQ ID NO: 20820 - DNA, 117 bp, Neocallimastix californiae; identical to SEQ ID NO: 18193
  Dockerin_dom

SEQ ID NO: 20821 - DNA, 117 bp, Neocallimastix californiae; identical to SEQ ID NO: 15646
  Dockerin_dom

SEQ ID NO: 20822 - DNA, 102 bp, Neocallimastix californiae
  Dockerin_dom
aaaaggatataatagttgtacattgggaactaaagtttcatttactgatgtaaatggtatttggggtatagaaaatgataaatggtgtgctatacttagtaa

SEQ ID NO: 20823 - DNA, 111 bp, Neocallimastix californiae; identical to SEQ ID NO: 18198
  Dockerin_dom

SEQ ID NO: 20824 - DNA, 123 bp, Neocallimastix californiae; identical to SEQ ID NO: 18197
  Dockerin_dom

SEQ ID NO: 20825 - DNA, 120 bp, Neocallimastix californiae
  Dockerin_dom
gtgttggtctttatctgaaggatataaatgttgtagtgcaggtactactgtcgcattagttgatagtaaaggtaagtggggtattgaaaacggagattggtgtggtattattgatgctaa

SEQ ID NO: 20826 - DNA, 123 bp, Neocallimastix californiae
  Dockerin_dom
ttgttgggcaacaaaattagattatccatgctgttcctattctactcaagtttttgaaacggatgaaaatggtcaatggagtatagaaaatggagaatggtgtggtattgtaagtagccaatc

SEQ ID NO: 20827 - DNA, 120 bp, Neocallimastix californiae; identical to SEQ ID NO: 18201
  Dockerin_dom

SEQ ID NO: 20828 - DNA, 123 bp, Neocallimastix californiae
  Dockerin_dom
ttgtttttctgagaaattggggtacccatgttgtaaaaaaacaaaagatattgtttactcagatgaagatggtccatggggtgtagaagataatagttggtgtggtattcaaagagaaaagaa

SEQ ID NO: 20829 - DNA, 120 bp, Neocallimastix californiae; identical to SEQ ID NO: 18205
  Dockerin_dom

SEQ ID NO: 20830 - DNA, 120 bp, Neocallimastix californiae
  Dockerin_dom
ctgctggtctgaagccttaggctatccatgttgtcaaggtgaagtagaatatgtagaaagtaatgaaaatggtgattggggtttagaaaacaatgaatggtgtggtcttccaaagacaag

SEQ ID NO: 20831 - DNA, 117 bp, Neocallimastix californiae; identical to SEQ ID NO: 18206
  Dockerin_dom

SEQ ID NO: 20832 - DNA, 115 bp, Neocallimastix californiae; identical to SEQ ID NO: 18203
  Dockerin_dom

SEQ ID NO: 20833 - DNA, 120 bp, Neocallimastix californiae; identical to SEQ ID NO: 18207
  Dockerin_dom

SEQ ID NO: 20834 - DNA, 120 bp, Neocallimastix californiae
  Dockerin_dom
atgctggtcatcaaaattaggttacaaatgttgttctagaggttgtaatactgctgttgttgttactgataatgatggtgcttggggtgttgaaaacggtgaatggtgtggtgttcaatg

SEQ ID NO: 20835 - DNA, 111 bp, Neocallimastix californiae
  Dockerin_dom
ctgctggtctgaaccagattatccatgctgtaagaatacctgtagagttgtctataccgatagttctgaatggggtgttgaaaatggtaactggtgtggtattccaagttt

SEQ ID NO: 20836 - DNA, 97 bp, Neocallimastix californiae
  Dockerin_dom
tccatgttgtagtacttgtgacgtttatttaactgaagataatggtagtcgctggggtgttgaaaataacgactggtgtagtatcaaaaattcttgt

SEQ ID NO: 20837 - DNA, 73 bp, Neocallimastix californiae; identical to SEQ ID NO: 15663
  Dockerin_dom

SEQ ID NO: 20838 - DNA, 120 bp, Neocallimastix californiae; identical to SEQ ID NO: 18212
  Dockerin_dom

SEQ ID NO: 20839 - DNA, 45 bp, Neocallimastix californiae
  Dockerin_dom
gggtgttgaaaatggtaattggtgtggaataaagtcatcatgtaa

SEQ ID NO: 20840 - DNA, 117 bp, Neocallimastix californiae
  Dockerin_dom
ttgctggtctgaaccagattacaagtgttgtactacctgtgatattgtttatactgatgatcataactggggtgttgaaaatggcgaatggtgtggtattgatgatagtaaatgtgg

SEQ ID NO: 20841 - DNA, 118 bp, Neocallimastix californiae
  Dockerin_dom
atgtggtgctgctgctctcggttatccatgttgtcaatcaacttgtactgaagtttatactgatgaatacagatggggtgttgaaaatggtgactggtgtggacttaaggattcctgt

SEQ ID NO: 20842 - DNA, 123 bp, Neocallimastix californiae; identical to SEQ ID NO: 18216
  Dockerin_dom

SEQ ID NO: 20843 - DNA, 126 bp, Neocallimastix californiae
  Dockerin_dom
atgttggtcagaaatattaggatatccatgttgtaaaggatgtaaaatctatgaaactgactcagatggatcttggggatatgaatttaatcaatggtgtggtattatttcatcccgctgtcaaaa

SEQ ID NO: 20844 - DNA, 117 bp, Neocallimastix californiae
  Dockerin_dom
ttgtttctctattgctttaggtttcccatgttgtaagggtaatacagtaatttatactgatgatgatggtgattggggtgttgaaaatgaagaatggtgtggtattagtggtagttc

SEQ ID NO: 20845 - DNA, 118 bp, Neocallimastix californiae
  Dockerin_dom
atgctttgctaaagctttaggttatgaatgttgtagtacttgtgatgttgtttatacagatgatgatggtgattggggtgttgataatggtgaatggtgtggtattaaagataattgt

SEQ ID NO: 20846 - DNA, 123 bp, Neocallimastix californiae
  Dockerin_dom
ctgttgggctgaagaattagatgatggctacccatgttgtaaaactactaatgtagttatagaaactgatggcaatggggaatggggtattgaaaatgatcaatggtgtggtattagaaagtg

SEQ ID NO: 20847 - DNA, 117 bp, Neocallimastix californiae
  Dockerin_dom
taaatgttggtcgaatttcttaggttatccatgttgtaagaaaactgacgatattatttataatgcagttaaaggatcatggggttatgaaaataattcatggtgtggtttagattt

SEQ ID NO: 20848 - DNA, 123 bp, Neocallimastix californiae
  Dockerin_dom
ctggtctgaattattagatgatccatttccttgttgtactaaggatgatggaccaatagaaggtgaaaatatggaaggttcatggggtatagaaaatggtcaaaaatgtggttatagaagtag

SEQ ID NO: 20849 - DNA, 123 bp, Neocallimastix californiae; identical to SEQ ID NO: 18219
  Dockerin_dom

SEQ ID NO: 20850 - DNA, 117 bp, Neocallimastix californiae
  Dockerin_dom
ttgtaaaggtctaagtgaaggttatccatgttgttcaagtcttagtatgaagacttcaggatatgatgatcaatggggctatgaagataatgattggtgtcgtttaactgatgaaca

SEQ ID NO: 20851 - DNA, 123 bp, Neocallimastix californiae
  Dockerin_dom
ttggtcattaaaattagatgaaccatatccatgttgtgtttatgctaccgaaatcatatacactaatgaaaatggtaaatggagtatggaaaatggtgactggtgtggtataatagaaaatgc

SEQ ID NO: 20852 - DNA, 120 bp, Neocallimastix californiae
  Dockerin_dom
ctgctgggcaaccaagaaaggttttccatgttgttcaaacaaagatacttcaattgttagtgttgattcggaaggacaatggggaatggaaaacggtcaatggtgtggaattgaaaaatg

SEQ ID NO: 20853 - DNA, 126 bp, Neocallimastix californiae
  Dockerin_dom
gtgttggtcattaagccaaggatatccatgttgttcaattcaaccatatcatatagaattaagtgatgaatctggtgattggggtatagaaaatggagattggtgtggtattcctaaatctaacaa

SEQ ID NO: 20854 - DNA, 117 bp, Neocallimastix californiae
  Dockerin_dom
ttggtctgtcagtaaaggttatccatgttgtgtaggagataatccttccatagaatttgttgattctgatggtcaatggggtttggaaaatggaaattggtgtggtattgcagtaga

SEQ ID NO: 20855 - DNA, 105 bp, Neocallimastix californiae
  Dockerin_dom
tactggttattcctgctgtatgtttaatactaccgccatagccactaaggatagtgatggttattggggtgttgaaaatggtcaatggtgtctctttgaaaacaa

SEQ ID NO: 20856 - DNA, 117 bp, Neocallimastix californiae
  Dockerin_dom
tccagccgctaaaaatggatataaatgttgtaatgcctgtaaggtcaagaccacagataaaaatggtgactggggtgttgaaaatggagaatggtgttccattccatacacttgtag

SEQ ID NO: 20857 - DNA, 129 bp, Neocallimastix californiae
  Dockerin_dom
atgttggtctaaaagtcaaggttattcctgttgtaaggatgccaccactaccgttcgtacgacggatagtaaaggttatttatggggtattgaaaataatgaatggtgtggtattaccggaaatcaatg

SEQ ID NO: 20858 - DNA, 123 bp, Neocallimastix californiae; identical to SEQ ID NO: 18231
  Dockerin_dom

SEQ ID NO: 20859 - DNA, 108 bp, Neocallimastix californiae; identical to SEQ ID NO: 18230
  Dockerin_dom

SEQ ID NO: 20860 - DNA, 120 bp, Neocallimastix californiae
  Dockerin_dom
ttctggtgctatcttaagtcaaggttacaaatgttgtagtagtggatgttctgtagtttacactgatggtgatggtacttggggatttgaaaatgatcaatggtgtggatgtaatctctc

SEQ ID NO: 20861 - DNA, 124 bp, Neocallimastix californiae
  Dockerin_dom
agcttctattgcttcccaaggttataaatgttgtagtagtaataactgtgatgtttatcttaccgatgaatctggtaaatggggtgttgaaaacaatgactggtgtggtatttccaacagttgt

SEQ ID NO: 20862 - DNA, 117 bp, Neocallimastix californiae
  Dockerin_dom
ttctgctgctatcttaagtcaaggttacaaatgttgtagtggtggatgttctgtagtttacactgacggcgatggtacttggggagttgagaatggtcaatggtgtggatgtgctct

SEQ ID NO: 20863 - DNA, 124 bp, Neocallimastix californiae
  Dockerin_dom
agctactattacttcccaaggttataaatgttgtagcagtaataactgtgatgtctatcttaccgatgaatctggaagatggggtgttgaaaacaatgattggtgtggtatttccaacagttgt

SEQ ID NO: 20864 - DNA, 102 bp, Neocallimastix californiae
  Dockerin_dom
tcttggttatgagtgttgtaaaactactactactgttatctatacggatgaatctggtaaatggggtattgaaaataacgaatggtgtgaaattaaagataa

SEQ ID NO: 20865 - DNA, 120 bp, Neocallimastix californiae; identical to SEQ ID NO: 18243
  Dockerin_dom

SEQ ID NO: 20866 - DNA, 120 bp, Neocallimastix californiae; identical to SEQ ID NO: 18245
  Dockerin_dom

SEQ ID NO: 20867 - DNA, 96 bp, Neocallimastix californiae
  Dockerin_dom
tagtaattgtaaaaacacttgtgaaattgcctatgaagatgaaaataaatggggtattgaaaatgaagattggtgtattcttccagattcttgttt

SEQ ID NO: 20868 - DNA, 120 bp, Neocallimastix californiae
  Dockerin_dom
atgttgggcttcatcattaggttattcatgttgtaaaggatgtgatataataattactgattccaatggcgattggggtgttgaagataatgaatggtgtggtattttatcaacatgtaa

SEQ ID NO: 20869 - DNA, 111 bp, Neocallimastix californiae; identical to SEQ ID NO: 18248
  Dockerin_dom

SEQ ID NO: 20870 - DNA, 123 bp, Neocallimastix californiae; identical to SEQ ID NO: 18249
  Dockerin_dom

SEQ ID NO: 20871 - DNA, 96 bp, Neocallimastix californiae
  Dockerin_dom
ctatccatgctgtaagaccaccactgagattgtgtcaaccgataactccggagattggggtatagaaaatgatgagtggtgtggtattggtaatgg

SEQ ID NO: 20872 - DNA, 111 bp, Neocallimastix californiae
  Dockerin_dom
aggaactgaatataaatgttgttccagctgtttagatgtctatgaagaagatgagaatggaccatgggcaattgaggatgaacaatggtgttcacttccatattattgtca

SEQ ID NO: 20873 - DNA, 96 bp, Neocallimastix californiae
  Dockerin_dom
cggatatccatgctgtagcaactgtgaacttacctaccaagatgaaacaggaaagtggggagtagaaggagaggaatggtgtggacttcgtgacat

SEQ ID NO: 20874 - DNA, 123 bp, Neocallimastix californiae
  Dockerin_dom
atgttggtcattaaaatatggttatctttgctgtaattctgattctacttcagttgttaaaaccaataaatatggtaattggggtaaggaaaatggtaaatggtgtggtattaaagatcaatc

SEQ ID NO: 20875 - DNA, 120 bp, Neocallimastix californiae
  Dockerin_dom
atgtccattcaaagctataggctatggatgttgtaaaaattctaagactgaaattgtttttactgatagttttggtaactatggtgttgaaaagggtaagcgttgtggtattattgatga

SEQ ID NO: 20876 - DNA, 123 bp, Neocallimastix californiae; identical to SEQ ID NO: 18256
  Dockerin_dom

SEQ ID NO: 20877 - DNA, 93 bp, Neocallimastix californiae
  Dockerin_dom
caggtgttgtaaggaatgtaatgtcatcttcaccgactctgaagattggggtatagaagatggtgactggtgttctattccatacacttgtga

SEQ ID NO: 20878 - DNA, 99 bp, Neocallimastix californiae
  Dockerin_dom
taccggttatcactgttgtctttacaccactgaggtggaaaccacagatgccgtgggtcagtggggtattgaagccggagaatggtgtctctttgaaca

SEQ ID NO: 20879 - DNA, 114 bp, Neocallimastix californiae; identical to SEQ ID NO: 18258
  Dockerin_dom

SEQ ID NO: 20880 - DNA, 126 bp, Neocallimastix californiae
  Dockerin_dom
ttgctggtcattacctttaggttacaattgttgttcctctgacaacactgaagtatactatactgatgatgatggtcaatggggtgttgaaaatggtgactggtgtggtatcatgagtgataaatg

SEQ ID NO: 20881 - DNA, 120 bp, Neocallimastix californiae
  Dockerin_dom
ttggtccgaacctttaggttatgaatgttgtgatccaaaggataatacttactattatgaggatgatgatggttactggggattagttgatggtgaatggtgtggtatcattgctgaaaa

SEQ ID NO: 20882 - DNA, 114 bp, Neocallimastix californiae; identical to SEQ ID NO: 18262
  Dockerin_dom

SEQ ID NO: 20883 - DNA, 108 bp, Neocallimastix californiae
  Dockerin_dom
ttatccatgttgttcaaggtgtgatataaaagtaattcttgatgatggtgataataaacaatggggtattgaaaattcaaattggtgtggtctcccagacaattgttt

SEQ ID NO: 20884 - DNA, 117 bp, Neocallimastix californiae
  Dockerin_dom
atgttttgctaataaattaggatatccatgttgtacacaaactaatgaaatcgtttctattgatgaaaacggtaaatggggtttagaaaatggtcaaatttgtggtattgaagaaat

SEQ ID NO: 20885 - DNA, 123 bp, Neocallimastix californiae; identical to SEQ ID NO: 18264
  Dockerin_dom

SEQ ID NO: 20886 - DNA, 120 bp, Neocallimastix californiae
  Dockerin_dom
ttgggctaaagaattaggatatgaatgttgtagtactaattcttgtagaaatgctatttataccgatgatgacggtgaatgggatgtcgaaaatggcaactggtgtggtataacctctgc

SEQ ID NO: 20887 - DNA, 123 bp, Neocallimastix californiae
  Dockerin_dom
ttcaaagaaatttaatcaaatgggttataaatgttgtaattcatgtaatgctgtttataccgattccaccggtagatggggagtcgaaaacagacaatggtgtggtattcgtaatgactgtaa

SEQ ID NO: 20888 - DNA, 126 bp, Neocallimastix californiae
  Dockerin_dom
ctctatgttaagacaaggttataaatgttgtgaaatcaacaattgtaatatttaccataaggatggtgatggtgattggggtcttgacagaaacttaaaatggtgtggtatccgttttgaatgtaa

SEQ ID NO: 20889 - DNA, 123 bp, Neocallimastix californiae; identical to SEQ ID NO: 18268
  Dockerin_dom

SEQ ID NO: 20890 - DNA, 93 bp, Neocallimastix californiae
  Dockerin_dom
tccatgctgtaaggaatgtaacatttattatacggatagtgaagattggggtattgaagatggaaaatggtgttccattccacattcttgtaa

SEQ ID NO: 20891 - DNA, 93 bp, Neocallimastix californiae
  Dockerin_dom
cggctttaactgttgtctcttcacaaccatagtggcgacgaccgattctgttggtcaatggggcgttgaaaacggagaatggtgtctctttga

SEQ ID NO: 20892 - DNA, 129 bp, Neocallimastix californiae
  Dockerin_dom
ttgggcaacttatcttgataaaaattatacttgttgttcaaatgataatattgaaattaaatccattaatatggatggagaatggggtcttgagaataataattggtgtggtttaagaaatagtaaagt

SEQ ID NO: 20893 - DNA, 117 bp, Neocallimastix californiae
  Dockerin_dom
ttggtccttaccggattattcatgttgtaaagataagaatatagatgtaatctatacagataatatgggcaattggggtattgaaaatggagaatggtgtggtattataagagaatc

SEQ ID NO: 20894 - DNA, 114 bp, Neocallimastix californiae; identical to SEQ ID NO: 18276
  Dockerin_dom

SEQ ID NO: 20895 - DNA, 96 bp, Neocallimastix californiae
  Dockerin_dom
tccatgttgtaataataataatattgctgtagtaataactgatgataagggtaattggggtattgaaaatggagaatggtgtggtattctaaaaga

SEQ ID NO: 20896 - DNA, 120 bp, Neocallimastix californiae
  Dockerin_dom
ctgttggtctttacctgattatccatgttgtcgtaataaaaagacagatgtagtttatacagatgataatggtaattggggtattgaaaatgaaaattggtgtgggattattagagaatc

SEQ ID NO: 20897 - DNA, 123 bp, Neocallimastix californiae; identical to SEQ ID NO: 18274
  Dockerin_dom

SEQ ID NO: 20898 - DNA, 120 bp, Neocallimastix californiae; identical to SEQ ID NO: 18275
  Dockerin_dom

SEQ ID NO: 20899 - DNA, 85 bp, Neocallimastix californiae; identical to SEQ ID NO: 15727
  Dockerin_dom

SEQ ID NO: 20900 - DNA, 117 bp, Neocallimastix californiae; identical to SEQ ID NO: 18279
  Dockerin_dom

SEQ ID NO: 20901 - DNA, 117 bp, Neocallimastix californiae; identical to SEQ ID NO: 18280
  Dockerin_dom

SEQ ID NO: 20902 - DNA, 120 bp, Neocallimastix californiae; identical to SEQ ID NO: 18281
  Dockerin_dom

SEQ ID NO: 20903 - DNA, 120 bp, Neocallimastix californiae
  Dockerin_dom
atgttggtctgaagctcaaggttatccctgctgtaaattcacttctgatgtcgttttcaccgacaatgacggaaactggggtgttgaaaatggaaattggtgtggtatccaaaagaagaa

SEQ ID NO: 20904 - DNA, 121 bp, Neocallimastix californiae
  Dockerin_dom
atgttggtctgaaagtcttggatataaatgttgttcatcatgtggacaagtatacttcaccgatgaaaatggaagatggagtgttgaaaatgatgactggtgtggtttactagccaactgt

SEQ ID NO: 20905 - DNA, 117 bp, Neocallimastix californiae
  Dockerin_dom
ttgttggtcaaattctttaggatacaattgttgtagtgattcaaatactcaagtgtactatgaagatcaagatggtcaatggggtattgaaaataataattggtgtggtatttccag

SEQ ID NO: 20906 - DNA, 124 bp, Neocallimastix californiae
  Dockerin_dom
ttcatcctcatttacttctcaaggctataagtgttgttcctattgtagtacagtttattatactgatgattcaggaaaatggggtattgaaaatggcaattggtgtggattaccaagtaattgt

SEQ ID NO: 20907 - DNA, 120 bp, Neocallimastix californiae
  Dockerin_dom
ttccgaaaagatccttaagcaaggttacaaatgttgtccagctaactgtcaaattgtttatgctgataatgatggtacttggggtgttgacaataatcaatggtgtggatgtggtaatgc

SEQ ID NO: 20908 - DNA, 118 bp, Neocallimastix californiae
  Dockerin_dom
atgtacaggtagaaatcagggctatcaatgctgtaattcatgtgatgtttactatacagataatgatggcagatggggtgttgaaaataatgcttggtgcggtatcaagaatacttgt

SEQ ID NO: 20909 - DNA, 117 bp, Neocallimastix californiae
  Dockerin_dom
ctgtttttctgttaatcttggttatccatgttgtaatggtaacactgtttattatactgatgatgatggaaaatggggttacgaaaatgataattggtgtggtattaaagaaactga

SEQ ID NO: 20910 - DNA, 126 bp, Neocallimastix californiae; identical to SEQ ID NO: 18289
  Dockerin_dom

SEQ ID NO: 20911 - DNA, 123 bp, Neocallimastix californiae
  Dockerin_dom
agctgctattactaaccaaggttacaagtgttgtagtgctaagtgtaacccagttgtttacaaggatgaatctggtgactggggtgttgaaaacaaccaatggtgtggttgtccaactgatgc

SEQ ID NO: 20912 - DNA, 117 bp, Neocallimastix californiae
  Dockerin_dom
tgctattactagccaaggttacaagtgttgtagaaacaagtgtaacccagttgtttaccaagatgaagctggtgactggggtgttgaaaacaaccaatggtgtggatgtccaactgc

SEQ ID NO: 20913 - DNA, 117 bp, Neocallimastix californiae; identical to SEQ ID NO: 20912
  Dockerin_dom

SEQ ID NO: 20914 - DNA, 124 bp, Neocallimastix californiae
  Dockerin_dom
taattctaaggttactcaacaaggttacaagtgttgctcaacttgtactgctactgtttacgttgatgatgccggtaaatggggtgttgaaaacaatgactggtgtggtattccaaccaattgt

SEQ ID NO: 20915 - DNA, 117 bp, Neocallimastix californiae
  Dockerin_dom
tgctattactagccaaggttacaagtgttgtagtgctaagtgtaacccagttgtttaccaagatgaagctggtgactggggtgttgaaaacaaccaatggtgtggatgtccaactgc

SEQ ID NO: 20916 - DNA, 124 bp, Neocallimastix californiae
  Dockerin_dom
taattctaaggttactcaacaaggttacaagtgttgctcaacttgtactgaaactttctacgttgatgatgccggtaaatggggtattgaaaacaatgactggtgtggtattccaaccacctgt

SEQ ID NO: 20917 - DNA, 94 bp, Neocallimastix californiae
  Dockerin_dom
tccatgttgtgaatcttgtgatgttgttaccactgatcaaaatggtaaatggggtattgaaaatggccattggtgttctattaaatattcttgt

SEQ ID NO: 20918 - DNA, 120 bp, Neocallimastix californiae; identical to SEQ ID NO: 18296
  Dockerin_dom

SEQ ID NO: 20919 - DNA, 109 bp, Neocallimastix californiae
  Dockerin_dom
atatggctatccttattgttatggctgtcaagttacttacactagcaatgatggaatttgttggggatgggaaaataataattcttgtgttattaataattcaagatgc

SEQ ID NO: 20920 - DNA, 120 bp, Neocallimastix californiae; identical to SEQ ID NO: 18298
  Dockerin_dom

SEQ ID NO: 20921 - DNA, 129 bp, Neocallimastix californiae; identical to SEQ ID NO: 18299
  Dockerin_dom

SEQ ID NO: 20922 - DNA, 105 bp, Neocallimastix californiae
  Dockerin_dom
tccatgttgctccaaatgtgatatagaagtagctttcaacgaaggtgaacataaactttggggtatagaaaattcaaattggtgtggtattccagaaagctgttc

SEQ ID NO: 20923 - DNA, 117 bp, Neocallimastix californiae
  Dockerin_dom
tgaatgctggtcattaaaattaggatattcatgttgtaaagaatccactaaagtttatactacagatgaaagtggatcatggggtgttgaaaatggacaatggtgtggtatatcaaa

SEQ ID NO: 20924 - DNA, 85 bp, Neocallimastix californiae
  Dockerin_dom
tgaatgttgttcaccaggtactaaggttgaatacacggatgaagaagcattatggggtgttgaaaatggtaattggtgttacatt

SEQ ID NO: 20925 - DNA, 117 bp, Neocallimastix californiae
  Dockerin_dom
ttgttgggctaatgattatggctacgattgttgtgggcctgaaatagtaaaaggtaattatattgataatgatggtatctggtatcaaaatgattcttattggtgtggattagtaac

SEQ ID NO: 20926 - DNA, 90 bp, Neocallimastix californiae
  Dockerin_dom
tgaatgttgttcaccaggtactaaggttgaatacacggatgaagaagcattatggggtgttgaaaatggtaattggtgttacattactag

SEQ ID NO: 20927 - DNA, 90 bp, Neocallimastix californiae
  Dockerin_dom
taaatgttgttcaccaggtactaaggttgaatacacagatgaagaagcattatggggtgttgaaaatggtaattggtgttacattactag

SEQ ID NO: 20928 - DNA, 90 bp, Neocallimastix californiae; identical to SEQ ID NO: 20926
  Dockerin_dom

SEQ ID NO: 20929 - DNA, 120 bp, Neocallimastix californiae; identical to SEQ ID NO: 18306
  Dockerin_dom

SEQ ID NO: 20930 - DNA, 120 bp, Neocallimastix californiae
  Dockerin_dom
atgtagatctgaagtgaaaggttatccttgttgtccaccagaaattacagaaatttatatggtcgatactgatggagactggggatttgatgaaaaaactaataattggtgtggttttac

SEQ ID NO: 20931 - DNA, 96 bp, Neocallimastix californiae
  Dockerin_dom
atacaagtgttgtcaacattgtaaggtggtctacactgattcacaaaaatggggtattgaagataatgaatggtgtcatattccatatacctgtga

SEQ ID NO: 20932 - DNA, 135 bp, Neocallimastix californiae
  Dockerin_dom
tacatgttggtcagagaaatatggttatccatgctgtaaagatccaaatactttattagtttcaccacaaagtaaatctaatccggatcatgaatggtatggtgttgaaaataatgaatggtgtggtattgccaa

SEQ ID NO: 20933 - DNA, 114 bp, Neocallimastix californiae
  Dockerin_dom
aaatactggttatccttgctgtagtaatccagacgctcaggtatatactacggattcctctggtgattggagtattgaaggtgatttttggtgtttagttgagaaagaaaaaga

SEQ ID NO: 20934 - DNA, 114 bp, Neocallimastix californiae; identical to SEQ ID NO: 15763
  Dockerin_dom

SEQ ID NO: 20935 - DNA, 96 bp, Neocallimastix californiae; identical to SEQ ID NO: 18312
  Dockerin_dom

SEQ ID NO: 20936 - DNA, 96 bp, Neocallimastix californiae
  Dockerin_dom
ccatgtctgtaaaaactgtagtgttgctgcttaccaaaatgatatctactggggttttgaaaataatcaatggtgtgaaatttcatcagaatgttt

SEQ ID NO: 20937 - DNA, 111 bp, Neocallimastix californiae
  Dockerin_dom
tgacaaatatggatatcgctgctgttcaacttgtactatttcatacaccgatgatactggcaattggggtgttgaaaatgatgaatggtgtattgttgaagacagctgtaa

SEQ ID NO: 20938 - DNA, 123 bp, Neocallimastix californiae; identical to SEQ ID NO: 18316
  Dockerin_dom

SEQ ID NO: 20939 - DNA, 123 bp, Neocallimastix californiae
  Dockerin_dom
atgttgggctacctctttaggatattcttgttgttctgaaggtgctgatattattttagaagatgaaaatggaaaatggggtttagaaaacgacgactggtgtggcatcattgaaaaaaaatc

SEQ ID NO: 20940 - DNA, 123 bp, Neocallimastix californiae; identical to SEQ ID NO: 18317
  Dockerin_dom

SEQ ID NO: 20941 - DNA, 117 bp, Neocallimastix californiae
  Dockerin_dom
tttctctgatactttaggttacccatgttgtactagtaccactaatgttatctacactgatagctacggtcgctggggtattgaaaacagtaattggtgtattcttgatgattcatc

SEQ ID NO: 20942 - DNA, 123 bp, Neocallimastix californiae
  Dockerin_dom
ttgtttctctcttgctcttggttataattgttgtaagcatacaaccgaagttatttctgttgataatgatggttcatggggtattgaaaataatgaatggtgtggaataggaaatagtaccaa

SEQ ID NO: 20943 - DNA, 114 bp, Neocallimastix californiae
  Dockerin_dom
tttttctgaagcattaggttatccttgttgtagtgatggagtagctgtcgtctacacagataatgatggaccatggggtgtagaaaacaatgattggtgtggtatctctaatac

SEQ ID NO: 20944 - DNA, 123 bp, Neocallimastix californiae; identical to SEQ ID NO: 18322
  Dockerin_dom

SEQ ID NO: 20945 - DNA, 126 bp, Neocallimastix californiae
  Dockerin_dom
atgctggtcttctgctttgggttatccatgctgttctagtagtaatgtaccaattattgaaactgatggtgatggccaatggggtattgaaaatgatgaatggtgtggagtaccaaaaagcactgg

SEQ ID NO: 20946 - DNA, 96 bp, Neocallimastix californiae; identical to SEQ ID NO: 18323
  Dockerin_dom

SEQ ID NO: 20947 - DNA, 121 bp, Neocallimastix californiae
  Dockerin_dom
atgttgggctgaagcttatggatatccatgttgtagtaaatgtttacctgttattgatacaacaaatgataaagaatgggcattagaaaatggaaattggtgtggtcttccatctaaatgc

SEQ ID NO: 20948 - DNA, 123 bp, Neocallimastix californiae
  Dockerin_dom
tctatcagaattttatggctatccatgttgttccccggaattaaccgaggtttacgctcaagatgactatggtgactggggttatgacttttcaaagagtgaatggtgtggtctaacaaagta

SEQ ID NO: 20949 - DNA, 126 bp, Neocallimastix californiae; identical to SEQ ID NO: 18325
  Dockerin_dom

SEQ ID NO: 20950 - DNA, 105 bp, Neocallimastix californiae
  Dockerin_dom
tggttacccatgttgtaaatcttgtgacgtcgttgatactgatgatgatggtcaatggggtgttgaaaataatgattggtgtagtattgataccgaaaagtgtgg

SEQ ID NO: 20951 - DNA, 123 bp, Neocallimastix californiae; identical to SEQ ID NO: 18327
  Dockerin_dom

SEQ ID NO: 20952 - DNA, 96 bp, Neocallimastix californiae; identical to SEQ ID NO: 18328
  Dockerin_dom

SEQ ID NO: 20953 - DNA, 129 bp, Neocallimastix californiae
  Dockerin_dom
ctgttgggtttccgtttacggatatccatgttgtgaaggtaaaattaaagaacatgtctatgccacggataatgatggaaaatggggatatgatttctccaaaaagatatggtgtggtatttcctccta

SEQ ID NO: 20954 - DNA, 120 bp, Neocallimastix californiae
  Dockerin_dom
ctgttggtcccttgaacaaggttacaattgttgtgttggctgtaccaccttcttaaccaccgatgaaggaaattggggtattgaaaatgctgaatggtgtggtataccatcctactgttc

SEQ ID NO: 20955 - DNA, 114 bp, Neocallimastix californiae; identical to SEQ ID NO: 18332
  Dockerin_dom

SEQ ID NO: 20956 - DNA, 102 bp, Neocallimastix californiae
  Dockerin_dom
atataattatccatattgtaagacaacttcttctgttgtctatactgatgattttgaatggggtattgagaatgatgattggtgtattattaaggcaaaatc

SEQ ID NO: 20957 - DNA, 123 bp, Neocallimastix californiae; identical to SEQ ID NO: 18334
  Dockerin_dom

SEQ ID NO: 20958 - DNA, 123 bp, Neocallimastix californiae
  Dockerin_dom
ctgctggtctgaaaagttcaatattccatgttgtaagtctactacttcagtcgaaagatcaacttataatggtgattttggtaaggaaaatggacaatggtgtggtcttggtgaaagtaaaag

SEQ ID NO: 20959 - DNA, 109 bp, Neocallimastix californiae; identical to SEQ ID NO: 18337
  Dockerin_dom

SEQ ID NO: 20960 - DNA, 123 bp, Neocallimastix californiae; identical to SEQ ID NO: 18336
  Dockerin_dom

SEQ ID NO: 20961 - DNA, 120 bp, Neocallimastix californiae
  Dockerin_dom
ttgttggtctgaatcattaggttattcatgttgtcatggctgtaccatttatgaaactgatgatgatggttcttggggttatgaaaatgatagttggtgtggtattcaatcatactgtaa

SEQ ID NO: 20962 - DNA, 123 bp, Neocallimastix californiae; identical to SEQ ID NO: 18338
  Dockerin_dom

SEQ ID NO: 20963 - DNA, 126 bp, Neocallimastix californiae
  Dockerin_dom
taaatgttggtcagaagaattaggatttctatgttgtaaggaaagcaagacgaaggtcaaactagaagatattaatggaaaatggggaaaagagaaaggcaggtggtgtggtattatagaagagtt

SEQ ID NO: 20964 - DNA, 111 bp, Neocallimastix californiae; identical to SEQ ID NO: 15797
  Dockerin_dom

SEQ ID NO: 20965 - DNA, 105 bp, Neocallimastix californiae
  Dockerin_dom
ttacgattgttgtactggttgcaaaccaattgtagctgatgatgaaggcttatggggtgcagaaaatggtgattggtgtttgattgatagtgaaaaatgtcaagg

SEQ ID NO: 20966 - DNA, 99 bp, Neocallimastix californiae
  Dockerin_dom
caaagtatgtaaaggttgcgaagtagttgtcactgatatagaaggtgcatggggtgcagaaaatggtgaatggtgttacattgatgaaatcatatgtga

SEQ ID NO: 20967 - DNA, 123 bp, Neocallimastix californiae; identical to SEQ ID NO: 18344
  Dockerin_dom

SEQ ID NO: 20968 - DNA, 126 bp, Neocallimastix californiae
  Dockerin_dom
atgttggtcagaaatattaggatatccatgttgtaaaggatgtaaaatctatgaaactgactcagatggatcctggggatatgaatttaatcaatggtgtggtattatttcatcccgctgtcaaaa

SEQ ID NO: 20969 - DNA, 126 bp, Neocallimastix californiae; identical to SEQ ID NO: 18347
  Dockerin_dom

SEQ ID NO: 20970 - DNA, 100 bp, Neocallimastix californiae
  Dockerin_dom
cgcctatccatgctgtagccattgtaacgtctcaatttcagaagaatatatccgttggggtattgaaaatggtgactggtgtatgattaatttttcatgt

SEQ ID NO: 20971 - DNA, 123 bp, Neocallimastix californiae
  Dockerin_dom
ttgttgggcatttgctgatggttatgagtgttgtaagaataccaaaaatattcaatatattaataaagacggtaactcatttggttttgaaaatggcgtcatttgtgcacttcgaaaggaaga

SEQ ID NO: 20972 - DNA, 111 bp, Neocallimastix californiae
  Dockerin_dom
atcaaaaaaattcccatgttgtagtagtaataatgtaaaagttgctggaaaagatatggatggttcatggggatatgagaatggtgtaaaatgtggtattagaagtcaacg

SEQ ID NO: 20973 - DNA, 117 bp, Neocallimastix californiae; identical to SEQ ID NO: 18351
  Dockerin_dom

SEQ ID NO: 20974 - DNA, 126 bp, Neocallimastix californiae
  Dockerin_dom
ttgttggtcggtatcattaggttatccatgctgcagtgaagataatcaaggtatttacttaattgatgaaaatggatcatggggtttggaaaacaatgactggtgtggtattatagataaacaaaa

SEQ ID NO: 20975 - DNA, 120 bp, Neocallimastix californiae; identical to SEQ ID NO: 18348
  Dockerin_dom

SEQ ID NO: 20976 - DNA, 109 bp, Neocallimastix californiae; identical to SEQ ID NO: 18352
  Dockerin_dom

SEQ ID NO: 20977 - DNA, 117 bp, Neocallimastix californiae; identical to SEQ ID NO: 18353
  Dockerin_dom

SEQ ID NO: 20978 - DNA, 117 bp, Neocallimastix californiae
  Dockerin_dom
ttgttggtccaaaaaattaggttacccttgttgtaatggatgtaaaatttatgaaagtgatttggatggtttatggggatatgaaaaacatcaatggtgtggtattcaaccttactg

SEQ ID NO: 20979 - DNA, 120 bp, Neocallimastix californiae
  Dockerin_dom
ttgtatggcagaattattaggttatatttgttgtcctactactattactatcgtctatgatcatgatgaatacggtgattggggttatgattttgcaaaaaaggaatggtgtggattaac

SEQ ID NO: 20980 - DNA, 120 bp, Neocallimastix californiae; identical to SEQ ID NO: 20979
  Dockerin_dom

SEQ ID NO: 20981 - DNA, 117 bp, Neocallimastix californiae; identical to SEQ ID NO: 20978
  Dockerin_dom

SEQ ID NO: 20982 - DNA, 126 bp, Neocallimastix californiae; identical to SEQ ID NO: 18359
  Dockerin_dom

SEQ ID NO: 20983 - DNA, 115 bp, Neocallimastix californiae
  Dockerin_dom
ctggtcagaatccgtcggttacccttgttgtacaggatgtgaagtggtagaagttgaagatgataaaaaatggggagtagaatctaatgaatggtgtggtattccaacctcttgt

SEQ ID NO: 20984 - DNA, 120 bp, Neocallimastix californiae; identical to SEQ ID NO: 18361
  Dockerin_dom

SEQ ID NO: 20985 - DNA, 126 bp, Neocallimastix californiae
  Dockerin_dom
ttgttgggcaaataaattaagttatagatgttgctcaacaagtgatgctgatgttgtatttaaagacggtagtggtgaatgggctattgaaaacggtgactggtgtggaattataaaagaagaatc

SEQ ID NO: 20986 - DNA, 48 bp, Neocallimastix californiae
  Dockerin_dom
atggggtgttgaaggagatgactggtgtggtattccaactagttgtga

SEQ ID NO: 20987 - DNA, 106 bp, Neocallimastix californiae; identical to SEQ ID NO: 18362
  Dockerin_dom

SEQ ID NO: 20988 - DNA, 106 bp, Neocallimastix californiae; identical to SEQ ID NO: 18362
  Dockerin_dom

SEQ ID NO: 20989 - DNA, 102 bp, Neocallimastix californiae
  Dockerin_dom
aaatggttatggtagttgttctcttcaaaccaaaataattgcagtagataatgatggaatttggggtatagaaaataataaatggtgtgctatcctttcaga

SEQ ID NO: 20990 - DNA, 114 bp, Neocallimastix californiae; identical to SEQ ID NO: 15819
  Dockerin_dom

SEQ ID NO: 20991 - DNA, 126 bp, Neocallimastix californiae; identical to SEQ ID NO: 18367
  Dockerin_dom

SEQ ID NO: 20992 - DNA, 96 bp, Neocallimastix californiae
  Dockerin_dom
tccatgttgtgaaggttgtaaaaccgcatatagagataacaatggtaaatggggatatgaaaataataattggtgttccataaaatattcctgtaa

SEQ ID NO: 20993 - DNA, 126 bp, Neocallimastix californiae; identical to SEQ ID NO: 18368
  Dockerin_dom

SEQ ID NO: 20994 - DNA, 123 bp, Neocallimastix californiae; identical to SEQ ID NO: 18369
  Dockerin_dom

SEQ ID NO: 20995 - DNA, 117 bp, Neocallimastix californiae; identical to SEQ ID NO: 18370
  Dockerin_dom

SEQ ID NO: 20996 - DNA, 120 bp, Neocallimastix californiae
  Dockerin_dom
cagctgctggtcagaaattttaggctatttatgttgttcagaatgtattaaagtagttgaagttgattctaatggtaaatggggtatagaaaataatcattggtgtggtattccaacatt

SEQ ID NO: 20997 - DNA, 123 bp, Neocallimastix californiae; identical to SEQ ID NO: 18371
  Dockerin_dom

SEQ ID NO: 20998 - DNA, 117 bp, Neocallimastix californiae
  Dockerin_dom
acatgctactaaattaggatataaatgttgtaaaagttgtacgatctatttaaatgatagcaccggtaaatggggtgtagaaaataatcaatggtgtggtattgatacttcttgcag

SEQ ID NO: 20999 - DNA, 129 bp, Neocallimastix californiae
  Dockerin_dom
tacatgttgggccgcttcacaaggttataaatgttgtaatagttgtcaacctgtttatactgatggttcaagaagatggggtgttgaaaataatcaatggtgtggtatcatcgaaagtaaatgtaagac

SEQ ID NO: 21000 - DNA, 123 bp, Neocallimastix californiae
  Dockerin_dom
ctgttgggctgcctctgaaggttataagtgttgtaaagctggtaccgcagttgttcttacagatagtaagggtaaatggggtattgaaaacaatcaatggtgtggtattgttcaatcaaatac

SEQ ID NO: 21001 - DNA, 123 bp, Neocallimastix californiae
  Dockerin_dom
ctgtttctccttaaagttaggttatccatgttgttctaatgctagcactccatctgtctatgaagattctgatggtaaatggggtgttgaaaatggtaactggtgtggtattccagaacaagt

SEQ ID NO: 21002 - DNA, 111 bp, Neocallimastix californiae
  Dockerin_dom
ttggtctgaaaaattaggatatccatgttgtacttctactagtgtttctgtctttgaagataatgatggtaaatggggtattgaaaacggtaactggtgtggtattattaa

SEQ ID NO: 21003 - DNA, 126 bp, Neocallimastix californiae
  Dockerin_dom
atgttatgctgaattactgaactatccttgctgttcatccagtataactgaagtctttgcacatgataatttgggggattggggttatgattttgaaaaaaagacatggtgtggacttacctctta

SEQ ID NO: 21004 - DNA, 117 bp, Neocallimastix californiae
  Dockerin_dom
ttggtccgaaaagtttggatattcttgctgtaaaaaatgtgttgtatatgaaacagataataatggtaaatggggttatgagaataatcattggtgtggtattccatcctattgtaa

SEQ ID NO: 21005 - DNA, 111 bp, Neocallimastix californiae
  Dockerin_dom
tttctcagaagctcttggttacccctgttgtaccaataattcacgagtatattttataggtgaaagcggttcctggggaattcaagatgatcaatggtgtggtattatcgg

SEQ ID NO: 21006 - DNA, 120 bp, Neocallimastix californiae; identical to SEQ ID NO: 18382
  Dockerin_dom

SEQ ID NO: 21007 - DNA, 109 bp, Neocallimastix californiae; identical to SEQ ID NO: 18380
  Dockerin_dom

SEQ ID NO: 21008 - DNA, 120 bp, Neocallimastix californiae
  Dockerin_dom
ttgtttctctcaggctttaggatatccatgttgttctaatccgaatacatcggtgaaagcaactgataaggatggagaatggggtatagaaaataatgcatggtgtggtatcaatgacat

SEQ ID NO: 21009 - DNA, 120 bp, Neocallimastix californiae
  Dockerin_dom
gtgtaaagctgctataaagggttattcctgttgtagtcaatgtaaagtgaaatataccgacaatgatggcgattggggagtagaaaataatcaatggtgttccattccatatacctgtaa

SEQ ID NO: 21010 - DNA, 114 bp, Neocallimastix californiae
  Dockerin_dom
ttgctgggctgaaaaattaggttactcttgctgtacttctacttctcaagttgtttacactgatggtgatggtaactggggtgttgaaaacggtaactggtgtggtattattac

SEQ ID NO: 21011 - DNA, 117 bp, Neocallimastix californiae; identical to SEQ ID NO: 18385
  Dockerin_dom

SEQ ID NO: 21012 - DNA, 114 bp, Neocallimastix californiae
  Dockerin_dom
ttgctgggctgaaaaattaggttactcttgctgtacttctacttctcaagttgtttacactgatggtgatggtaactggggtgttgaaaacggtaactggtgtggtattactac

SEQ ID NO: 21013 - DNA, 117 bp, Neocallimastix californiae; identical to SEQ ID NO: 18388
  Dockerin_dom

SEQ ID NO: 21014 - DNA, 120 bp, Neocallimastix californiae
  Dockerin_dom
atgctggtctaaaaaattaggttatccatgttgtaagggatgtaaattatattctactgatgatgatggttcatggggttatgaatctaatcaatggtgtggtattcaatctttctgtaa

SEQ ID NO: 21015 - DNA, 129 bp, Neocallimastix californiae; identical to SEQ ID NO: 18391
  Dockerin_dom

SEQ ID NO: 21016 - DNA, 126 bp, Neocallimastix californiae
  Dockerin_dom
ttcttgttggtctgaattaataggctatccatgttgttcttcagaaaatacaacagtttatcaacaagatgaatacggtgattggggttacgattttactaaacaagaatggtgtggtatttcgta

SEQ ID NO: 21017 - DNA, 120 bp, Neocallimastix californiae; identical to SEQ ID NO: 18393
  Dockerin_dom

SEQ ID NO: 21018 - DNA, 120 bp, Neocallimastix californiae; identical to SEQ ID NO: 18392
  Dockerin_dom

SEQ ID NO: 21019 - DNA, 96 bp, Neocallimastix californiae
  Dockerin_dom
tccttgttgtaaaggttgtaatgtagtagaagaagatgcttctggtaaatggggtattgaaaataattattggtgtgctattaaagactcatgtgg

SEQ ID NO: 21020 - DNA, 99 bp, Neocallimastix californiae
  Dockerin_dom
ctattcaaattgttatggttgccaagtagttactgaagaagatggttataaatggggtgttgaaaacaatgattggtgtataattaatggaaattgtga

SEQ ID NO: 21021 - DNA, 123 bp, Neocallimastix californiae
  Dockerin_dom
atgtttttcagttcatttaggtttcccttgttgtcaaaatacacaggaaattatttattctgataacgatggtgattggggtgttgaaaataatagttggtgtggaataaagaatgaacagaa

SEQ ID NO: 21022 - DNA, 117 bp, Neocallimastix californiae
  Dockerin_dom
ctgctggtctgaacctgattatccatgctgtaaaaacacttgcaatgttattcttaatgatggttcagaatggggttccgaaaatggtgaatggtgtggtattccatcttcttgtag

SEQ ID NO: 21023 - DNA, 100 bp, Neocallimastix californiae
  Dockerin_dom
ttatccatgctgttcatcttgtaacgtcatcttagttgaagacgacggtagccgttggggtgttcaagataataactggtgcagtattaaaaataattgt

SEQ ID NO: 21024 - DNA, 123 bp, Neocallimastix californiae
  Dockerin_dom
atgttggtctgaaccattaggttacccatgttgttccgaatgtggttattcttactacagtgactccgatggtgaatggggtgttgaaaacgacgactggtgtggtcttttaccaagttgttt

SEQ ID NO: 21025 - DNA, 117 bp, Neocallimastix californiae
  Dockerin_dom
ttggactgaagaattaggttatccatgttgtcaaacttgccaaatcagtcaattcaaagatgaaagtggtgattggggttacgaaaatgatgattggtgtggtattattgataatcc

SEQ ID NO: 21026 - DNA, 105 bp, Neocallimastix californiae; identical to SEQ ID NO: 18401
  Dockerin_dom

SEQ ID NO: 21027 - DNA, 129 bp, Neocallimastix californiae; identical to SEQ ID NO: 18402
  Dockerin_dom

SEQ ID NO: 21028 - DNA, 127 bp, Neocallimastix californiae
  Dockerin_dom
ttgctggtctactcctcttggttaccaatgttgtccaagtggctgtaaagctgaagtctatgaaaccgatgacaatggcaaatggggttatgaaaatggcaaatggtgtggtgttccaaaagactgt

SEQ ID NO: 21029 - DNA, 93 bp, Neocallimastix californiae
  Dockerin_dom
taattgttgtgaggaatgtaacgtcgtttacaccgactctgaggattggggtattgaaaatggtaagtggtgttctataccttattcttgtaa

SEQ ID NO: 21030 - DNA, 123 bp, Neocallimastix californiae; identical to SEQ ID NO: 18405
  Dockerin_dom

SEQ ID NO: 21031 - DNA, 99 bp, Neocallimastix californiae
  Dockerin_dom
cagtggctataactgttgtctcttcagtacctccgttataacgaccgataatgtgggaaaatggggtattgaaaatgatgaatggtgtctcttcgaaag

SEQ ID NO: 21032 - DNA, 99 bp, Neocallimastix californiae
  Dockerin_dom
cagtggctataactgttgtctcttcagtacctccgttataacgaccgataaagtgggtcagtggggtattgaaaatgatgaatggtgtctcttcgaaag

SEQ ID NO: 21033 - DNA, 93 bp, Neocallimastix californiae
  Dockerin_dom
taattgttgtaaggaatgtaacgtcgtttacaccgactcagaagattggggtattgaagatggtaagtggtgttctatccctcattcctgtaa

SEQ ID NO: 21034 - DNA, 123 bp, Neocallimastix californiae; identical to SEQ ID NO: 18409
  Dockerin_dom

SEQ ID NO: 21035 - DNA, 105 bp, Neocallimastix californiae
  Dockerin_dom
cagtggttataattgttgcctcttcacaactacagttgaaacaacagattctgtgggtgactggggtattgaaaatggtgattggtgtctcttcgaaagtagtgc

SEQ ID NO: 21036 - DNA, 93 bp, Neocallimastix californiae; identical to SEQ ID NO: 18410
  Dockerin_dom

SEQ ID NO: 21037 - DNA, 123 bp, Neocallimastix californiae; identical to SEQ ID NO: 18411
  Dockerin_dom

SEQ ID NO: 21038 - DNA, 111 bp, Neocallimastix californiae
  Dockerin_dom
ttggtctgaaaaattaggttacccatgttgtacaagtggtgctcaagtttattacactgatgctgatggtcaatggggtgttgaaaacaataactggtgtggtattattgc

SEQ ID NO: 21039 - DNA, 120 bp, Neocallimastix californiae
  Dockerin_dom
ttgtttcgccaccaaattaggttacccatgttgtactactactactgaagttgtttttactgataatgatggtaaatggggtgttgaaaacaataactggtgtggtatggctgatgaatg

SEQ ID NO: 21040 - DNA, 120 bp, Neocallimastix californiae; identical to SEQ ID NO: 18416
  Dockerin_dom

SEQ ID NO: 21041 - DNA, 120 bp, Neocallimastix californiae; identical to SEQ ID NO: 18415
  Dockerin_dom

SEQ ID NO: 21042 - DNA, 117 bp, Neocallimastix californiae
  Dockerin_dom
ttgtttctctactagattaggttatccttgttgttcaggaaataccgtcgcttatacagataatgatggtgattggggtgttgaaaatggtaattggtgtggtattggaaatacttc

SEQ ID NO: 21043 - DNA, 120 bp, Neocallimastix californiae; identical to SEQ ID NO: 18418
  Dockerin_dom

SEQ ID NO: 21044 - DNA, 66 bp, Neocallimastix californiae; identical to SEQ ID NO: 18419
  Dockerin_dom

SEQ ID NO: 21045 - DNA, 123 bp, Neocallimastix californiae; identical to SEQ ID NO: 18420
  Dockerin_dom

SEQ ID NO: 21046 - DNA, 120 bp, Neocallimastix californiae
  Dockerin_dom
atgttggtctgaaagtttgaattatccatgttgtgataattgtgttgtctatgaagtcgatgataatggcaaatggggttatgatttccaaactcaaacctggtgtggtagtccatcata

SEQ ID NO: 21047 - DNA, 120 bp, Neocallimastix californiae; identical to SEQ ID NO: 18423
  Dockerin_dom

SEQ ID NO: 21048 - DNA, 114 bp, Neocallimastix californiae; identical to SEQ ID NO: 18422
  Dockerin_dom

SEQ ID NO: 21049 - DNA, 123 bp, Neocallimastix californiae
  Dockerin_dom
atgttggtctgaagctttaggttacccatgttgttctgaatgcataaatgcctacgctgaagatgctgatggcaaatggggtattgaaaatgataactggtgtggtcttttatcacattgtat

SEQ ID NO: 21050 - DNA, 108 bp, Neocallimastix californiae; identical to SEQ ID NO: 18425
  Dockerin_dom

SEQ ID NO: 21051 - DNA, 114 bp, Neocallimastix californiae; identical to SEQ ID NO: 18426
  Dockerin_dom

SEQ ID NO: 21052 - DNA, 100 bp, Neocallimastix californiae
  Dockerin_dom
aggttatgaatgttgcgaaggttgtacagttgaatatgaagaaaacaatataaaatggggttacgaaaatagaaattggtgtgttataccctattcatgt

SEQ ID NO: 21053 - DNA, 123 bp, Neocallimastix californiae
  Dockerin_dom
ttggtctaaaggtctttttaaaattccatgttgtaaaaaaactgatgtagtcgttcgtaccacatatgatggtgaatggggtcaagaagataacggaaaatggtgtagtctcagtaaaaaaag

SEQ ID NO: 21054 - DNA, 129 bp, Neocallimastix californiae
  Dockerin_dom
ttgttggtcagaaattttaggttacagttgttgcaaaaaaacctgtaaaacaaaatattcagataaacatggtaattggggtgttgaaaataaacagtggtgtggtattattgatgagaaatgcaaaaa

SEQ ID NO: 21055 - DNA, 102 bp, Neocallimastix californiae
  Dockerin_dom
tgaatattcatgttgtgaaaaatgtaaggttcgttactctgacaagcatggtgattggggtatcgaaaataaagagtggtgttccataaaatatacttgtaa

SEQ ID NO: 21056 - DNA, 129 bp, Neocallimastix californiae
  Dockerin_dom
ttgttggtcagaaattttaggttatagttgttgcaaagaaacctgtaagacaaaatatactgataagcatggtaattggggtgttgaaaataaacaatggtgtggtattattgatgagaaatgtaaaaa

SEQ ID NO: 21057 - DNA, 123 bp, Neocallimastix californiae; identical to SEQ ID NO: 18432
  Dockerin_dom

SEQ ID NO: 21058 - DNA, 90 bp, Neocallimastix californiae; identical to SEQ ID NO: 15887
  Dockerin_dom

SEQ ID NO: 21059 - DNA, 120 bp, Neocallimastix californiae; identical to SEQ ID NO: 18433
  Dockerin_dom

SEQ ID NO: 21060 - DNA, 114 bp, Neocallimastix californiae; identical to SEQ ID NO: 18434
  Dockerin_dom

SEQ ID NO: 21061 - DNA, 123 bp, Neocallimastix californiae; identical to SEQ ID NO: 18435
  Dockerin_dom

SEQ ID NO: 21062 - DNA, 112 bp, Neocallimastix californiae; identical to SEQ ID NO: 15891
  Dockerin_dom

SEQ ID NO: 21063 - DNA, 117 bp, Neocallimastix californiae; identical to SEQ ID NO: 18438
  Dockerin_dom

SEQ ID NO: 21064 - DNA, 102 bp, Neocallimastix californiae
  Dockerin_dom
caaatgttgcagtagtagtgatgctgaagtatggtatgttgatgatgatggaaattggggtgttgaaaatggagaatggtgcttcatagacactgaaaaatc

SEQ ID NO: 21065 - DNA, 117 bp, Neocallimastix californiae
  Dockerin_dom
atgtttatctgaaataattggttattcatgctgtccattaggttatgaaaatatttatcatgataattatggtgactggggttatgattttgaaaatgatacatggtgtggtcttac

SEQ ID NO: 21066 - DNA, 120 bp, Neocallimastix californiae
  Dockerin_dom
atgttggtctgagccattaggttatccttgttgtcagaaatgttcaattattgaaaccaatgaaagtggttcatggggatttgaattaaatcaatggtgtggtattcctacttattgcca

SEQ ID NO: 21067 - DNA, 123 bp, Neocallimastix californiae; identical to SEQ ID NO: 18443
  Dockerin_dom

SEQ ID NO: 21068 - DNA, 102 bp, Neocallimastix californiae
  Dockerin_dom
cagtggctacaactgttgtctcttcaccaccaaagtagaaacgagtgatacggtgggggactggggtatcgaaaacaatgaatggtgtctcttcgaaagtag

SEQ ID NO: 21069 - DNA, 93 bp, Neocallimastix californiae; identical to SEQ ID NO: 18441
  Dockerin_dom

SEQ ID NO: 21070 - DNA, 123 bp, Neocallimastix californiae
  Dockerin_dom
tagctgttggtctacttccttaggtttcccatgttgtagtggtaattctattgtttatttcactgattccaatggtcaatggggtattgaaaatgaccaatggtgtggtaagccaaattctaa

SEQ ID NO: 21071 - DNA, 123 bp, Neocallimastix californiae; identical to SEQ ID NO: 18445
  Dockerin_dom

SEQ ID NO: 21072 - DNA, 126 bp, Neocallimastix californiae; identical to SEQ ID NO: 18447
  Dockerin_dom

SEQ ID NO: 21073 - DNA, 121 bp, Neocallimastix californiae
  Dockerin_dom
ttgtattggtgcacaaggttacccatgttgtaagactacctgttccgtcttctctactgatagtgatggtaaatggggtattgaaaacgacaattggtgtttaattgatagttctaaatgc

SEQ ID NO: 21074 - DNA, 111 bp, Neocallimastix californiae
  Dockerin_dom
ttggtctgaaagatttaatattccttgttgtaaatcaactaatactgtcgtaagatcaacttatgatggtgaatggggaatggaaaatggtgaatggtgtggtcttggttt

SEQ ID NO: 21075 - DNA, 117 bp, Neocallimastix californiae
  Dockerin_dom
ttctcaaaagattattgcccaaggttacaaatgttgcgctgattcaaattgtactgtttactacactgatgccgatggtacctggggtgttgaaaatggtgaatggtgtggttgtgg

SEQ ID NO: 21076 - DNA, 126 bp, Neocallimastix californiae
  Dockerin_dom
ttcttcaaagattactgctcaaggttataagtgctgttctgatccaaactgtgttgtttactacactgatgctgatggtacttggggtgttgaaaacggccaatggtgtggttgtggcagtagtgc

SEQ ID NO: 21077 - DNA, 120 bp, Neocallimastix californiae; identical to SEQ ID NO: 18451
  Dockerin_dom

SEQ ID NO: 21078 - DNA, 102 bp, Neocallimastix californiae; identical to SEQ ID NO: 18452
  Dockerin_dom

SEQ ID NO: 21079 - DNA, 120 bp, Neocallimastix californiae
  Dockerin_dom
tacttgctgggcccaagctcaaggatatcaatgttgtacttctacctccgaagttgttttcactgatgaaagtggtgattggggtgtagaaaacggtgaatggtgtggaattaaaaattg

SEQ ID NO: 21080 - DNA, 108 bp, Neocallimastix californiae; identical to SEQ ID NO: 18454
  Dockerin_dom

SEQ ID NO: 21081 - DNA, 102 bp, Neocallimastix californiae; identical to SEQ ID NO: 18452
  Dockerin_dom

SEQ ID NO: 21082 - DNA, 120 bp, Neocallimastix californiae; identical to SEQ ID NO: 21079
  Dockerin_dom

SEQ ID NO: 21083 - DNA, 108 bp, Neocallimastix californiae; identical to SEQ ID NO: 18454
  Dockerin_dom

SEQ ID NO: 21084 - DNA, 123 bp, Neocallimastix californiae
  Dockerin_dom
ttgctggtctgttaagttaggttacccatgttgtgaagtttctaatgccatttactctgttgatgacaatggtagttggggtgttgaagatgatttctggtgtggtatcgttgaagataagga

SEQ ID NO: 21085 - DNA, 126 bp, Neocallimastix californiae
  Dockerin_dom
atgctggtctgattcattaggatacccatgttgtagttccgctgatattcaagttgtatctgaagattcttctggaaaatggggtattgaaaataacaactggtgtggtattccaaaggaaacttg

SEQ ID NO: 21086 - DNA, 117 bp, Neocallimastix californiae
  Dockerin_dom
ttgggctgaagcacttggatattcatgttgtccaagtggtactccagttagttacactgatgcttcaggtgattggggttacgttaatgattggtgtggtattgttaaatccacaaa

SEQ ID NO: 21087 - DNA, 120 bp, Neocallimastix californiae
  Dockerin_dom
gtgctggtctgaaccagattacccatgttgtaaattatcttctactagagtagaatacactgatgcaagtggtagttggggtattgaaaatggtaactggtgtggtattgtaaagtcttc

SEQ ID NO: 21088 - DNA, 99 bp, Neocallimastix californiae
  Dockerin_dom
ttatgatgaatgtaaagcatgtaatgttgtttatgttgaaggtgatgaaaaatggggtgttgaaaacaatgactggtgtataattccatccaagtgtga

SEQ ID NO: 21089 - DNA, 96 bp, Neocallimastix californiae; identical to SEQ ID NO: 18462
  Dockerin_dom

SEQ ID NO: 21090 - DNA, 120 bp, Neocallimastix californiae
  Dockerin_dom
tcaatgctgggctgaggcttatggttattcatgttgtactaaatgtgtatccgtagtagatatatctaataatagaaaatggggtatagaaaataatagatggtgtggtattccatcata

SEQ ID NO: 21091 - DNA, 99 bp, Neocallimastix californiae
  Dockerin_dom
aaaatataaatgttgtgattcctgtaaagtttctgtggatgatggtaataaatggggtatacttaatggtgaatggtgtagtataacctatgattgtct

SEQ ID NO: 21092 - DNA, 117 bp, Neocallimastix californiae
  Dockerin_dom
ttctgcttctatcattgctcaaggttacaagtgctgttccgctaactgtgaagttgtttatactgataatgatggtgattggggtgttgaaaacaacgaatggtgtggttgtggtgg

SEQ ID NO: 21093 - DNA, 121 bp, Neocallimastix californiae
  Dockerin_dom
atctgctattaccgctcaaggttacaagtgctgctcttcctgtggtaccgtttactacaccgatggtgatggtgaatggggtgttgaaaacggtgactggtgtggaatgccaaccaactgt

SEQ ID NO: 21094 - DNA, 114 bp, Neocallimastix californiae; identical to SEQ ID NO: 18468
  Dockerin_dom

SEQ ID NO: 21095 - DNA, 118 bp, Neocallimastix californiae
  Dockerin_dom
ttgttggtctagttccttaagctatggatgctgttctggatgtaaagttctctataccgataaagatggtaaatggggaatagaaaatggtgattggtgtggtattccaaaaaattgt

SEQ ID NO: 21096 - DNA, 118 bp, Neocallimastix californiae
  Dockerin_dom
atgtccaggtaagaaatatggatatccatgttgtgaaagctgtgatgtcttcttagaagatgaaagtggtatttggggagctgaaaatggtcaatggtgcagtattaagaccagctgt

SEQ ID NO: 21097 - DNA, 123 bp, Neocallimastix californiae
  Dockerin_dom
atgttggtctgaagctttcggatataaatgctgttctgctggatgtaattcagtagttgttgttattgatgaaagtggttactggagtgctgaaaacggtgaatggtgtggtattccagaatg

SEQ ID NO: 21098 - DNA, 126 bp, Neocallimastix californiae; identical to SEQ ID NO: 18472
  Dockerin_dom

SEQ ID NO: 21099 - DNA, 99 bp, Neocallimastix californiae
  Dockerin_dom
cccatgttgtagtggatgtgatgttatttacactgatactgatggtgaatggggtgttgaaaactatgactggtgtttcattgacagcaatcgttgtca

SEQ ID NO: 21100 - DNA, 126 bp, Neocallimastix californiae
  Dockerin_dom
ctcatctactattaaaagtcaaggttatgcatgctgtagatcatgcgatattatttattctgatgagagtggtgattggggaattgaaaatagttattggtgtggaatttctaattcatgtaagaa

SEQ ID NO: 21101 - DNA, 123 bp, Neocallimastix californiae
  Dockerin_dom
ctcagctaatattaaaaaacaaggttattcatgctgttcaagctgtattatatattttactgataatgatggcaaatggggtgttgaaaatggaaaatggtgtggtattcaagaatattgtga

SEQ ID NO: 21102 - DNA, 126 bp, Neocallimastix californiae; identical to SEQ ID NO: 21100
  Dockerin_dom

SEQ ID NO: 21103 - DNA, 123 bp, Neocallimastix californiae; identical to SEQ ID NO: 21101
  Dockerin_dom

SEQ ID NO: 21104 - DNA, 118 bp, Neocallimastix californiae
  Dockerin_dom
ttgtactggaatgaatttaggttacccatgttgtgatgattgtaatgtcgtttacacggatcatgatggtaaatggggtgttcaaaatgatgattggtgtggtatcaagagtacttgt

SEQ ID NO: 21105 - DNA, 117 bp, Neocallimastix californiae
  Dockerin_dom
ttgtaaatttactcaacttggttatccatgttgtgataatccaaagactgtttccgtttataccgatgaatctggtgattggggtattgaaaatggtgattggtgtggtattgacct

SEQ ID NO: 21106 - DNA, 105 bp, Neocallimastix californiae
  Dockerin_dom
tccatgttgtaaaaattgtgaagttatttacaccgatgaagatgatggtactcaatatggtcttgataagatagaatggtgtattatcgataaaactgtatgtaa

SEQ ID NO: 21107 - DNA, 102 bp, Neocallimastix californiae
  Dockerin_dom
ttataaatggtgttctgatccaaatactaaaagatatccatataatgatgaagatttttggggtgttgaaaatggtaattggtgtgttattaaaaataatac

SEQ ID NO: 21108 - DNA, 123 bp, Neocallimastix californiae
  Dockerin_dom
gtgttggtcagaaccattaggttacccatgttgtactggtaataccaaaactgaatatactgataaagatggggaatggggattacaaaatggtgattggtgtggtatcaatgaagataacac

SEQ ID NO: 21109 - DNA, 111 bp, Neocallimastix californiae; identical to SEQ ID NO: 18483
  Dockerin_dom

SEQ ID NO: 21110 - DNA, 96 bp, Neocallimastix californiae
  Dockerin_dom
atgttgtagtagtgacaatgtaaaagttattggaaagcatatggatggaacatggggagaagaaaatggtaaaaaatgtggtattagaaataaacg

SEQ ID NO: 21111 - DNA, 120 bp, Neocallimastix californiae; identical to SEQ ID NO: 18482
  Dockerin_dom

SEQ ID NO: 21112 - DNA, 120 bp, Neocallimastix californiae; identical to SEQ ID NO: 18485
  Dockerin_dom

SEQ ID NO: 21113 - DNA, 123 bp, Neocallimastix californiae; identical to SEQ ID NO: 18481
  Dockerin_dom

SEQ ID NO: 21114 - DNA, 111 bp, Neocallimastix californiae
  Dockerin_dom
ttggtctgcaaaatttggttatccttgctgtaaggaaactactgttgtagaagctgttgatgaaaatggcagatggggattagaaaatggtggaagatgtggttttatcga

SEQ ID NO: 21115 - DNA, 94 bp, Neocallimastix californiae
  Dockerin_dom
taaatgctgggcagaagcctacggatattcatgctgtagtgaatgtgtatctgtactagataaatcttataataaaaaatggggtatagaaaat

SEQ ID NO: 21116 - DNA, 93 bp, Neocallimastix californiae
  Dockerin_dom
taaatgttgcgaatcttgcaatgtttcctacgatgatggaaataaatggggtgtattaaatggagaatggtgtagtttaacctatgaatgtct

SEQ ID NO: 21117 - DNA, 102 bp, Neocallimastix californiae
  Dockerin_dom
ttacccatgctgtgaaaatacttgtgctgttcaatatactgacgctgatggtcaatggggtattgaaaatggtgaatggtgtagtatttctaagagtgaaaa

SEQ ID NO: 21118 - DNA, 117 bp, Neocallimastix californiae; identical to SEQ ID NO: 18488
  Dockerin_dom

SEQ ID NO: 21119 - DNA, 96 bp, Neocallimastix californiae
  Dockerin_dom
tttaggttatccatgttgtaaatctacatgtaatgtttactcatctgatgaaagtggtcaatggggtattgaagataacaactggtgtttaattga

SEQ ID NO: 21120 - DNA, 123 bp, Neocallimastix californiae; identical to SEQ ID NO: 18490
  Dockerin_dom

SEQ ID NO: 21121 - DNA, 96 bp, Neocallimastix californiae
  Dockerin_dom
catatgttgtgaaggttgtaatgtaatagaagaaacagctgaaggtaaatggggtattgaaaagaaccaatggtgtggtatcaaaagttcttgttt

SEQ ID NO: 21122 - DNA, 96 bp, Neocallimastix californiae
  Dockerin_dom
atatgaatattgccaaggctgtagagtattttatgaagatgaccaacaatggggtgttgaaaacaatgattggtgtattattccatctaaatgtaa

SEQ ID NO: 21123 - DNA, 87 bp, Neocallimastix californiae
  Dockerin_dom
taaaactggttatccatactgttctttggaaaatattgatattgcatacactcatgaaacgggttcttggggatttgaaaatgacct

SEQ ID NO: 21124 - DNA, 93 bp, Neocallimastix californiae
  Dockerin_dom
cccatgttgtaccaacactaaaactgcggtctacactgataatgccggtaatgaatggggcatggaaaataataactggtgtggtattattcc

SEQ ID NO: 21125 - DNA, 102 bp, Neocallimastix californiae
  Dockerin_dom
ttataactgttgtaaaaattcttgtaatgtcacttacaaggataacgatggtaattgggatgtagagaacggtaactggtgtggtgttcccttctcttgttt

SEQ ID NO: 21126 - DNA, 120 bp, Neocallimastix californiae; identical to SEQ ID NO: 18497
  Dockerin_dom

SEQ ID NO: 21127 - DNA, 93 bp, Neocallimastix californiae
  Dockerin_dom
taaatgttgttcttcctgtgaaattctttatactgacacggaagaatggggtattgaagatggtgaatggtgttccattcctcattcctgtaa

SEQ ID NO: 21128 - DNA, 123 bp, Neocallimastix californiae; identical to SEQ ID NO: 18499
  Dockerin_dom

SEQ ID NO: 21129 - DNA, 105 bp, Neocallimastix californiae
  Dockerin_dom
ctcaggctataattgttgtgtctttgatactactgccgttcaaaccgtggatgttgttggcaaatgggggattgaaaatggagattggtgtctctttgatgaaac

SEQ ID NO: 21130 - DNA, 115 bp, Neocallimastix californiae
  Dockerin_dom
tacttcccaaggttacaagtgttgtaaagaagataactgttcagttattgaaaccgatgatgctggtaaatggggtattgaagatggacaatggtgtggtatttctgacaaatgt

SEQ ID NO: 21131 - DNA, 111 bp, Neocallimastix californiae; identical to SEQ ID NO: 18501
  Dockerin_dom

SEQ ID NO: 21132 - DNA, 117 bp, Neocallimastix californiae
  Dockerin_dom
ttcttatagaattactagtcaaggttataaatgttgttctagaaattgtgttgttgtttactctgatgctgatggtaattggggtgttgaaaatggtgaatggtgtggatgtgctgc

SEQ ID NO: 21133 - DNA, 99 bp, Neocallimastix californiae; identical to SEQ ID NO: 18503
  Dockerin_dom

SEQ ID NO: 21134 - DNA, 120 bp, Neocallimastix californiae; identical to SEQ ID NO: 18506
  Dockerin_dom

SEQ ID NO: 21135 - DNA, 123 bp, Neocallimastix californiae; identical to SEQ ID NO: 18505
  Dockerin_dom

SEQ ID NO: 21136 - DNA, 114 bp, Neocallimastix californiae
  Dockerin_dom
taaatgttttgcaactgctctcggctatccatgctgttctccatatgctaaagaacgtttcagagataaaaatggtagatggggtattgaatatggtgcatggtgtggtttatt

SEQ ID NO: 21137 - DNA, 120 bp, Neocallimastix californiae
  Dockerin_dom
taaatgttttaccattccattgggttatccttgttgtactaaaactaaagaagtaacttatactaatggctatggtacatggggtacagaaaatggagattggtgtggtcttaagcaagc

SEQ ID NO: 21138 - DNA, 120 bp, Neocallimastix californiae
  Dockerin_dom
ttcatgcttttcaaaatctcttggttatccctgttgtacttctaaaaatcctcgtatctatttcagtgatagtaaaggtaattggagttatgaaaatggaaaatggtgtggtgcatcctc

SEQ ID NO: 21139 - DNA, 126 bp, Neocallimastix californiae
  Dockerin_dom
ctggtccaaaacattaggctatgattgttgtaaaaatacatgtaatgttgtttattcagataatgatggagaatggggagttgaaaataatgaatggtgtggtataatacaaagtaattgtaatat

SEQ ID NO: 21140 - DNA, 73 bp, Neocallimastix californiae
  Dockerin_dom
tccatgttgtactcattgtgatatatattatgttgacgaaaatggtaattggggtattgaaaataataactgg

SEQ ID NO: 21141 - DNA, 96 bp, Neocallimastix californiae
  Dockerin_dom
tccatgttgtgaagaatgtaatgtatatgaagaagatgattctggtaaatggggtattgaaaataaccaatggtgtggtattaaagacagttgctt

SEQ ID NO: 21142 - DNA, 105 bp, Neocallimastix californiae
  Dockerin_dom
ctacagtaactgtaatagtacatgtagagttgtaacagttgaagacggtgtcagctggggtgtagaaaataatgactggtgtattattaaaccatctctttgtaa

SEQ ID NO: 21143 - DNA, 126 bp, Neocallimastix californiae
  Dockerin_dom
ttctgaaaagattcaatcccaaggttataagtgttgttctgataagaactgtgctgttgtctacagtgataatgatggtacttggggtgttgaaaatggacaatggtgtggatgtaacaataagac

SEQ ID NO: 21144 - DNA, 93 bp, Neocallimastix californiae; identical to SEQ ID NO: 18515
  Dockerin_dom

SEQ ID NO: 21145 - DNA, 120 bp, Neocallimastix californiae; identical to SEQ ID NO: 18516
  Dockerin_dom

SEQ ID NO: 21146 - DNA, 123 bp, Neocallimastix californiae
  Dockerin_dom
ttgtgttgttaaatctcttggttacccatgttgttcaccaaacaacactgaagtcttctacactgatgaaaatggtgattggggtgttgaaaatggtgactggtgtggtattactaaggctca

SEQ ID NO: 21147 - DNA, 118 bp, Neocallimastix californiae
  Dockerin_dom
ttggtctgaagctttaggttacccatgttgttctacttgttccagtcctgtctacagtgataatgatggtaactggggtattgaaaatggtgactggtgtggtcttttagccagttgt

SEQ ID NO: 21148 - DNA, 123 bp, Neocallimastix californiae; identical to SEQ ID NO: 18519
  Dockerin_dom

SEQ ID NO: 21149 - DNA, 114 bp, Neocallimastix californiae; identical to SEQ ID NO: 18520
  Dockerin_dom

SEQ ID NO: 21150 - DNA, 120 bp, Neocallimastix californiae
  Dockerin_dom
ttgttggtcaatagatttaggttatccatgttgtatagaaaataatgttgttgaagtcaatgaaaatggaaaatggggtattgagaataataactggtgtggtataatcgagaaaaaatc

SEQ ID NO: 21151 - DNA, 123 bp, Neocallimastix californiae
  Dockerin_dom
atgctgggcatcggaatttggttatccatgttgtaaaacgactactgaagtaattgaaaaggatgagcatggaaaatggggttttgaaaataaagagtggtgtggtatagttgatagtaattc

SEQ ID NO: 21152 - DNA, 109 bp, Neocallimastix californiae; identical to SEQ ID NO: 15981
  Dockerin_dom

SEQ ID NO: 21153 - DNA, 120 bp, Neocallimastix californiae; identical to SEQ ID NO: 18525
  Dockerin_dom

SEQ ID NO: 21154 - DNA, 123 bp, Neocallimastix californiae; identical to SEQ ID NO: 18522
  Dockerin_dom

SEQ ID NO: 21155 - DNA, 123 bp, Neocallimastix californiae; identical to SEQ ID NO: 18523
  Dockerin_dom

SEQ ID NO: 21156 - DNA, 81 bp, Neocallimastix californiae
  Dockerin_dom
ttcttgctgtagtagttgtgatgtttattatgttgatgaatttgaatggggtgtggaagatggttcatggtgtttgactcc

SEQ ID NO: 21157 - DNA, 129 bp, Neocallimastix californiae
  Dockerin_dom
ctgttgggctataagtgaaggttatccatgttgtaaaaacaaaaatactcaagttcaagatatatctagtgatggtaggaaatggggttttgaaaatgatgattggtgtggtattatcgaagagaaaga

SEQ ID NO: 21158 - DNA, 102 bp, Neocallimastix californiae
  Dockerin_dom
ttctggatataattgttgtatattaactaaatcagttaaattaatcgataatgttggtcagtggggtgttgaaaatggtgaatggtgtcttttcgaggaaga

SEQ ID NO: 21159 - DNA, 114 bp, Neocallimastix californiae
  Dockerin_dom
tagtaagtttggttattcctgttgtaaaaaggaaaccactgccattttaacaactgatagagatgccgattggggagttgaggatggtaaatggtgtgccataaaagaatattg

SEQ ID NO: 21160 - DNA, 108 bp, Neocallimastix californiae; identical to SEQ ID NO: 15989
  Dockerin_dom

SEQ ID NO: 21161 - DNA, 117 bp, Neocallimastix californiae; identical to SEQ ID NO: 18533
  Dockerin_dom

SEQ ID NO: 21162 - DNA, 99 bp, Neocallimastix californiae; identical to SEQ ID NO: 18532
  Dockerin_dom

SEQ ID NO: 21163 - DNA, 114 bp, Neocallimastix californiae
  Dockerin_dom
ctgttgggccactgctcttggttacaagtgttgtcaatctacttctgttgtagttgaaactgatgctaatggtaagtggggtattgaaaataatgaatggtgtggtattgtcag

SEQ ID NO: 21164 - DNA, 117 bp, Neocallimastix californiae; identical to SEQ ID NO: 18534
  Dockerin_dom

SEQ ID NO: 21165 - DNA, 123 bp, Neocallimastix californiae; identical to SEQ ID NO: 18536
  Dockerin_dom

SEQ ID NO: 21166 - DNA, 93 bp, Neocallimastix californiae
  Dockerin_dom
tccatgttgtaaagaatgtaatgtttattacacggatactgaagattggggtattgaagatggagaatggtgttccattccatatacttgtga

SEQ ID NO: 21167 - DNA, 102 bp, Neocallimastix californiae
  Dockerin_dom
caccggatataattgttgtcttttcactactaccgttgtaactacagattcggttggtgactggggtgttgaaaatgaagattggtgtctctttgaaaataa

SEQ ID NO: 21168 - DNA, 123 bp, Neocallimastix californiae; identical to SEQ ID NO: 18538
  Dockerin_dom

SEQ ID NO: 21169 - DNA, 120 bp, Neocallimastix californiae
  Dockerin_dom
ttctaccgctattattaatcaaggatacaagtgttgttccgatggttgtacagtcatttacattgacagtgatggagattggggagcagaaaatggggaatggtgtggatgtggccaagg

SEQ ID NO: 21170 - DNA, 115 bp, Neocallimastix californiae
  Dockerin_dom
tataactagatatggttataaatgttgttcttcatgctctaaagtttattacactgataaagatggtaaatggggtattgaaaatagagattggtgtggtataccaagtcattgc

SEQ ID NO: 21171 - DNA, 118 bp, Neocallimastix californiae
  Dockerin_dom
atgttggtcaaaggctcaaggttatgattgttgtgctgaaggaacttccgttttccttgaagatgaaagtggaaaatggggtgttactccaaatggtttatggtgtggtattaagaat

SEQ ID NO: 21172 - DNA, 126 bp, Neocallimastix californiae; identical to SEQ ID NO: 18543
  Dockerin_dom

SEQ ID NO: 21173 - DNA, 111 bp, Neocallimastix californiae
  Dockerin_dom
ttttgcattatctgatggttatgaatgttgtttcgataatgaagttgtttatgaagatgaaactggtaaatggggtattaatgacaaaggtgaatggtgtggtgttgaaca

SEQ ID NO: 21174 - DNA, 123 bp, Neocallimastix californiae; identical to SEQ ID NO: 18547
  Dockerin_dom

SEQ ID NO: 21175 - DNA, 90 bp, Neocallimastix californiae
  Dockerin_dom
ttgctgtaaaaattctaatttaaaagtatcttatgttgataataatggctattggggtattgagtctgaatcatggtgcaaaataaattt

SEQ ID NO: 21176 - DNA, 117 bp, Neocallimastix californiae
  Dockerin_dom
atgttggtcagaatcattaggttataaatgctgtagccttgatatagagccgatttttacagataatgatggtatttggggtatggaaaacgaacaatggtgtggcataataaataa

SEQ ID NO: 21177 - DNA, 114 bp, Neocallimastix californiae; identical to SEQ ID NO: 18548
  Dockerin_dom

SEQ ID NO: 21178 - DNA, 120 bp, Neocallimastix californiae; identical to SEQ ID NO: 18550
  Dockerin_dom

SEQ ID NO: 21179 - DNA, 115 bp, Neocallimastix californiae; identical to SEQ ID NO: 18549
  Dockerin_dom

SEQ ID NO: 21180 - DNA, 120 bp, Neocallimastix californiae
  Dockerin_dom
ttgttggtccactagattaggttacccatgttgtgaagatagtaatgttgtttacgctgttgatgaaaatggtatttggggttatgaaaataaacattggtgtggtattactaaggccaa

SEQ ID NO: 21181 - DNA, 85 bp, Neocallimastix californiae; identical to SEQ ID NO: 16014
  Dockerin_dom

SEQ ID NO: 21182 - DNA, 120 bp, Neocallimastix californiae; identical to SEQ ID NO: 18552
  Dockerin_dom

SEQ ID NO: 21183 - DNA, 126 bp, Neocallimastix californiae
  Dockerin_dom
ttcctgtttttccgttgcactcggttttccatgttgttcatcaagtgctactgaagtgttcagagatagttatggtagttggggtgttgaatatggtgaatggtgtggtatgtccaaagcaaaaac

SEQ ID NO: 21184 - DNA, 120 bp, Neocallimastix californiae
  Dockerin_dom
ttgtttttctattccactgggatatccttgttgtacttccacaaaagaagttattgatacaaatgaatatggtacttggggtatagaaaatggtgattggtgtggactaaaaaaagcctc

SEQ ID NO: 21185 - DNA, 120 bp, Neocallimastix californiae
  Dockerin_dom
atgcttttcaaaatctcttggtttcccgtgttgttcctccaaaaataaagatatttatttcactgatgaaaaaggtaattggggtattgaaaacggtgaatggtgtggtatatcagcagc

SEQ ID NO: 21186 - DNA, 123 bp, Neocallimastix californiae
  Dockerin_dom
ttgcttttctagtgctctcggtattccctgttgttcttccaaaaatgcagaaatctattacagtgacattaaaggtaattggggtattgaaaatggagactggtgtggtatatcagcagcaaa

SEQ ID NO: 21187 - DNA, 129 bp, Neocallimastix californiae; identical to SEQ ID NO: 18557
  Dockerin_dom

SEQ ID NO: 21188 - DNA, 73 bp, Neocallimastix californiae
  Dockerin_dom
aggatatacttgttgtaaaggatgtgatgtaatatatactgatgactttaaatggggttttgaagctggtgac

SEQ ID NO: 21189 - DNA, 99 bp, Neocallimastix californiae
  Dockerin_dom
tggttatgcttgttgtatattcaagaatactatagttgaaactgttgatgagagtggccaatggggacatgaaggaaatgattggtgcctaatgaactt

SEQ ID NO: 21190 - DNA, 78 bp, Neocallimastix californiae; identical to SEQ ID NO: 18560
  Dockerin_dom

SEQ ID NO: 21191 - DNA, 120 bp, Neocallimastix californiae; identical to SEQ ID NO: 18559
  Dockerin_dom

SEQ ID NO: 21192 - DNA, 120 bp, Neocallimastix californiae
  Dockerin_dom
ctggtctaaaacttatggttacccatgttgttcctctgccagtactaaggttatgtacaccgataacgatggtgaatggggtgttgaaaacggtaactggtgtggtattgtaaaggatga

SEQ ID NO: 21193 - DNA, 120 bp, Neocallimastix californiae
  Dockerin_dom
ctgtttctcttatactttaggttacccatgttgtactagtaccactaatgttatctacactgatagctacggtcgctggggtattgaaaagggtaattggtgttttcttggtgattcatc

SEQ ID NO: 21194 - DNA, 111 bp, Neocallimastix californiae
  Dockerin_dom
tttagcatatgaagattgtaaatcatgttatattcattatgaagatagtgatggttactggggatacaatggtgatgaatggtgtataattaatgaagaatattgtaaaga

SEQ ID NO: 21195 - DNA, 123 bp, Neocallimastix californiae
  Dockerin_dom
ttgttggatcaaagattacttttcttgttgtgatgagggagctgaagttatttacgaagatcataatggtaaatggggtatccaaggggctaatgattggtgtttaatagttgaaaaacaaag

SEQ ID NO: 21196 - DNA, 117 bp, Neocallimastix californiae
  Dockerin_dom
atgttggagtttagaacttggttatccatgttgtaaaacaacaaaagacgtagtttatactgataatagtggtgattggggtcttgaaaatggtgattggtgtggtatcgtagaagg

SEQ ID NO: 21197 - DNA, 111 bp, Neocallimastix californiae; identical to SEQ ID NO: 18567
  Dockerin_dom

SEQ ID NO: 21198 - DNA, 123 bp, Neocallimastix californiae
  Dockerin_dom
ttttgcagaagtattaggttataaatgttgtgaagaccaaaacggtccaagaacatcaatagatgcagatggtgaatggtatgaagataaatatggtaattggtgtggttatagtaatagtac

SEQ ID NO: 21199 - DNA, 120 bp, Neocallimastix californiae; identical to SEQ ID NO: 18570
  Dockerin_dom

SEQ ID NO: 21200 - DNA, 120 bp, Neocallimastix californiae; identical to SEQ ID NO: 18568
  Dockerin_dom

SEQ ID NO: 21201 - DNA, 90 bp, Neocallimastix californiae
  Dockerin_dom
cccatgttgtacttcaactaaaactgtaatgtatactgatgaaaagggaccatggggtattgaaaatggtaactggtgtggtattcaaaa

SEQ ID NO: 21202 - DNA, 123 bp, Neocallimastix californiae; identical to SEQ ID NO: 18571
  Dockerin_dom

SEQ ID NO: 21203 - DNA, 121 bp, Neocallimastix californiae
  Dockerin_dom
ctgggctactaagcttggttataagtgttgtactgctaaatgtccagaagtttcttacgttgaccaagatggtgcttggggtgttgaaaacggtaactggtgtggtattaccaagacatgt

SEQ ID NO: 21204 - DNA, 123 bp, Neocallimastix californiae
  Dockerin_dom
ttgctgggctactaaacttggttttaactgttgtaagaacactagtgctgtttatgaaaccgatgctaatggccgttggggtattgaaaatggtaattggtgtggtattattgaaagttcttg

SEQ ID NO: 21205 - DNA, 99 bp, Neocallimastix californiae; identical to SEQ ID NO: 18575
  Dockerin_dom

SEQ ID NO: 21206 - DNA, 105 bp, Neocallimastix californiae
  Dockerin_dom
tatggctcaaggttacccatgttgttccgctaactgtcaagttgtttacactgatgctgatggtgaatggggtgttgaaaatggtgactggtgtggttgtggtgg

SEQ ID NO: 21207 - DNA, 111 bp, Neocallimastix californiae; identical to SEQ ID NO: 18576
  Dockerin_dom

SEQ ID NO: 21208 - DNA, 81 bp, Neocallimastix californiae
  Dockerin_dom
ttgttctggtaacgaagttgtttacactgataatgatggtaagtggggtgttgaaaatggtaattggtgtggtattgctga

SEQ ID NO: 21209 - DNA, 126 bp, Neocallimastix californiae
  Dockerin_dom
ttcagcttctattttaaaacaaggttattcttgctgctcatcaagatgtaccgttacatttactgacgaagatggagattggggtgttgaaaatggacaatggtgtggatgtggaaatagaaaacc

SEQ ID NO: 21210 - DNA, 126 bp, Neocallimastix californiae; identical to SEQ ID NO: 18578
  Dockerin_dom

SEQ ID NO: 21211 - DNA, 129 bp, Neocallimastix californiae; identical to SEQ ID NO: 18579
  Dockerin_dom

SEQ ID NO: 21212 - DNA, 73 bp, Neocallimastix californiae; identical to SEQ ID NO: 16044
  Dockerin_dom

SEQ ID NO: 21213 - DNA, 111 bp, Neocallimastix californiae; identical to SEQ ID NO: 18582
  Dockerin_dom

SEQ ID NO: 21214 - DNA, 96 bp, Neocallimastix californiae; identical to SEQ ID NO: 18585
  Dockerin_dom

SEQ ID NO: 21215 - DNA, 117 bp, Neocallimastix californiae; identical to SEQ ID NO: 18584
  Dockerin_dom

SEQ ID NO: 21216 - DNA, 102 bp, Neocallimastix californiae
  Dockerin_dom
ttatgaatgctgcaaatcatgtaatatcgttttaacagatgaaagtggtaattggggtgttgaagacggtcaatggtgtggtattgacgaagataaatgtac

SEQ ID NO: 21217 - DNA, 129 bp, Neocallimastix californiae; identical to SEQ ID NO: 18586
  Dockerin_dom

SEQ ID NO: 21218 - DNA, 111 bp, Neocallimastix californiae; identical to SEQ ID NO: 18587
  Dockerin_dom

SEQ ID NO: 21219 - DNA, 120 bp, Neocallimastix californiae; identical to SEQ ID NO: 18588
  Dockerin_dom

SEQ ID NO: 21220 - DNA, 126 bp, Neocallimastix californiae
  Dockerin_dom
atgttgggctactgctcaaggttatggatgttgtactggatgtgaagccatcatgactgatgataatagaaaatggggttttgaaaatggtaattggtgtggaattattgactcagtttgtaataa

SEQ ID NO: 21221 - DNA, 96 bp, Neocallimastix californiae
  Dockerin_dom
gcaaggttatccatgctgtaagaacaccaaggatgtttactatagagatgccgatggtaattggggtatcgaaaataataactggtgttacatggc

SEQ ID NO: 21222 - DNA, 126 bp, Neocallimastix californiae
  Dockerin_dom
ttctgctaagattgttcaacaaggttacaagtgttgttccagcagtaactgtgttgttcaatatgttgatagtgatggttactgggctgttgaaaataaccaatggtgtggatgtggaactgaagc

SEQ ID NO: 21223 - DNA, 82 bp, Neocallimastix californiae
  Dockerin_dom
ttcatcatcaattagatcacttggttattcatgttgtagtgataataactgtactgtttatgccaccgatgaatctggtaaa

SEQ ID NO: 21224 - DNA, 123 bp, Neocallimastix californiae; identical to SEQ ID NO: 18592
  Dockerin_dom

SEQ ID NO: 21225 - DNA, 117 bp, Neocallimastix californiae
  Dockerin_dom
ttgtttcgcacttgatttaggttttaaatgttgtaatgatgccactgttgtttacactgatgattcaggtgactggggttacgttaataatgattggtgtggtattggtggatcttc

SEQ ID NO: 21226 - DNA, 99 bp, Neocallimastix californiae
  Dockerin_dom
tccatgttgtagtgaatgtactgttgtatacactgatgaatctggtgactggggtgttgaaaataatgaatggtgtttaattaagaaatctaaatgtgg

SEQ ID NO: 21227 - DNA, 120 bp, Neocallimastix californiae
  Dockerin_dom
ttgttttgctattaaacttggttataaatgttgtaaaactactactgttaccatttatgaagataatgatggaccatggggtattgaaaatgatgaatggtgtggtcttaaaaaagctag

SEQ ID NO: 21228 - DNA, 114 bp, Neocallimastix californiae; identical to SEQ ID NO: 16057
  Dockerin_dom

SEQ ID NO: 21229 - DNA, 91 bp, Neocallimastix californiae; identical to SEQ ID NO: 16059
  Dockerin_dom

SEQ ID NO: 21230 - DNA, 120 bp, Neocallimastix californiae
  Dockerin_dom
atgtgtttctgaacttgttggtttcccatgttgtccagaaaataataaggctgtttacaaccgtgatgaatttggtgattggggttatgactttgctaaaggtacatggtgtggtcttac

SEQ ID NO: 21231 - DNA, 111 bp, Neocallimastix californiae
  Dockerin_dom
ttggtcattaccacaatttccatgttgtaaaaacaatgtagtagtttacactgatggttctggtgattggggttttgaaaacaacaactggtgtggtattattaaaaaaca

SEQ ID NO: 21232 - DNA, 93 bp, Neocallimastix californiae
  Dockerin_dom
cccatgttgtaaaggtaacactgttgtcttaactgatgtaaaaggtgattggggtgttgaaaacaacgcctggtgtggtattaataaaaaaac

SEQ ID NO: 21233 - DNA, 69 bp, Neocallimastix californiae
  Dockerin_dom
ttatacagacgaagacggaaactggggtgttgagaatgatcaatggtgcggatgtgaagatactaaatc

SEQ ID NO: 21234 - DNA, 120 bp, Neocallimastix californiae
  Dockerin_dom
taccagtattttagaaaaaggctattcatgctgtcctaaagattgtaaagttttatatactgatgaagaagggacttggggaattaacaattataaatggtgtatttgtaattctaatga

SEQ ID NO: 21235 - DNA, 123 bp, Neocallimastix californiae; identical to SEQ ID NO: 18604
  Dockerin_dom

SEQ ID NO: 21236 - DNA, 99 bp, Neocallimastix californiae; identical to SEQ ID NO: 18603
  Dockerin_dom

SEQ ID NO: 21237 - DNA, 42 bp, Neocallimastix californiae
  Dockerin_dom
gggtgttgaaaatcatgaatggtgtggtattacaaaggaaac

SEQ ID NO: 21238 - DNA, 54 bp, Neocallimastix californiae
  Dockerin_dom
tggtgattatggtttcgaaaataatgactggtgtggtattgctgattcatgtta

SEQ ID NO: 21239 - DNA, 120 bp, Neocallimastix californiae
  Dockerin_dom
tacatgctgggctactaaattaggttacccatgttgtactactacttcacaatcattattcactgatgaaaacggtgaatggggtgttgaaaacaatgactggtgtggtattagtaaatg

SEQ ID NO: 21240 - DNA, 102 bp, Neocallimastix californiae
  Dockerin_dom
aaatggttatccatactgtaaacaaactaatgaagtagttttcactgatactgttgaatggggtgtagaaaatggtgcttggtgtgttataaaatcaaaaga

SEQ ID NO: 21241 - DNA, 126 bp, Neocallimastix californiae
  Dockerin_dom
atgttggtctaaggcattaggttatgaatgctgttctaaagacaataccagagttgttgttagcgatgattctggtaaatggggtgttgaaaatggacaatggtgtggtattaataaatccaaaga

SEQ ID NO: 21242 - DNA, 91 bp, Neocallimastix californiae; identical to SEQ ID NO: 16067
  Dockerin_dom

SEQ ID NO: 21243 - DNA, 114 bp, Neocallimastix californiae; identical to SEQ ID NO: 18610
  Dockerin_dom

SEQ ID NO: 21244 - DNA, 123 bp, Neocallimastix californiae; identical to SEQ ID NO: 18609
  Dockerin_dom

SEQ ID NO: 21245 - DNA, 90 bp, Neocallimastix californiae; identical to SEQ ID NO: 18611
  Dockerin_dom

SEQ ID NO: 21246 - DNA, 123 bp, Neocallimastix californiae; identical to SEQ ID NO: 18612
  Dockerin_dom

SEQ ID NO: 21247 - DNA, 126 bp, Neocallimastix californiae
  Dockerin_dom
ttggtcccttcaatacggttatgactgttgtaagaagaaggagacggaaccttactactattctcaatccataaagaaatggtatggagtggaagatggcgaatggtgtggtattgaggaccgtca

SEQ ID NO: 21248 - DNA, 102 bp, Neocallimastix californiae
  Dockerin_dom
tggctatgactgctgtcaatacacgaccattccaacctataccgataagcagggttactgggccatggaggatgaggaatggtgtatcattgatcaagataa

SEQ ID NO: 21249 - DNA, 99 bp, Neocallimastix californiae
  Dockerin_dom
caagtgttgtaccaccacctgtgaagtctactactctgatgaatctggcgattggggggttgaggataatgattggtgttccatgccttatacttgtca

SEQ ID NO: 21250 - DNA, 87 bp, Neocallimastix californiae
  Dockerin_dom
cccatgttgtaccggaaaggatatagtttattctgatggtagtggtgattggggttttgaaaatggcagttggtgtggtattgttcc

SEQ ID NO: 21251 - DNA, 117 bp, Neocallimastix californiae
  Dockerin_dom
ttggtctcttccagaatatccatgctgtactgacagtaatactccagtaatggaagaagatacacttggaaaatggggtattgaaaatggtagctggtgtggtattaaagctgataa

SEQ ID NO: 21252 - DNA, 102 bp, Neocallimastix californiae
  Dockerin_dom
cggctattcctgttgtatatttgatacaacccctgtggtttccaaggataataccggctattggggtgttgaaaatggtcaatggtgtctctttgaaaatga

SEQ ID NO: 21253 - DNA, 132 bp, Neocallimastix californiae; identical to SEQ ID NO: 18619
  Dockerin_dom

SEQ ID NO: 21254 - DNA, 96 bp, Neocallimastix californiae
  Dockerin_dom
cccatgttgtaaaagttgtgttgaagtttatgaagatgatttaggtaaatggggtattgaaaatgatgtatggtgtggtattaaagatagttgtaa

SEQ ID NO: 21255 - DNA, 90 bp, Neocallimastix californiae; identical to SEQ ID NO: 18621
  Dockerin_dom

SEQ ID NO: 21256 - DNA, 93 bp, Neocallimastix californiae
  Dockerin_dom
taaatgttgtaaatcatgtgatattatttatacagacacctcagattggggagttgaagatgatgactggtgttctattccatatacatgtga

SEQ ID NO: 21257 - DNA, 123 bp, Neocallimastix californiae; identical to SEQ ID NO: 18623
  Dockerin_dom

SEQ ID NO: 21258 - DNA, 106 bp, Neocallimastix californiae; identical to SEQ ID NO: 16083
  Dockerin_dom

SEQ ID NO: 21259 - DNA, 126 bp, Neocallimastix californiae
  Dockerin_dom
ttgttgggctcaaggtttaggttatccatgttgtgaaggttgtgaagcctcatttactgatggtgatggtgattgggctattgaaaatggtaactggtgtggtattgatccaaagaaatgtaatgg

SEQ ID NO: 21260 - DNA, 120 bp, Neocallimastix californiae; identical to SEQ ID NO: 18627
  Dockerin_dom

SEQ ID NO: 21261 - DNA, 120 bp, Neocallimastix californiae; identical to SEQ ID NO: 18626
  Dockerin_dom

SEQ ID NO: 21262 - DNA, 114 bp, Neocallimastix californiae
  Dockerin_dom
ctggtctactgcattaggttacccatgttgtaaaaactctagtattgtttatttcactgataatgatggtaaatggagtgttgaagataatgaatggtgtggtatttcatccgg

SEQ ID NO: 21263 - DNA, 76 bp, Neocallimastix californiae; identical to SEQ ID NO: 16088
  Dockerin_dom

SEQ ID NO: 21264 - DNA, 132 bp, Neocallimastix californiae
  Dockerin_dom
tgaatgttggtctgaacagttaggttatccatgttgtaattcaggaaataaagaagtagtatttgaagatgaaaatggtaattggggaatcagccctaaaaccaatgattggtgtggtattcgttcagatgt

SEQ ID NO: 21265 - DNA, 123 bp, Neocallimastix californiae; identical to SEQ ID NO: 18632
  Dockerin_dom

SEQ ID NO: 21266 - DNA, 99 bp, Neocallimastix californiae; identical to SEQ ID NO: 18631
  Dockerin_dom

SEQ ID NO: 21267 - DNA, 123 bp, Neocallimastix californiae; identical to SEQ ID NO: 18633
  Dockerin_dom

SEQ ID NO: 21268 - DNA, 60 bp, Neocallimastix californiae
  Dockerin_dom
taatgatggtgattggggttttgaaaatgacaactggtgtggtttaaatgattattgtaa

SEQ ID NO: 21269 - DNA, 99 bp, Neocallimastix californiae
  Dockerin_dom
ctcttgctgtaagagtacctgtactccttccttatccgataatactggtgattgggctgttgaaaatggtgcctggtgttccattccatacacctgtga

SEQ ID NO: 21270 - DNA, 105 bp, Neocallimastix californiae; identical to SEQ ID NO: 18636
  Dockerin_dom

SEQ ID NO: 21271 - DNA, 120 bp, Neocallimastix californiae; identical to SEQ ID NO: 18637
  Dockerin_dom

SEQ ID NO: 21272 - DNA, 120 bp, Neocallimastix californiae; identical to SEQ ID NO: 18638
  Dockerin_dom

SEQ ID NO: 21273 - DNA, 120 bp, Neocallimastix californiae; identical to SEQ ID NO: 18640
  Dockerin_dom

SEQ ID NO: 21274 - DNA, 93 bp, Neocallimastix californiae; identical to SEQ ID NO: 18639
  Dockerin_dom

SEQ ID NO: 21275 - DNA, 123 bp, Neocallimastix californiae
  Dockerin_dom
ttgggctaatgcctatggttatgactgctgtgttgatggtactcttacatacttagaagatgaaactggaaaatggggtgttacctctgactaccaatggtgtggtctcttaaagagtgaatg

SEQ ID NO: 21276 - DNA, 87 bp, Neocallimastix californiae
  Dockerin_dom
ttgggctaatgcctatggttatgactgctgtgttgatggtactcttacatacttagaagatgaaactggaaaatggggtgttacctc

SEQ ID NO: 21277 - DNA, 126 bp, Neocallimastix californiae
  Dockerin_dom
atgttgggctaatgcctatggttatgactgctgtgttgatggtactcttacatacttagaagatgaaactggaaaatggggtgttacctctgactaccaatggtgtggtctcttaaagagtgaatg

SEQ ID NO: 21278 - DNA, 114 bp, Neocallimastix californiae; identical to SEQ ID NO: 18644
  Dockerin_dom

SEQ ID NO: 21279 - DNA, 120 bp, Neocallimastix californiae; identical to SEQ ID NO: 18645
  Dockerin_dom

SEQ ID NO: 21280 - DNA, 126 bp, Neocallimastix californiae
  Dockerin_dom
cagtgctaagattactagtcagggttatccatgctgttcctctagctgtactgttgtctacactgatgaatctggtgactggggtgttgaaaacaatcaatggtgtggttgtggtaaggtatgtac

SEQ ID NO: 21281 - DNA, 96 bp, Neocallimastix californiae
  Dockerin_dom
tcaaggttatccttgctgtaggactgccacatttgtttactacaccgatagtgatggtaattggagtgttgaaaacaatgattggtgtttaattcc

SEQ ID NO: 21282 - DNA, 123 bp, Neocallimastix californiae; identical to SEQ ID NO: 18648
  Dockerin_dom

SEQ ID NO: 21283 - DNA, 111 bp, Neocallimastix californiae
  Dockerin_dom
tttttcagagccattttatccatgctgtgaaaaaaatacagtagtatttactgataaacaagggaaatggggtattgaaaatggctcttggtgtggtataggtaaaagtat

SEQ ID NO: 21284 - DNA, 120 bp, Neocallimastix californiae; identical to SEQ ID NO: 18650
  Dockerin_dom

SEQ ID NO: 21285 - DNA, 93 bp, Neocallimastix californiae
  Dockerin_dom
taaatgttgtaagggttgtgaagtcgtatacacggattctgaagattggggtattgaagatggtaaatggtgttctatccctcattcttgtag

SEQ ID NO: 21286 - DNA, 63 bp, Neocallimastix californiae
  Dockerin_dom
tactgataacgatggagaatggggtataaacaatggagaatggtgcggatgtggtggtagtag

SEQ ID NO: 21287 - DNA, 76 bp, Neocallimastix californiae; identical to SEQ ID NO: 16112
  Dockerin_dom

SEQ ID NO: 21288 - DNA, 102 bp, Neocallimastix californiae
  Dockerin_dom
ttactcttgttgtgttttaactacaacggttgtcaccaccgatggtactggtaaatggggtattgaaggaaatcaatggtgtcttatgaaggaagacaaaac

SEQ ID NO: 21289 - DNA, 105 bp, Neocallimastix californiae; identical to SEQ ID NO: 18656
  Dockerin_dom

SEQ ID NO: 21290 - DNA, 111 bp, Neocallimastix californiae
  Dockerin_dom
ctctttcccacaataccactgttgtaatgaatgtaatgttgtattagaagatgaagaaggtaaatggggttttgaaaacaataaatggtgtggtctcaaagattcttgtac

SEQ ID NO: 21291 - DNA, 120 bp, Neocallimastix californiae; identical to SEQ ID NO: 18657
  Dockerin_dom

SEQ ID NO: 21292 - DNA, 79 bp, Neocallimastix californiae; identical to SEQ ID NO: 18658
  Dockerin_dom

SEQ ID NO: 21293 - DNA, 102 bp, Neocallimastix californiae; identical to SEQ ID NO: 18660
  Dockerin_dom

SEQ ID NO: 21294 - DNA, 102 bp, Neocallimastix californiae
  Dockerin_dom
tccatattgtaatggatgtgaatccaattatactgatggagatggtgattggtatttcgttgataataattggtgtaaggttaatgaaaagaaatgtcaaac

SEQ ID NO: 21295 - DNA, 96 bp, Neocallimastix californiae
  Dockerin_dom
atatcaatgttgtaagaattcctctactgtagctgtttattcagataaggatggtgaatggggtgttgaaaataatgattggtgtattattccatc

SEQ ID NO: 21296 - DNA, 123 bp, Neocallimastix californiae; identical to SEQ ID NO: 18662
  Dockerin_dom

SEQ ID NO: 21297 - DNA, 118 bp, Neocallimastix californiae
  Dockerin_dom
ttgtggtgctgccggttatccatgttgtaaatcaagttgtaccgtttatgctgaagattctgacggtaaatggagtattgaaaatgataattggtgtttaattgaccaatccaaatgt

SEQ ID NO: 21298 - DNA, 82 bp, Neocallimastix californiae
  Dockerin_dom
ttctgaaaagtttactaaacaaggttacaaatgttgtagtagctgtagctttgtctactacactgatgaatcaggtgactgg

SEQ ID NO: 21299 - DNA, 114 bp, Neocallimastix californiae
  Dockerin_dom
cgctgctattcgtaaccaaggttacaaatgttgtaaggctggttgtcaagttatttacaaagattctgatggtgattggggtgttgaaaacaaccaatggtgtggttgtggtgg

SEQ ID NO: 21300 - DNA, 102 bp, Neocallimastix californiae
  Dockerin_dom
taagtgttgtagtgaaacttgtgaagtcaaaaaatttactaaatctggtaaagttttgggttatgaaaatggaaagtggtgttctattccatataaatgttc

SEQ ID NO: 21301 - DNA, 117 bp, Neocallimastix californiae
  Dockerin_dom
ttgttgggcatacaaattaggttatcaatgttgtttaggagacaatgttaaaagtatatacaatgatgtagatggtgattggaattatcttaatggaagatggtgtggtattatggt

SEQ ID NO: 21302 - DNA, 63 bp, Neocallimastix californiae
  Dockerin_dom
tgtctatgtcgataaagatggtgaatggggtgtagaaaatggaaattggtgtggtattggtgg

SEQ ID NO: 21303 - DNA, 106 bp, Neocallimastix californiae; identical to SEQ ID NO: 16127
  Dockerin_dom

SEQ ID NO: 21304 - DNA, 105 bp, Neocallimastix californiae
  Dockerin_dom
attgggttataattgttgtaagtacagaagtactcctgtttatgaaaaggataatgatggtttatggggtattgaagataacgattggtgtggtgtcaccgaaat

SEQ ID NO: 21305 - DNA, 102 bp, Neocallimastix californiae; identical to SEQ ID NO: 18670
  Dockerin_dom

SEQ ID NO: 21306 - DNA, 114 bp, Neocallimastix californiae; identical to SEQ ID NO: 18671
  Dockerin_dom

SEQ ID NO: 21307 - DNA, 108 bp, Neocallimastix californiae; identical to SEQ ID NO: 18672
  Dockerin_dom

SEQ ID NO: 21308 - DNA, 120 bp, Neocallimastix californiae
  Dockerin_dom
atgttggtctgaagtagttggttattcatgctgtagttctaatgaaactacggtttatgctcatgatgataacggtgattggggttatgactttaataaacaagaatggtgtggtcttac

SEQ ID NO: 21309 - DNA, 96 bp, Neocallimastix californiae; identical to SEQ ID NO: 18674
  Dockerin_dom

SEQ ID NO: 21310 - DNA, 114 bp, Neocallimastix californiae
  Dockerin_dom
ttggtctctcccaagatatccatgttgttctaatgtcacaataactctaattaaggatatgtatggaaataaatggggtatggaaaataaaaattattgtggtattttatatga

SEQ ID NO: 21311 - DNA, 96 bp, Neocallimastix californiae; identical to SEQ ID NO: 18676
  Dockerin_dom

SEQ ID NO: 21312 - DNA, 114 bp, Neocallimastix californiae
  Dockerin_dom
atgtggagctgctgctatcggttacccatgttgtgaaaatacctgtactgaagtctacactgatgaatacagatggggtgttgaagatgatgaatggtgtggtattgatgatgc

SEQ ID NO: 21313 - DNA, 109 bp, Neocallimastix californiae; identical to SEQ ID NO: 15442
  Dockerin_dom

SEQ ID NO: 21314 - DNA, 88 bp, Neocallimastix californiae; identical to SEQ ID NO: 16139
  Dockerin_dom

SEQ ID NO: 21315 - DNA, 103 bp, Neocallimastix californiae; identical to SEQ ID NO: 16140
  Dockerin_dom

SEQ ID NO: 21316 - DNA, 93 bp, Neocallimastix californiae
  Dockerin_dom
tccttgctgtcaggaatgcaatgttttatacacggatactgaagattggggtatcgaaaatggtagctggtgttctattccatatacctgtaa

SEQ ID NO: 21317 - DNA, 109 bp, Neocallimastix californiae; identical to SEQ ID NO: 16142
  Dockerin_dom

SEQ ID NO: 21318 - DNA, 79 bp, Neocallimastix californiae; identical to SEQ ID NO: 16143
  Dockerin_dom

SEQ ID NO: 21319 - DNA, 117 bp, Neocallimastix californiae; identical to SEQ ID NO: 18684
  Dockerin_dom

SEQ ID NO: 21320 - DNA, 114 bp, Neocallimastix californiae; identical to SEQ ID NO: 15140
  Dockerin_dom

SEQ ID NO: 21321 - DNA, 117 bp, Neocallimastix californiae; identical to SEQ ID NO: 17704
  Dockerin_dom

SEQ ID NO: 21322 - DNA, 120 bp, Neocallimastix californiae; identical to SEQ ID NO: 17690
  Dockerin_dom

SEQ ID NO: 21323 - DNA, 120 bp, Neocallimastix californiae; identical to SEQ ID NO: 17690
  Dockerin_dom

SEQ ID NO: 21324 - DNA, 120 bp, Neocallimastix californiae; identical to SEQ ID NO: 17690
  Dockerin_dom

SEQ ID NO: 21325 - DNA, 97 bp, Neocallimastix californiae; identical to SEQ ID NO: 16150
  Dockerin_dom

SEQ ID NO: 21326 - DNA, 88 bp, Neocallimastix californiae; identical to SEQ ID NO: 16139
  Dockerin_dom

SEQ ID NO: 21327 - DNA, 100 bp, Neocallimastix californiae; identical to SEQ ID NO: 18692
  Dockerin_dom

SEQ ID NO: 21328 - DNA, 109 bp, Neocallimastix californiae; identical to SEQ ID NO: 15442
  Dockerin_dom

SEQ ID NO: 21329 - DNA, 105 bp, Neocallimastix californiae
  Dockerin_dom
ccaaggttatccatgttgtaagactgcaactgaagttttctacactgataatgatggtaactggggtgttgaaaatggacaatggtgtggttgtggtgtgagtgt

SEQ ID NO: 21330 - DNA, 117 bp, Neocallimastix californiae; identical to SEQ ID NO: 18684
  Dockerin_dom

SEQ ID NO: 21331 - DNA, 120 bp, Neocallimastix californiae; identical to SEQ ID NO: 17690
  Dockerin_dom

SEQ ID NO: 21332 - DNA, 114 bp, Neocallimastix californiae; identical to SEQ ID NO: 15140
  Dockerin_dom

SEQ ID NO: 21333 - DNA, 120 bp, Neocallimastix californiae; identical to SEQ ID NO: 17690
  Dockerin_dom

SEQ ID NO: 21334 - DNA, 82 bp, Neocallimastix californiae; identical to SEQ ID NO: 15255
  Dockerin_dom

SEQ ID NO: 21335 - DNA, 112 bp, Neocallimastix californiae; identical to SEQ ID NO: 16160
  Dockerin_dom

SEQ ID NO: 21336 - DNA, 103 bp, Neocallimastix californiae; identical to SEQ ID NO: 16140
  Dockerin_dom

SEQ ID NO: 21337 - DNA, 120 bp, Neocallimastix californiae; identical to SEQ ID NO: 17690
  Dockerin_dom

SEQ ID NO: 21338 - DNA, 120 bp, Neocallimastix californiae; identical to SEQ ID NO: 17690
  Dockerin_dom

SEQ ID NO: 21339 - DNA, 88 bp, Neocallimastix californiae; identical to SEQ ID NO: 16139
  Dockerin_dom

SEQ ID NO: 21340 - DNA, 94 bp, Neocallimastix californiae; identical to SEQ ID NO: 16165
  Dockerin_dom

SEQ ID NO: 21341 - DNA, 120 bp, Neocallimastix californiae; identical to SEQ ID NO: 17690
  Dockerin_dom

SEQ ID NO: 21342 - DNA, 114 bp, Neocallimastix californiae; identical to SEQ ID NO: 18237
  Dockerin_dom_fun

SEQ ID NO: 21343 - DNA, 108 bp, Neocallimastix californiae
  Dockerin_dom_fun
tgaaaatggctatccttactgtaaaaataccaaaatcgttgtatacactgacgatgttgaatggggtgtagaaaataatgaatggtgtgtcattaaggatgatgaatc

SEQ ID NO: 21344 - DNA, 117 bp, Neocallimastix californiae
  Dockerin_dom_fun
taaatgttggtcagaaaagctaggttatccatgctgtgttggtaacactgtttatactactgatgaaagtggttcatggggtttagaaaatgatgattggtgtggtattaaaacttg

SEQ ID NO: 21345 - DNA, 120 bp, Neocallimastix californiae; identical to SEQ ID NO: 18240
  Dockerin_dom_fun

SEQ ID NO: 21346 - DNA, 118 bp, Neocallimastix californiae
  Dockerin_dom_fun
atgtttctctcttgtattaggtttcccatgttgttcttcatgtgattcaatttatgaagatgatgatggaaaatggggtgttgaaaataacaattggtgtggtattaaaaattcatgt

SEQ ID NO: 21347 - DNA, 99 bp, Neocallimastix californiae
  Dockerin_dom_fun
cgattgttgtaatggttgtgatgtttattacaccgatgacgaaggtgagtggggtattcaaaacaataattggtgcttcattaatgatgctaattgcca

SEQ ID NO: 21348 - DNA, 117 bp, Neocallimastix californiae; identical to SEQ ID NO: 18241
  Dockerin_dom_fun

SEQ ID NO: 21349 - DNA, 123 bp, Anaeromyces robustus; identical to SEQ ID NO: 20911
  Dockerin_dom_fun

SEQ ID NO: 21350 - DNA, 126 bp, Anaeromyces robustus; identical to SEQ ID NO: 18289
  Dockerin_dom_fun

SEQ ID NO: 21351 - DNA, 117 bp, Anaeromyces robustus; identical to SEQ ID NO: 20912
  Dockerin_dom_fun

SEQ ID NO: 21352 - DNA, 114 bp, Anaeromyces robustus; identical to SEQ ID NO: 21012
  Dockerin_dom_fun

SEQ ID NO: 21353 - DNA, 120 bp, Anaeromyces robustus
  Dockerin_dom_fun
ctgtttctctgttaaattaggatacccatgttgttctagtgccaatgttccagttgcttacactgataatgatggtaactggggtattgaaaatggtgattggtgtggtattccagaagt

SEQ ID NO: 21354 - DNA, 123 bp, Anaeromyces robustus; identical to SEQ ID NO: 18711
  Dockerin_dom_fun

SEQ ID NO: 21355 - DNA, 105 bp, Anaeromyces robustus; identical to SEQ ID NO: 18401
  Dockerin_dom_fun

SEQ ID NO: 21356 - DNA, 117 bp, Anaeromyces robustus; identical to SEQ ID NO: 21025
  Dockerin_dom_fun

SEQ ID NO: 21357 - DNA, 123 bp, Anaeromyces robustus; identical to SEQ ID NO: 21024
  Dockerin_dom_fun

SEQ ID NO: 21358 - DNA, 111 bp, Anaeromyces robustus; identical to SEQ ID NO: 21038
  Dockerin_dom_fun

SEQ ID NO: 21359 - DNA, 120 bp, Anaeromyces robustus; identical to SEQ ID NO: 21039
  Dockerin_dom_fun

SEQ ID NO: 21360 - DNA, 79 bp, Anaeromyces robustus; identical to SEQ ID NO: 18718
  Dockerin_dom_fun

SEQ ID NO: 21361 - DNA, 123 bp, Anaeromyces robustus; identical to SEQ ID NO: 21070
  Dockerin_dom_fun

SEQ ID NO: 21362 - DNA, 123 bp, Anaeromyces robustus; identical to SEQ ID NO: 18445
  Dockerin_dom_fun

SEQ ID NO: 21363 - DNA, 126 bp, Anaeromyces robustus; identical to SEQ ID NO: 21085
  Dockerin_dom_fun

SEQ ID NO: 21364 - DNA, 117 bp, Anaeromyces robustus; identical to SEQ ID NO: 21086
  Dockerin_dom_fun

SEQ ID NO: 21365 - DNA, 120 bp, Anaeromyces robustus; identical to SEQ ID NO: 21087
  Dockerin_dom_fun

SEQ ID NO: 21366 - DNA, 99 bp, Anaeromyces robustus; identical to SEQ ID NO: 21088
  Dockerin_dom_fun

SEQ ID NO: 21367 - DNA, 96 bp, Anaeromyces robustus; identical to SEQ ID NO: 18462
  Dockerin_dom_fun

SEQ ID NO: 21368 - DNA, 126 bp, Anaeromyces robustus; identical to SEQ ID NO: 18447
  Dockerin_dom_fun

SEQ ID NO: 21369 - DNA, 121 bp, Anaeromyces robustus; identical to SEQ ID NO: 21073
  Dockerin_dom_fun

SEQ ID NO: 21370 - DNA, 123 bp, Anaeromyces robustus; identical to SEQ ID NO: 21049
  Dockerin_dom_fun

SEQ ID NO: 21371 - DNA, 126 bp, Anaeromyces robustus; identical to SEQ ID NO: 18472
  Dockerin_dom_fun

SEQ ID NO: 21372 - DNA, 99 bp, Anaeromyces robustus; identical to SEQ ID NO: 21099
  Dockerin_dom_fun

SEQ ID NO: 21373 - DNA, 123 bp, Anaeromyces robustus; identical to SEQ ID NO: 21001
  Dockerin_dom_fun

SEQ ID NO: 21374 - DNA, 114 bp, Anaeromyces robustus; identical to SEQ ID NO: 18377
  Dockerin_dom_fun

SEQ ID NO: 21375 - DNA, 123 bp, Anaeromyces robustus; identical to SEQ ID NO: 21001
  Dockerin_dom_fun

SEQ ID NO: 21376 - DNA, 114 bp, Anaeromyces robustus; identical to SEQ ID NO: 18377
  Dockerin_dom_fun

SEQ ID NO: 21377 - DNA, 102 bp, Anaeromyces robustus; identical to SEQ ID NO: 21117
  Dockerin_dom_fun

SEQ ID NO: 21378 - DNA, 117 bp, Anaeromyces robustus; identical to SEQ ID NO: 18488
  Dockerin_dom_fun

SEQ ID NO: 21379 - DNA, 96 bp, Anaeromyces robustus; identical to SEQ ID NO: 21121
  Dockerin_dom_fun

SEQ ID NO: 21380 - DNA, 96 bp, Anaeromyces robustus; identical to SEQ ID NO: 21122
  Dockerin_dom_fun

SEQ ID NO: 21381 - DNA, 109 bp, Anaeromyces robustus
  Dockerin_dom_fun
tttaggttatccatgttgtaaatctacatgtaatgtttactcatctgatgaaagtggtcaatggggtattgaagataacaactggtgtttaattgatgcctctaaatgt

SEQ ID NO: 21382 - DNA, 123 bp, Anaeromyces robustus; identical to SEQ ID NO: 18490
  Dockerin_dom_fun

SEQ ID NO: 21383 - DNA, 102 bp, Anaeromyces robustus; identical to SEQ ID NO: 18743
  Dockerin_dom_fun

SEQ ID NO: 21384 - DNA, 108 bp, Anaeromyces robustus
  Dockerin_dom_fun
tttaggttattcatgttgtaaatcatgtgatagtttcaattacaaagataatgatggtgaatggggtatagaaaatgatgcctggtgtggtattccaaaagaatgttc

SEQ ID NO: 21385 - DNA, 108 bp, Anaeromyces robustus
  Dockerin_dom_fun
tttaggttatccatgttgtaaatctacatgtaatgtttactcatctgatgaaagtggtcaatggggtatagaaaatgatgcctggtgtggtattccaaaagaatgttc

SEQ ID NO: 21386 - DNA, 117 bp, Anaeromyces robustus; identical to SEQ ID NO: 21105
  Dockerin_dom_fun

SEQ ID NO: 21387 - DNA, 105 bp, Anaeromyces robustus; identical to SEQ ID NO: 21106
  Dockerin_dom_fun

SEQ ID NO: 21388 - DNA, 118 bp, Anaeromyces robustus; identical to SEQ ID NO: 21104
  Dockerin_dom_fun

SEQ ID NO: 21389 - DNA, 111 bp, Anaeromyces robustus; identical to SEQ ID NO: 18501
  Dockerin_dom_fun

SEQ ID NO: 21390 - DNA, 115 bp, Anaeromyces robustus; identical to SEQ ID NO: 21130
  Dockerin_dom_fun

SEQ ID NO: 21391 - DNA, 117 bp, Anaeromyces robustus; identical to SEQ ID NO: 18534
  Dockerin_dom_fun

SEQ ID NO: 21392 - DNA, 114 bp, Anaeromyces robustus; identical to SEQ ID NO: 21163
  Dockerin_dom_fun

SEQ ID NO: 21393 - DNA, 96 bp, Anaeromyces robustus; identical to SEQ ID NO: 21141
  Dockerin_dom_fun

SEQ ID NO: 21394 - DNA, 105 bp, Anaeromyces robustus; identical to SEQ ID NO: 21142
  Dockerin_dom_fun

SEQ ID NO: 21395 - DNA, 120 bp, Anaeromyces robustus; identical to SEQ ID NO: 18552
  Dockerin_dom_fun

SEQ ID NO: 21396 - DNA, 120 bp, Anaeromyces robustus; identical to SEQ ID NO: 21180
  Dockerin_dom_fun

SEQ ID NO: 21397 - DNA, 105 bp, Anaeromyces robustus; identical to SEQ ID NO: 16214
  Dockerin_dom_fun

SEQ ID NO: 21398 - DNA, 126 bp, Anaeromyces robustus; identical to SEQ ID NO: 21143
  Dockerin_dom_fun

SEQ ID NO: 21399 - DNA, 93 bp, Anaeromyces robustus; identical to SEQ ID NO: 18515
  Dockerin_dom_fun

SEQ ID NO: 21400 - DNA, 99 bp, Anaeromyces robustus; identical to SEQ ID NO: 18503
  Dockerin_dom_fun

SEQ ID NO: 21401 - DNA, 117 bp, Anaeromyces robustus; identical to SEQ ID NO: 21132
  Dockerin_dom_fun

SEQ ID NO: 21402 - DNA, 118 bp, Anaeromyces robustus; identical to SEQ ID NO: 21147
  Dockerin_dom_fun

SEQ ID NO: 21403 - DNA, 123 bp, Anaeromyces robustus; identical to SEQ ID NO: 21146
  Dockerin_dom_fun

SEQ ID NO: 21404 - DNA, 109 bp, Anaeromyces robustus; identical to SEQ ID NO: 16223
  Dockerin_dom_fun

SEQ ID NO: 21405 - DNA, 126 bp, Anaeromyces robustus; identical to SEQ ID NO: 18543
  Dockerin_dom_fun

SEQ ID NO: 21406 - DNA, 111 bp, Anaeromyces robustus; identical to SEQ ID NO: 21173
  Dockerin_dom_fun

SEQ ID NO: 21407 - DNA, 111 bp, Anaeromyces robustus; identical to SEQ ID NO: 21194
  Dockerin_dom_fun

SEQ ID NO: 21408 - DNA, 123 bp, Anaeromyces robustus; identical to SEQ ID NO: 21195
  Dockerin_dom_fun

SEQ ID NO: 21409 - DNA, 117 bp, Anaeromyces robustus; identical to SEQ ID NO: 21196
  Dockerin_dom_fun

SEQ ID NO: 21410 - DNA, 76 bp, Anaeromyces robustus
  Dockerin_dom_fun
ttgttggatcaaagattacttttcttgttgtgatgagggagctgaagttatttacgaagatcataatggtaaatgg

SEQ ID NO: 21411 - DNA, 123 bp, Anaeromyces robustus; identical to SEQ ID NO: 21195
  Dockerin_dom_fun

SEQ ID NO: 21412 - DNA, 105 bp, Anaeromyces robustus; identical to SEQ ID NO: 21206
  Dockerin_dom_fun

SEQ ID NO: 21413 - DNA, 99 bp, Anaeromyces robustus; identical to SEQ ID NO: 18575
  Dockerin_dom_fun

SEQ ID NO: 21414 - DNA, 90 bp, Anaeromyces robustus; identical to SEQ ID NO: 21201
  Dockerin_dom_fun

SEQ ID NO: 21415 - DNA, 120 bp, Anaeromyces robustus; identical to SEQ ID NO: 18570
  Dockerin_dom_fun

SEQ ID NO: 21416 - DNA, 120 bp, Anaeromyces robustus; identical to SEQ ID NO: 18568
  Dockerin_dom_fun

SEQ ID NO: 21417 - DNA, 120 bp, Anaeromyces robustus; identical to SEQ ID NO: 18637
  Dockerin_dom_fun

SEQ ID NO: 21418 - DNA, 120 bp, Anaeromyces robustus; identical to SEQ ID NO: 18638
  Dockerin_dom_fun

SEQ ID NO: 21419 - DNA, 111 bp, Anaeromyces robustus; identical to SEQ ID NO: 21231
  Dockerin_dom_fun

SEQ ID NO: 21420 - DNA, 93 bp, Anaeromyces robustus; identical to SEQ ID NO: 21232
  Dockerin_dom_fun

SEQ ID NO: 21421 - DNA, 120 bp, Anaeromyces robustus; identical to SEQ ID NO: 18777
  Dockerin_dom_fun

SEQ ID NO: 21422 - DNA, 117 bp, Anaeromyces robustus; identical to SEQ ID NO: 18584
  Dockerin_dom_fun

SEQ ID NO: 21423 - DNA, 96 bp, Anaeromyces robustus; identical to SEQ ID NO: 18585
  Dockerin_dom_fun

SEQ ID NO: 21424 - DNA, 102 bp, Anaeromyces robustus; identical to SEQ ID NO: 21216
  Dockerin_dom_fun

SEQ ID NO: 21425 - DNA, 96 bp, Anaeromyces robustus; identical to SEQ ID NO: 16243
  Dockerin_dom_fun

SEQ ID NO: 21426 - DNA, 111 bp, Anaeromyces robustus; identical to SEQ ID NO: 18782
  Dockerin_dom_fun

SEQ ID NO: 21427 - DNA, 111 bp, Anaeromyces robustus; identical to SEQ ID NO: 18582
  Dockerin_dom_fun

SEQ ID NO: 21428 - DNA, 120 bp, Anaeromyces robustus
  Dockerin_dom_fun
ttgctggtcagaatctttcggttacccatgctgtcacagttgttacgtttttgaaactgatgacaatggtaagtggggttttgaaaacaacacctggtgtggtattcaatcttactgttc

SEQ ID NO: 21429 - DNA, 120 bp, Anaeromyces robustus; identical to SEQ ID NO: 21230
  Dockerin_dom_fun

SEQ ID NO: 21430 - DNA, 123 bp, Anaeromyces robustus; identical to SEQ ID NO: 18519
  Dockerin_dom_fun

SEQ ID NO: 21431 - DNA, 114 bp, Anaeromyces robustus; identical to SEQ ID NO: 18520
  Dockerin_dom_fun

SEQ ID NO: 21432 - DNA, 96 bp, Anaeromyces robustus; identical to SEQ ID NO: 21221
  Dockerin_dom_fun

SEQ ID NO: 21433 - DNA, 126 bp, Anaeromyces robustus; identical to SEQ ID NO: 21222
  Dockerin_dom_fun

SEQ ID NO: 21434 - DNA, 123 bp, Anaeromyces robustus
  Dockerin_dom_fun
tacttgttggtctaaatctttaggttacccatgttgtacctcaaaatctactgttatattcactgattctaacggtcaatggggtattgaaaatggtaactggtgtggtaaaccaaacagtaa

SEQ ID NO: 21435 - DNA, 126 bp, Anaeromyces robustus
  Dockerin_dom_fun
ctgttgggctaaatctcttggttacaactgttgttctacaagtagttgtagaactgctcaattcagcgatgctgatggtcaatgggatgttgaaaatggtaattggtgtggtattactacctccaa

SEQ ID NO: 21436 - DNA, 87 bp, Anaeromyces robustus; identical to SEQ ID NO: 21250
  Dockerin_dom_fun

SEQ ID NO: 21437 - DNA, 117 bp, Anaeromyces robustus; identical to SEQ ID NO: 21251
  Dockerin_dom_fun

SEQ ID NO: 21438 - DNA, 120 bp, Anaeromyces robustus; identical to SEQ ID NO: 18794
  Dockerin_dom_fun

SEQ ID NO: 21439 - DNA, 99 bp, Anaeromyces robustus; identical to SEQ ID NO: 18796
  Dockerin_dom_fun

SEQ ID NO: 21440 - DNA, 117 bp, Anaeromyces robustus; identical to SEQ ID NO: 18795
  Dockerin_dom_fun

SEQ ID NO: 21441 - DNA, 121 bp, Anaeromyces robustus
  Dockerin_dom_fun
atgttggtctcttgaatacggttacaaatgttgttcacactgtaaagttcttctcaaggatgactatggtaaatggggagaaatgaatggtcaatggtgtggtattgatccagccaaatgt

SEQ ID NO: 21442 - DNA, 126 bp, Anaeromyces robustus; identical to SEQ ID NO: 21241
  Dockerin_dom_fun

SEQ ID NO: 21443 - DNA, 99 bp, Anaeromyces robustus
  Dockerin_dom_fun
tgaatgttgtaaaggatgtcaaacaattttaaccgatgatgaaggtaattggggtgctgaaaataatcaatggtgtttcattgatgaaaataaatgtag

SEQ ID NO: 21444 - DNA, 120 bp, Anaeromyces robustus; identical to SEQ ID NO: 18516
  Dockerin_dom_fun

SEQ ID NO: 21445 - DNA, 120 bp, Anaeromyces robustus; identical to SEQ ID NO: 18588
  Dockerin_dom_fun

SEQ ID NO: 21446 - DNA, 126 bp, Anaeromyces robustus; identical to SEQ ID NO: 21220
  Dockerin_dom_fun

SEQ ID NO: 21447 - DNA, 111 bp, Anaeromyces robustus; identical to SEQ ID NO: 18587
  Dockerin_dom_fun

SEQ ID NO: 21448 - DNA, 96 bp, Anaeromyces robustus
  Dockerin_dom_fun
tccatgttgtgaaggttgtaaagtaattcaagaagataaagatggtaaatggggttatgaaaataatgaatggtgtggtattaaagatagttgtac

SEQ ID NO: 21449 - DNA, 102 bp, Anaeromyces robustus; identical to SEQ ID NO: 18806
  Dockerin_dom_fun

SEQ ID NO: 21450 - DNA, 96 bp, Anaeromyces robustus; identical to SEQ ID NO: 21254
  Dockerin_dom_fun

SEQ ID NO: 21451 - DNA, 99 bp, Anaeromyces robustus
  Dockerin_dom_fun
tccatgttgtaataattgtgaagtaatttacgttgattcagatggagaatggggtgtagaaaataataattggtgtgctattgatgcaagtcaatgtta

SEQ ID NO: 21452 - DNA, 99 bp, Anaeromyces robustus
  Dockerin_dom_fun
tccattctgtaagggttgtacagtagtatatactgataatgatggtgattggggtgtagaaaataatgattggtgtcttattaagaaatctaattgtga

SEQ ID NO: 21453 - DNA, 127 bp, Anaeromyces robustus
  Dockerin_dom_fun
ttcatcatcaattagatcacttggttattcatgttgtagtgataataactgtactgtttatgccaccgatgaatctggtaaatggggtattgaaaatgaccaatggtgtggtatttctaacaaatgt

SEQ ID NO: 21454 - DNA, 123 bp, Anaeromyces robustus; identical to SEQ ID NO: 18592
  Dockerin_dom_fun

SEQ ID NO: 21455 - DNA, 111 bp, Anaeromyces robustus
  Dockerin_dom_fun
aaagaatcttggatacaaatgttgtcaatattgtgatatagtatatactgatagtgatggtgattatggtttcgaaaataatgactggtgtggtattgctgattcatgtta

SEQ ID NO: 21456 - DNA, 120 bp, Anaeromyces robustus; identical to SEQ ID NO: 21239
  Dockerin_dom_fun

SEQ ID NO: 21457 - DNA, 102 bp, Anaeromyces robustus; identical to SEQ ID NO: 21240
  Dockerin_dom_fun

SEQ ID NO: 21458 - DNA, 120 bp, Anaeromyces robustus; identical to SEQ ID NO: 21227
  Dockerin_dom_fun

SEQ ID NO: 21459 - DNA, 114 bp, Anaeromyces robustus; identical to SEQ ID NO: 16057
  Dockerin_dom_fun

SEQ ID NO: 21460 - DNA, 93 bp, Anaeromyces robustus
  Dockerin_dom_fun
tggttacccatgctgtaaaactaacaagcaagtttacttcactgataatgatggtaactggagtttcgaaaacaacaactggtgtttaatcaa

SEQ ID NO: 21461 - DNA, 129 bp, Anaeromyces robustus
  Dockerin_dom_fun
ttccgctaagattcaagctcaaggttacaaatgctgttctgacaagaattgtactatcttctactccgataatgatggtaattggggtgttgaaaatggacaatggtgtggttgtgaaaacagcaacac

SEQ ID NO: 21462 - DNA, 102 bp, Anaeromyces robustus
  Dockerin_dom_fun
tggttacaactgttgtagaaacacttgtagtatttcatacaaagatgatgatggtaattggggtattgaaaacggtaattggtgtggtattccattcacttg

SEQ ID NO: 21463 - DNA, 93 bp, Anaeromyces robustus
  Dockerin_dom_fun
ccaatgttgtagaaatactagagtaagtcaatacactgactcagctggtaatgaatggggtatcgaaaacaatcaatggtgtggtattattcc

SEQ ID NO: 21464 - DNA, 120 bp, Anaeromyces robustus; identical to SEQ ID NO: 18821
  Dockerin_dom_fun

SEQ ID NO: 21465 - DNA, 126 bp, Anaeromyces robustus; identical to SEQ ID NO: 21259
  Dockerin_dom_fun

SEQ ID NO: 21466 - DNA, 123 bp, Anaeromyces robustus; identical to SEQ ID NO: 18662
  Dockerin_dom_fun

SEQ ID NO: 21467 - DNA, 118 bp, Anaeromyces robustus; identical to SEQ ID NO: 21297
  Dockerin_dom_fun

SEQ ID NO: 21468 - DNA, 99 bp, Anaeromyces robustus; identical to SEQ ID NO: 18603
  Dockerin_dom_fun

SEQ ID NO: 21469 - DNA, 120 bp, Anaeromyces robustus; identical to SEQ ID NO: 18825
  Dockerin_dom_fun

SEQ ID NO: 21470 - DNA, 123 bp, Anaeromyces robustus; identical to SEQ ID NO: 18827
  Dockerin_dom_fun

SEQ ID NO: 21471 - DNA, 123 bp, Anaeromyces robustus; identical to SEQ ID NO: 18604
  Dockerin_dom_fun

SEQ ID NO: 21472 - DNA, 111 bp, Anaeromyces robustus; identical to SEQ ID NO: 18829
  Dockerin_dom_fun

SEQ ID NO: 21473 - DNA, 121 bp, Anaeromyces robustus
  Dockerin_dom_fun
ttctattacttctcaaggttatagatgttgtaaagaaaataactgttcagttattgaaactgatgactctggtaaatggggtattgaagatggacaatggtgtggtatttctaacaagtgt

SEQ ID NO: 21474 - DNA, 120 bp, Anaeromyces robustus; identical to SEQ ID NO: 18657
  Dockerin_dom_fun

SEQ ID NO: 21475 - DNA, 117 bp, Anaeromyces robustus; identical to SEQ ID NO: 18831
  Dockerin_dom_fun

SEQ ID NO: 21476 - DNA, 126 bp, Anaeromyces robustus; identical to SEQ ID NO: 21280
  Dockerin_dom_fun

SEQ ID NO: 21477 - DNA, 96 bp, Anaeromyces robustus; identical to SEQ ID NO: 21281
  Dockerin_dom_fun

SEQ ID NO: 21478 - DNA, 126 bp, Anaeromyces robustus; identical to SEQ ID NO: 18835
  Dockerin_dom_fun

SEQ ID NO: 21479 - DNA, 91 bp, Anaeromyces robustus; identical to SEQ ID NO: 16293
  Dockerin_dom_fun

SEQ ID NO: 21480 - DNA, 123 bp, Anaeromyces robustus; identical to SEQ ID NO: 18841
  Dockerin_dom_fun

SEQ ID NO: 21481 - DNA, 123 bp, Anaeromyces robustus; identical to SEQ ID NO: 18838
  Dockerin_dom_fun

SEQ ID NO: 21482 - DNA, 102 bp, Anaeromyces robustus
  Dockerin_dom_fun
atatccatgttgtaaaaagtgtgatgtttacagttacgatagacatggttactggggtattgaaaagggaaactggtgtggtattgatactattaagtgtca

SEQ ID NO: 21483 - DNA, 123 bp, Anaeromyces robustus; identical to SEQ ID NO: 18836
  Dockerin_dom_fun

SEQ ID NO: 21484 - DNA, 123 bp, Anaeromyces robustus; identical to SEQ ID NO: 18840
  Dockerin_dom_fun

SEQ ID NO: 21485 - DNA, 126 bp, Anaeromyces robustus
  Dockerin_dom_fun
ctgttgggctagttggtatggttatgaatgttgtaaaggttgtaaagtcaaaggtgaagatagtaaaggtaaatggggttgggaaaatggtaaatggtgtggtattgatgaagattattgtaaaaa

SEQ ID NO: 21486 - DNA, 114 bp, Anaeromyces robustus
  Dockerin_dom_fun
ttgtttcgctattaagttaggttataagtgttgtaataatgaagccgttgttcttgttgataatgatggtaaatggggttacaatggtgattggtgtggtattggtggttctag

SEQ ID NO: 21487 - DNA, 99 bp, Anaeromyces robustus
  Dockerin_dom_fun
atgctgtagtcactgtaatggtatttaccatgataacgatggtgactggggtgttgaaaataaccaatggtgtttaattaagagtagtaaatgtaatgt

SEQ ID NO: 21488 - DNA, 115 bp, Anaeromyces robustus
  Dockerin_dom_fun
taaatctacttcctacccatgttgttcaagctgtaatttaccagtttattctaccgatagtgatggtaaatggagtattgaaaacaataactggtgtaactttaataccaattgt

SEQ ID NO: 21489 - DNA, 120 bp, Anaeromyces robustus; identical to SEQ ID NO: 18640
  Dockerin_dom_fun

SEQ ID NO: 21490 - DNA, 99 bp, Anaeromyces robustus
  Dockerin_dom_fun
atacccatgttgttcaaagtgtaatgttgtatacaccgatgatgagggtgattggggtttcgaaaaaggagcatggtgttctattagagaaaattgtaa

SEQ ID NO: 21491 - DNA, 126 bp, Anaeromyces robustus
  Dockerin_dom_fun
atgctggtcagaagaacttggctacaaatgctgtaaatattgtaatgtcttaatggaagatgaaaatggacaatggggttttgaaaatgatgaatggtgtggtataactgaatctgcttgcaatgt

SEQ ID NO: 21492 - DNA, 123 bp, Anaeromyces robustus; identical to SEQ ID NO: 18612
  Dockerin_dom_fun

SEQ ID NO: 21493 - DNA, 109 bp, Anaeromyces robustus; identical to SEQ ID NO: 18849
  Dockerin_dom_fun

SEQ ID NO: 21494 - DNA, 120 bp, Anaeromyces robustus; identical to SEQ ID NO: 18852
  Dockerin_dom_fun

SEQ ID NO: 21495 - DNA, 111 bp, Anaeromyces robustus; identical to SEQ ID NO: 18850
  Dockerin_dom_fun

SEQ ID NO: 21496 - DNA, 96 bp, Anaeromyces robustus
  Dockerin_dom_fun
cagtaattgtaaaagtacttgcgaagtctcttatgaagatgaccaaaaatggggtattgaaaatggacaatggtgtattcttccagaatcatgttt

SEQ ID NO: 21497 - DNA, 120 bp, Anaeromyces robustus; identical to SEQ ID NO: 18854
  Dockerin_dom_fun

SEQ ID NO: 21498 - DNA, 118 bp, Anaeromyces robustus
  Dockerin_dom_fun
ttgtactggtattgaggatggttatccatgttgtaagacatgtaatgctatttacaatgatgaacaaggaccatggggttatgaaaataatgaatggtgtggtatcaagacttcttgc

SEQ ID NO: 21499 - DNA, 96 bp, Anaeromyces robustus
  Dockerin_dom_fun
tccatgctgttctaagggtgctgaagttatttacactgatgaatcaggtgattggggattagaaaatggtgactggtgctttattaaggaagatgg

SEQ ID NO: 21500 - DNA, 123 bp, Anaeromyces robustus
  Dockerin_dom_fun
ttgctggtctactgctgaaggttacccatgctgtaccccaggtactgcagttacacttactgatagtaagggtaaatggggtattgaaaacggaagctggtgtggtattaccgaaactaaaaa

SEQ ID NO: 21501 - DNA, 111 bp, Anaeromyces robustus
  Dockerin_dom_fun
ttcaaaggatggttatccatgctgtaaaggttgttcagtaacttacgaagatgccagtggtaaatggggtgtcgaaaataatgcttggtgtggtattgacagttcatgtaa

SEQ ID NO: 21502 - DNA, 129 bp, Anaeromyces robustus
  Dockerin_dom_fun
ttcatgctgggcttcttctcttggttacggttgttgtaatggttgtgaagctattactgttgatggtagtggtaaatggggtttcgaaaatggagcctggtgtggtattattgactccaaatgtaaaaa

SEQ ID NO: 21503 - DNA, 111 bp, Anaeromyces robustus; identical to SEQ ID NO: 21501
  Dockerin_dom_fun

SEQ ID NO: 21504 - DNA, 79 bp, Anaeromyces robustus; identical to SEQ ID NO: 16319
  Dockerin_dom_fun

SEQ ID NO: 21505 - DNA, 117 bp, Anaeromyces robustus; identical to SEQ ID NO: 18861
  Dockerin_dom_fun

SEQ ID NO: 21506 - DNA, 117 bp, Anaeromyces robustus
  Dockerin_dom_fun
ttgtttctccattgctcttggctatccatgctgtaaaggaaatacaattgtttacactgatgatagcggagactggggtgttgaaaataataactggtgtggtattccttctaattc

SEQ ID NO: 21507 - DNA, 102 bp, Anaeromyces robustus; identical to SEQ ID NO: 21294
  Dockerin_dom_fun

SEQ ID NO: 21508 - DNA, 96 bp, Anaeromyces robustus; identical to SEQ ID NO: 21295
  Dockerin_dom_fun

SEQ ID NO: 21509 - DNA, 123 bp, Anaeromyces robustus
  Dockerin_dom_fun
tccaggttatgaattaggatatgaatgttgtaataataatgaagttgtatatactgatgaaactggagattggggtttaactgatactgtacctcctcaatggtgtagtattggtaagaagga

SEQ ID NO: 21510 - DNA, 102 bp, Anaeromyces robustus
  Dockerin_dom_fun
attatatccatgttgtgaaggatgtaatgtttatgaagaaaccgaagaaggtaaatggggtattgaaaatgatgcttggtgtggtgttaaagattcatgttt

SEQ ID NO: 21511 - DNA, 96 bp, Anaeromyces robustus
  Dockerin_dom_fun
atatgacgaatgtaaaggttgtactgtgtattatgaggatgatacaaaatggggtgttgaaaatgacgactggtgtattattccatcatcatgtga

SEQ ID NO: 21512 - DNA, 114 bp, Anaeromyces robustus
  Dockerin_dom_fun
atgttggtctgaaagattaggttacccatgttgtaccagtggtgctcaagtttattacagtgatgctgatggtcaatggggtgttgaaaacaataactggtgtggtattattac

SEQ ID NO: 21513 - DNA, 117 bp, Anaeromyces robustus; identical to SEQ ID NO: 18869
  Dockerin_dom_fun

SEQ ID NO: 21514 - DNA, 123 bp, Anaeromyces robustus
  Dockerin_dom_fun
atgtttcgctgctaaacttaattacaagtgctgttctacttgtgatgtagcttatactgatggtgatggtgattggggtttcgaaaataatgaatggtgtggtattaaagattcttgtaaaaa

SEQ ID NO: 21515 - DNA, 87 bp, Anaeromyces robustus
  Dockerin_dom_fun
cccatgttgttcttcatctgttggagtttccttcgttgatgaaagtggttcatggggtattgaaaatggtaattggtgtggtattcc

SEQ ID NO: 21516 - DNA, 123 bp, Anaeromyces robustus; identical to SEQ ID NO: 18872
  Dockerin_dom_fun

SEQ ID NO: 21517 - DNA, 117 bp, Anaeromyces robustus
  Dockerin_dom_fun
atgtttttcccaaaagttaaatccatcctacccatgttgtgaaggtgatgtcgttgtctatgtcgataaagatggtgaatggggtgtagaaaatggaaattggtgtggtattggtgg

SEQ ID NO: 21518 - DNA, 123 bp, Anaeromyces robustus; identical to SEQ ID NO: 18874
  Dockerin_dom_fun

SEQ ID NO: 21519 - DNA, 93 bp, Anaeromyces robustus
  Dockerin_dom_fun
cccatgttgtgaaggcactgatgttgtatacagtgatgcttctggtgattggggtgttgaaaatggtcaatggtgtggtattgttgaaactaa

SEQ ID NO: 21520 - DNA, 96 bp, Anaeromyces robustus
  Dockerin_dom_fun
cccatgttgtaaagaaggggccgaagctatctatgaagatgctcaaggaaaatggggtgtagaaaatggtcaatggtgtggaattgaaccagaaca

SEQ ID NO: 21521 - DNA, 126 bp, Anaeromyces robustus
  Dockerin_dom_fun
aagctgctggtcgactgctcttaattatccatgttgtaaaaatagttgtgacgttgttatttcagatgacgatggtgattggggtgttgaagatggtcaatggtgtggtataactaaaaattgtgg

SEQ ID NO: 21522 - DNA, 117 bp, Anaeromyces robustus; identical to SEQ ID NO: 18877
  Dockerin_dom_fun

SEQ ID NO: 21523 - DNA, 114 bp, Anaeromyces robustus
  Dockerin_dom_fun
ctggtctttaccagattacaagtgctgttcaggatgtgacattgtctacactgataaccacaactggggtgttgaaaatggtgaatggtgtggtattgatgacaaacaatgtgg

SEQ ID NO: 21524 - DNA, 118 bp, Anaeromyces robustus
  Dockerin_dom_fun
atgtgctgttctttctcaaggttacccatgttgtcaacaaacttgtgatgtcgtctatgtagatgactacaaatggggtgttgaaaatggtgaatggtgtggtattaaggattcctgt

SEQ ID NO: 21525 - DNA, 138 bp, Anaeromyces robustus
  Dockerin_dom_fun
ttgttgggctaaagcattaggatttaaatgttgtgatgaagaaaatccacaagtttattatacagatgaaagtggtgattggagtgttgaatttaaaggagattcaggtgaatggtgtggtattattaaatcaaaaga

SEQ ID NO: 21526 - DNA, 117 bp, Anaeromyces robustus; identical to SEQ ID NO: 18883
  Dockerin_dom_fun

SEQ ID NO: 21527 - DNA, 111 bp, Anaeromyces robustus
  Dockerin_dom_fun
ttgttgggcaaatagacttggttaccaatgttgtaaaggtaatactgtagtatacactgatagtgatggaaaatggggtgttgaaaatggtaattggtgtggtatcgtaga

SEQ ID NO: 21528 - DNA, 96 bp, Anaeromyces robustus
  Dockerin_dom_fun
tccatgctgtaaaggttgtgatatttcttacagtgatgaaagtggtgattggggtgttgaaaatggcaaatggtgtggtattaaagcttcctgtaa

SEQ ID NO: 21529 - DNA, 96 bp, Anaeromyces robustus
  Dockerin_dom_fun
tccatgctgtaattcatgtaatattgttgaaaccgatgctcttggaagatggggtgttgaaaatggtgaatggtgtggaattccagattcttgctc

SEQ ID NO: 21530 - DNA, 123 bp, Anaeromyces robustus; identical to SEQ ID NO: 18884
  Dockerin_dom_fun

SEQ ID NO: 21531 - DNA, 100 bp, Anaeromyces robustus; identical to SEQ ID NO: 16346
  Dockerin_dom_fun
  modified_base (70)..(70): a, c, t, g, unknown or other

SEQ ID NO: 21532 - DNA, 45 bp, Anaeromyces robustus
  Dockerin_dom_fun
cggtgactggggtgttgaaaacggtaactggtgtggtattccagt

SEQ ID NO: 21533 - DNA, 114 bp, Anaeromyces robustus; identical to SEQ ID NO: 18889
  Dockerin_dom_fun

SEQ ID NO: 21534 - DNA, 117 bp, Anaeromyces robustus
  Dockerin_dom_fun
atgtttctctgttagtttaggttacccatgttgtcaaaagactactaaagttgttgtcgttgatgaagatggtgaatggggagctgaagatggtaattggtgtggtcttaaagctaa

SEQ ID NO: 21535 - DNA, 114 bp, Anaeromyces robustus; identical to SEQ ID NO: 18891
  Dockerin_dom_fun

SEQ ID NO: 21536 - DNA, 123 bp, Anaeromyces robustus
  Dockerin_dom_fun
atgctgggcagaaaaacttggttatggatgttgtaaaactacaaccactcctattttagaagatgatgatggcaaatggggtgttgaaaatgacgaatggtgtggtattatggaacaaaaaga

SEQ ID NO: 21537 - DNA, 120 bp, Anaeromyces robustus; identical to SEQ ID NO: 18893
  Dockerin_dom_fun

SEQ ID NO: 21538 - DNA, 99 bp, Anaeromyces robustus
  Dockerin_dom_fun
ttacccatgttgttctgaatgtaaaactatatatactgaccaaactggtgactggggatatgaaaatgaacaatggtgtggtattaaagattcctgtaa

SEQ ID NO: 21539 - DNA, 78 bp, Anaeromyces robustus
  Dockerin_dom_fun
agaaaaggatatgggttatccttgttgtgataattgtgaagttgtcactacagacagcgatggtggttgggggtatca

SEQ ID NO: 21540 - DNA, 126 bp, Anaeromyces robustus
  Dockerin_dom_fun
atgctgggctgaagctttaggatattcatgctgtaaaggttgtgatattatctacagtgataatgatggtgattggagtgttgaaaatgatgaatggtgtggtattattagcaaaaaatgtaataa

SEQ ID NO: 21541 - DNA, 93 bp, Anaeromyces robustus
  Dockerin_dom_fun
taaatgttgtaaaaagtgtaatgttgtatacagagatgattatgattggggtgtagaaaacaatgattggtgttctattccacattcctgtta

SEQ ID NO: 21542 - DNA, 123 bp, Anaeromyces robustus
  Dockerin_dom_fun
atgttggtctgaagcaagtggttattcatgttgtaaattaaaaacaacaactgttgaatttactgatagtaaaggtaacaaatatggtattgaaaatggtcatttttgtggtatcaatgatat

SEQ ID NO: 21543 - DNA, 114 bp, Anaeromyces robustus; identical to SEQ ID NO: 21299
  Dockerin_dom_fun

SEQ ID NO: 21544 - DNA, 82 bp, Anaeromyces robustus; identical to SEQ ID NO: 21298
  Dockerin_dom_fun

SEQ ID NO: 21545 - DNA, 123 bp, Anaeromyces robustus
  Dockerin_dom_fun
ttcagctagtattaaaaatcaaggtttttcatgttgtgaaggatgtacaaaatattatagtgataatgatggtgattggggttttgaaaatgacaactggtgtggtttaaatgattattgtaa

SEQ ID NO: 21546 - DNA, 123 bp, Anaeromyces robustus; identical to SEQ ID NO: 18633
  Dockerin_dom_fun

SEQ ID NO: 21547 - DNA, 117 bp, Anaeromyces robustus
  Dockerin_dom_fun
ttgttggtctgaaccagaattcaaatgttgtaccaagagttgtactgtttacttcactgatgatcatgaatggggtgttgaagatgatgaatggtgtggtattccagaatcttgttc

SEQ ID NO: 21548 - DNA, 117 bp, Anaeromyces robustus
  Dockerin_dom_fun
ttgtaagtctgcttcattctacccatgttgtgaaacttgtaatgtcttctctgaagaagatggtgaccgttggggtgttgaaaacgatcaatggtgtagtattaaatacaagtgtaa

SEQ ID NO: 21549 - DNA, 96 bp, Anaeromyces robustus
  Dockerin_dom_fun
ctatgaagaatgtaaaggttgtgtcgtatattatgaagatgatacgaagtggggtattgaaaacgatgattggtgtattattccatcatcatgtga

SEQ ID NO: 21550 - DNA, 96 bp, Anaeromyces robustus; identical to SEQ ID NO: 18904
  Dockerin_dom_fun

SEQ ID NO: 21551 - DNA, 120 bp, Anaeromyces robustus; identical to SEQ ID NO: 18907
  Dockerin_dom_fun

SEQ ID NO: 21552 - DNA, 99 bp, Anaeromyces robustus
  Dockerin_dom_fun
tccatgttgtaatggctgtgaagttgtttacactgatgtagacggagaatggggtgttgaaaatggtgcttggtgtttacttcaaccttctaaatgcta

SEQ ID NO: 21553 - DNA, 120 bp, Anaeromyces robustus; identical to SEQ ID NO: 18909
  Dockerin_dom_fun

SEQ ID NO: 21554 - DNA, 114 bp, Anaeromyces robustus
  Dockerin_dom_fun
tcaatgttggtcagaaaaacttggataccaatgttgtaagagtactaaagatattgttttcaccgataatgatggtaattggggtatagaaaatggtaattggtgtggtcttat

SEQ ID NO: 21555 - DNA, 126 bp, Anaeromyces robustus
  Dockerin_dom_fun
ttggtcattaaaacgtaatcatccatacccatgttgtgaaaaatcagaaaccgaagtagtttatatttcatctaatggtgatgaatggggtactgaaaacggtgattggtgtggtattactgatat

SEQ ID NO: 21556 - DNA, 99 bp, Anaeromyces robustus
  Dockerin_dom_fun
agattatccatgttgtaaaggatgtatagtaaagtatgtagatgattatgaatggggtgtagaagaaaataattggtgttatattccattcaaatgtaa

SEQ ID NO: 21557 - DNA, 120 bp, Anaeromyces robustus
  Dockerin_dom_fun
atgttggtcattaagattgggttataattgttgtaagtacagaagtactcctgtttatgaaaaggataatgatggtttatggggtattgaagataacgattggtgtggtgtcaccgaaat

SEQ ID NO: 21558 - DNA, 102 bp, Anaeromyces robustus; identical to SEQ ID NO: 18913
  Dockerin_dom_fun

SEQ ID NO: 21559 - DNA, 114 bp, Anaeromyces robustus; identical to SEQ ID NO: 18914
  Dockerin_dom_fun

SEQ ID NO: 21560 - DNA, 117 bp, Anaeromyces robustus
  Dockerin_dom_fun
taaatgttggtctgaaaaattaggttatccatgttgtacaaataaaaatgttgttcatgttgatgaaaatggtcaatggggaattgaaaatgatatgtggtgtggtattaaaaattg

SEQ ID NO: 21561 - DNA, 117 bp, Anaeromyces robustus
  Dockerin_dom_fun
ctgggctactaagcttggttataagtgttgtactgctaaatgtccagaagtttcttacgttgaccaagatggtgcttggggtgttgaaaacggtaactggtgtggtattaccaagac

SEQ ID NO: 21562 - DNA, 123 bp, Anaeromyces robustus; identical to SEQ ID NO: 21204
  Dockerin_dom_fun

SEQ ID NO: 21563 - DNA, 123 bp, Anaeromyces robustus; identical to SEQ ID NO: 21204
  Dockerin_dom_fun

SEQ ID NO: 21564 - DNA, 121 bp, Anaeromyces robustus; identical to SEQ ID NO: 21203
  Dockerin_dom_fun

SEQ ID NO: 21565 - DNA, 123 bp, Anaeromyces robustus; identical to SEQ ID NO: 18921
  Dockerin_dom_fun

SEQ ID NO: 21566 - DNA, 90 bp, Anaeromyces robustus
  Dockerin_dom_fun
atgttgggcaaaaagatatggatatgaatgttgtagtgaaaatgctaaatattacaaagaagatagtaatggtccatggggtaaggaacc

SEQ ID NO: 21567 - DNA, 90 bp, Anaeromyces robustus
  Dockerin_dom_fun
atgttgtaagaatcctgatacagaagtaatatctttcgatatggatggaagatatggtaatgaaaatggtgtcatttgtggtattaaagg

SEQ ID NO: 21568 - DNA, 114 bp, Anaeromyces robustus; identical to SEQ ID NO: 18923
  Dockerin_dom_fun

SEQ ID NO: 21569 - DNA, 117 bp, Anaeromyces robustus; identical to SEQ ID NO: 21301
  Dockerin_dom_fun

SEQ ID NO: 21570 - DNA, 120 bp, Anaeromyces robustus
  Dockerin_dom_fun
ttggtcagaatctttaggttatagttgttgtaccttctgttctccaattatttattctgatgaaagtggtgattggggtgttataaataatgaatggtgtggtattccaagtaattgtaa

SEQ ID NO: 21571 - DNA, 112 bp, Anaeromyces robustus; identical to SEQ ID NO: 18925
  Dockerin_dom_fun

SEQ ID NO: 21572 - DNA, 120 bp, Anaeromyces robustus; identical to SEQ ID NO: 18926
  Dockerin_dom_fun

SEQ ID NO: 21573 - DNA, 114 bp, Anaeromyces robustus
  Dockerin_dom_fun
ctttgctgaagatttaggattcaaatgttgtagttatagtaccatggaagtttattcagatagtaatggtaaatggagtgttgaaagtggtgaatggtgtggtattgatccaaa

SEQ ID NO: 21574 - DNA, 114 bp, Anaeromyces robustus
  Dockerin_dom_fun
atgttgggccgaaaaacttggttattcatgttgtcaaggatgtcatgttatttatgttgataatgatggagaatggggtgttgaaaataatgcctggtgtggaattaaccaatg

SEQ ID NO: 21575 - DNA, 118 bp, Anaeromyces robustus
  Dockerin_dom_fun
ttgtactggtaaacttcaaggttatcaatgttgtttaacatgtaatgttgtaacgactgatgcagatggaagatggggtattgaaaatggaaattggtgtggtattaaaaattcatgt

SEQ ID NO: 21576 - DNA, 117 bp, Anaeromyces robustus; identical to SEQ ID NO: 18929
  Dockerin_dom_fun

SEQ ID NO: 21577 - DNA, 123 bp, Anaeromyces robustus; identical to SEQ ID NO: 18931
  Dockerin_dom_fun

SEQ ID NO: 21578 - DNA, 124 bp, Anaeromyces robustus
  Dockerin_dom_fun
atgttggtcaaagaaatatggttatgaatgttgtcaaggttgtactgcttatgaagttgatgaatttggaaaatggggttatgaaaaaaaccactggtgtggtattattgaagaaaattgtcaa

SEQ ID NO: 21579 - DNA, 126 bp, Anaeromyces robustus; identical to SEQ ID NO: 18934
  Dockerin_dom_fun

SEQ ID NO: 21580 - DNA, 96 bp, Anaeromyces robustus
  Dockerin_dom_fun
tccatgttgttccccagacaatacttatatattctttagtgataataatggtgattggggtattgaaaatggagattggtgtggtattataaatgg

SEQ ID NO: 21581 - DNA, 120 bp, Anaeromyces robustus; identical to SEQ ID NO: 18933
  Dockerin_dom_fun

SEQ ID NO: 21582 - DNA, 63 bp, Anaeromyces robustus; identical to SEQ ID NO: 18937
  Dockerin_dom_fun

SEQ ID NO: 21583 - DNA, 123 bp, Anaeromyces robustus
  Dockerin_dom_fun
ttgttggtcagcagtctttggttacccatgttgtaaatatactaaagttgtaagatctactgatgaaaatggagattggggtattgaatatgatcattggtgtggtattccaaaatctcagcc

SEQ ID NO: 21584 - DNA, 123 bp, Anaeromyces robustus
  Dockerin_dom_fun
atgttggtctttaaaacaaggttattcatgttgtcaaaataaaaatactaaagttagttacatttctaaaaatggtgacgaatggggtgttgaaaataatgaatggtgtggtattactgatct

SEQ ID NO: 21585 - DNA, 117 bp, Anaeromyces robustus
  Dockerin_dom_fun
tccaaaatacaaacttggtaaatacaagtgttgtcaacaatgtaaagttagatatactgatgattatgaatggggtgttgaagatggtgaatggtgttcaattccatatagttgttc

SEQ ID NO: 21586 - DNA, 120 bp, Anaeromyces robustus
  Dockerin_dom_fun
ttgttggtctgaaaagttcaacattccatgttgtcaatccacttctgaagtagttagaaaaacttatgacggtgaatggggtatagaagatggtaaatggtgtagtattggtgaatctac

SEQ ID NO: 21587 - DNA, 93 bp, Anaeromyces robustus
  Dockerin_dom_fun
taaatgttgtgaaagttgtaatgtagtttatactgatttccaaaaatggggttatgaagataatgaatggtgttctattccttattcatgtga

SEQ ID NO: 21588 - DNA, 120 bp, Anaeromyces robustus; identical to SEQ ID NO: 18942
  Dockerin_dom_fun

SEQ ID NO: 21589 - DNA, 117 bp, Anaeromyces robustus; identical to SEQ ID NO: 18944
  Dockerin_dom_fun

SEQ ID NO: 21590 - DNA, 99 bp, Anaeromyces robustus
  Dockerin_dom_fun
tgcttgttgtaaagatccaaatacatatattagtaccaccgataaaactggagactggggtatagaaggtaattactggtgtttaattgataaagatgt

SEQ ID NO: 21591 - DNA, 120 bp, Anaeromyces robustus
  Dockerin_dom_fun
ttgctggtctaagaaattaggttatgaatgctgtgctggttgtagtgttgcttacaccgatagtgatggtgaatggggtcttgaaaacgaccaatggtgtggtattccagatacttgtaa

SEQ ID NO: 21592 - DNA, 108 bp, Anaeromyces robustus
  Dockerin_dom_fun
atcatcaggttacccatgttgtgaaaactgtgaagtcatttacgatgatggaaacacaaaatggggtcttttaaataatgactggtgtgctctttctgatgcttgtgg

SEQ ID NO: 21593 - DNA, 97 bp, Anaeromyces robustus
  Dockerin_dom_fun
tgattgctgttctggatgtaccgtcgttgatcaaggtgatggtaaaatcaaatggggtgtcgaaaacaatcaatggtgtattattaagagtacctgt

SEQ ID NO: 21594 - DNA, 105 bp, Anaeromyces robustus
  Dockerin_dom_fun
tggttatccatgttgtaaagatcaaagacctgaaaaaaaaacttacttagatatggatggtgattggactatagaagatggtaaatggtgtggattttatgatag

SEQ ID NO: 21595 - DNA, 126 bp, Anaeromyces robustus
  Dockerin_dom_fun
ttgttgggctacaaaaataaatacatcatatgcttgttgtccagaagacgaagtaaaatttgaagataaatatggatattggtcagttaatcaatctggtaaattttgtggtatcaaaagaaaaga

SEQ ID NO: 21596 - DNA, 126 bp, Anaeromyces robustus
  Dockerin_dom_fun
atgttgggcagattcctatggttacccatgttgtagcgaaggtattttagctttaccattttacactgacgaaaaaggtaataaatggggtagagaaaatgatgattattgtggtatcattgaaaa

SEQ ID NO: 21597 - DNA, 123 bp, Anaeromyces robustus; identical to SEQ ID NO: 18948
  Dockerin_dom_fun

SEQ ID NO: 21598 - DNA, 99 bp, Anaeromyces robustus
  Dockerin_dom_fun
tatgtgttgtaaaggatgtgatgttgtagaagatgacggagaaacaactaaatggggtattgaaaataatgaatggtgtggtcttaaagaatcttgtta

SEQ ID NO: 21599 - DNA, 99 bp, Anaeromyces robustus
  Dockerin_dom_fun
ttatagcaactgtcaaggttgtagagtcattcttgaagaaaacggtgttaaatggggtgttgaaaacaatgactggtgcattgtttcatcaagttgtaa

SEQ ID NO: 21600 - DNA, 120 bp, Anaeromyces robustus; identical to SEQ ID NO: 18953
  Dockerin_dom_fun

SEQ ID NO: 21601 - DNA, 120 bp, Anaeromyces robustus; identical to SEQ ID NO: 18954
  Dockerin_dom_fun

SEQ ID NO: 21602 - DNA, 111 bp, Anaeromyces robustus; identical to SEQ ID NO: 18956
  Dockerin_dom_fun

SEQ ID NO: 21603 - DNA, 111 bp, Anaeromyces robustus
  Dockerin_dom_fun
ttttgctctttctgatggttatgaatgttgttttgataatgaagttgtttatgaagatgaaactggtaaatggggtattaatgaaaatggtgaatggtgtggtgtagaaca

SEQ ID NO: 21604 - DNA, 126 bp, Anaeromyces robustus
  Dockerin_dom_fun
tacttgttgggctgagccattaggatttaaatgttgtactggtactgatccaaagattgtttattcagatgaagatggtgattgggctattgaaaatggtcaatggtgtggtgttgtaaaaaatat

SEQ ID NO: 21605 - DNA, 126 bp, Anaeromyces robustus; identical to SEQ ID NO: 18955
  Dockerin_dom_fun

SEQ ID NO: 21606 - DNA, 99 bp, Anaeromyces robustus
  Dockerin_dom_fun
tagatgttgtacagaatgtaatgttagttatacaggtagtgatggacatacttggggtattgaatatggtcaatggtgttccattccatatacttgtca

SEQ ID NO: 21607 - DNA, 126 bp, Anaeromyces robustus
  Dockerin_dom_fun
atgttgggctagttttgaaggttatccatgttgtgaagatccaaaaactcctgtttcctatgttaataaacaaacccgtgttgaatatggttttgaacatggggaatggtgtggtattagttcttt

SEQ ID NO: 21608 - DNA, 123 bp, Anaeromyces robustus; identical to SEQ ID NO: 18962
  Dockerin_dom_fun

SEQ ID NO: 21609 - DNA, 118 bp, Anaeromyces robustus
  Dockerin_dom_fun
atgtttctctcaatcattaggtttcccatgttgtaataattgtaatgttgtttacacggatgaaagtggatcatggggtgttgaaaataatgattggtgtggtattaaaagctcttgt

SEQ ID NO: 21610 - DNA, 123 bp, Anaeromyces robustus; identical to SEQ ID NO: 18961
  Dockerin_dom_fun

SEQ ID NO: 21611 - DNA, 123 bp, Anaeromyces robustus; identical to SEQ ID NO: 18967
  Dockerin_dom_fun

SEQ ID NO: 21612 - DNA, 87 bp, Anaeromyces robustus
  Dockerin_dom_fun
ccaatgttgtaaagataagaaatctatatatactgatgatgatggtgattgggcatatactaatggtgaatggtgtggtgtcaagtt

SEQ ID NO: 21613 - DNA, 114 bp, Anaeromyces robustus; identical to SEQ ID NO: 16434
  Dockerin_dom_fun

SEQ ID NO: 21614 - DNA, 117 bp, Anaeromyces robustus
  Dockerin_dom_fun
ttgttgggctgaagctttatcttataaatgttgttctaatccaaatacacctgttgtacttactgataaatcaggagaatggggtattgaaaatggtaattggtgtggtattattcc

SEQ ID NO: 21615 - DNA, 117 bp, Anaeromyces robustus
  Dockerin_dom_fun
ttgttggtcacttgatcatggttataaatgttgtaaaggtgaaaatgttgaagttgaatatactgattctaaaggtcaatggggtaaagaaaatggtgaatggtgtggtattattcc

SEQ ID NO: 21616 - DNA, 123 bp, Anaeromyces robustus; identical to SEQ ID NO: 18970
  Dockerin_dom_fun

SEQ ID NO: 21617 - DNA, 117 bp, Anaeromyces robustus
  Dockerin_dom_fun
ttgttggtcacttaattatggatataaatgttgtaaagatgaaaatgttgaagttattactactgatatttatggtcaatggggtaaagaagatggtaaatggtgtggtattattcc

SEQ ID NO: 21618 - DNA, 120 bp, Anaeromyces robustus; identical to SEQ ID NO: 18971
  Dockerin_dom_fun

SEQ ID NO: 21619 - DNA, 111 bp, Anaeromyces robustus; identical to SEQ ID NO: 18972
  Dockerin_dom_fun

SEQ ID NO: 21620 - DNA, 114 bp, Anaeromyces robustus
  Dockerin_dom_fun
tttttccaaaacattaactccttcttacccatgttgtaaaggtgataaagtcatctatactgataaaaatggagattggggtgttgaaaatggagaatggtgtggtattggagg

SEQ ID NO: 21621 - DNA, 120 bp, Anaeromyces robustus; identical to SEQ ID NO: 18973
  Dockerin_dom_fun

SEQ ID NO: 21622 - DNA, 123 bp, Anaeromyces robustus
  Dockerin_dom_fun
ttggagtgaaagccttggtgttagatgttgtaagggtgctgaaaacattgtagaatacatggatcaagaaggatggtggggtgttactgaagaagatcaatggtgtggtattgttaaaaatga

SEQ ID NO: 21623 - DNA, 111 bp, Anaeromyces robustus; identical to SEQ ID NO: 18976
  Dockerin_dom_fun

SEQ ID NO: 21624 - DNA, 90 bp, Anaeromyces robustus
  Dockerin_dom_fun
tccatgttgtaaaggtaatgtagtttattataccgatgaacaaggagcttggggtgttgaaaatggtaattggtgtggtattagtaatcc

SEQ ID NO: 21625 - DNA, 108 bp, Anaeromyces robustus
  Dockerin_dom_fun
atatggttatccatgttgttctgaatgttccaccgtttattatcaggataaaaatggtgaatggggtattgaaaatggtgattggtgtggaatgccatataaatgtaa

SEQ ID NO: 21626 - DNA, 105 bp, Anaeromyces robustus
  Dockerin_dom_fun
tattcaagaaggatatgaatgttgtccaataggttgtaaaatttattatacggatagttctggggattggggtatttataataatgattggtgtggatgtggtag

SEQ ID NO: 21627 - DNA, 117 bp, Anaeromyces robustus
  Dockerin_dom_fun
taattgttgggcacaaaaattaggatatccttgttgtacagaaaaggttatttattactctgatggtgatggtgattggggatttgaaaataaccaatggtgtggtataatgaaatg

SEQ ID NO: 21628 - DNA, 102 bp, Anaeromyces robustus
  Dockerin_dom_fun
cagttatccatattgtaaaactacaaaagatgtagcatttgatgatggtacattacaatggggtgttgaaaatgataactggtgtataattaaaggtcaatc

SEQ ID NO: 21629 - DNA, 117 bp, Anaeromyces robustus; identical to SEQ ID NO: 18983
  Dockerin_dom_fun

SEQ ID NO: 21630 - DNA, 124 bp, Anaeromyces robustus
  Dockerin_dom_fun
tccatcttctattactaaccaaggttatccatgttgttcatcctgttcaactgtttattatgttgataatgatggtaaatggggtgttgaaaacaatgattggtgtggaataccaacaaattgt

SEQ ID NO: 21631 - DNA, 117 bp, Anaeromyces robustus; identical to SEQ ID NO: 16451
  Dockerin_dom_fun

SEQ ID NO: 21632 - DNA, 105 bp, Anaeromyces robustus
  Dockerin_dom_fun
cggttatccatgttgtatatttgatacaactaaagccgttcttcatgatgatgatggggattggggtatagaaggtgattattgtcttattgttaataataaaaa

SEQ ID NO: 21633 - DNA, 117 bp, Anaeromyces robustus; identical to SEQ ID NO: 18987
  Dockerin_dom_fun

SEQ ID NO: 21634 - DNA, 84 bp, Anaeromyces robustus
  Dockerin_dom_fun
tccagtttgtaaaacaacttctgaaatagttttcactgacacggaaaaatggggaatagaaaataatgaatggtgtatcttgtg

SEQ ID NO: 21635 - DNA, 117 bp, Anaeromyces robustus
  Dockerin_dom_fun
ttgtaaagctgaagaaattggatattcatgttgtaaaaaacaaaaagaagtaatttatactgatgatttaggtgaatggggtatagaaaatggtgattggtgtggtatttctacatg

SEQ ID NO: 21636 - DNA, 108 bp, Anaeromyces robustus
  Dockerin_dom_fun
tggttataaatgttgttctaatattaatgctgaagtacaatatcatgataaagatggtgattggagtattgaaaataatgaatggtgtattattaaaaaggatgaaaa

SEQ ID NO: 21637 - DNA, 126 bp, Anaeromyces robustus; identical to SEQ ID NO: 18991
  Dockerin_dom_fun

SEQ ID NO: 21638 - DNA, 123 bp, Anaeromyces robustus; identical to SEQ ID NO: 18992
  Dockerin_dom_fun

SEQ ID NO: 21639 - DNA, 124 bp, Anaeromyces robustus
  Dockerin_dom_fun
agctactattactgctcaaaattatccatgctgtagtgataataattgtgatgtatatgctgttgatgaatctggtaaatggggtcttgaaaataatcaatggtgtggtatttccaacaaatgt

SEQ ID NO: 21640 - DNA, 123 bp, Anaeromyces robustus
  Dockerin_dom_fun
ttctgctaatattacaaaacaaggttataaatgttgtccaagtggatgtattgttatttatactgatgatgatggtacttggggtataaataatggtgaatggtgtggatgtaatgctgatgt

SEQ ID NO: 21641 - DNA, 108 bp, Anaeromyces robustus
  Dockerin_dom_fun
catacttaataaaggatattcatgttgtccatacaagtgtgaagttatttacactgatgaagatggtacttggggtatttatgataatgaatggtgtggatgcaatcc

SEQ ID NO: 21642 - DNA, 117 bp, Anaeromyces robustus; identical to SEQ ID NO: 18997
  Dockerin_dom_fun

SEQ ID NO: 21643 - DNA, 114 bp, Anaeromyces robustus; identical to SEQ ID NO: 18996
  Dockerin_dom_fun

SEQ ID NO: 21644 - DNA, 126 bp, Anaeromyces robustus
  Dockerin_dom_fun
ttgttggtcaactgaatatggttatccatgttgtgtattaaagtctacagttatcgaatacgatgatgttgagaatggaagaaaatatggtattgaagataacaaaatttgtggtattagtgatat

SEQ ID NO: 21645 - DNA, 96 bp, Anaeromyces robustus
  Dockerin_dom_fun
atacaaatgttgtaaaagttgtgatatagtttatactgatactactaattggggtgttgaaaataatgaatggtgttctattccatataaatgtgg

SEQ ID NO: 21646 - DNA, 123 bp, Anaeromyces robustus
  Dockerin_dom_fun
ttgttggtcatctgctgaaggttatccatgttgtcaagataaaaaaactaaagtttcttatgtttctaaattaactggtaaaaaatacggtatagaaaataataaaaaatgtggtattgtgga

SEQ ID NO: 21647 - DNA, 99 bp, Anaeromyces robustus
  Dockerin_dom_fun
tgaatgttgtgtttatccggatactcaattagtttattatactaatgttggtccatggggtatagaaaataatagttggtgtcttattaataaaacaga

SEQ ID NO: 21648 - DNA, 99 bp, Anaeromyces robustus; identical to SEQ ID NO: 19000
  Dockerin_dom_fun

SEQ ID NO: 21649 - DNA, 120 bp, Anaeromyces robustus; identical to SEQ ID NO: 19002
  Dockerin_dom_fun

SEQ ID NO: 21650 - DNA, 108 bp, Anaeromyces robustus
  Dockerin_dom_fun
tggttataaatgttgtaaagaatcatgtgcttactatgataaagatagtaaaggttactggggacttgaaaataaagaatggtgttatattgatactgctaaatgtga

SEQ ID NO: 21651 - DNA, 114 bp, Anaeromyces robustus
  Dockerin_dom_fun
ttggtcagcatctttaccatgttgtaaagaatgtaatgttgttgatgcatctgataaatctcgtcaatacggttgggaaaatgatcaatggtgtgctataccagataaatgttt

SEQ ID NO: 21652 - DNA, 108 bp, Anaeromyces robustus
  Dockerin_dom_fun
agcttatcaatatccatcatgtcctgatgaagaatggacttatactgataaagatggaatatggcatcaaaacagtgatggtagttggtgtttaattagtaaggaacc

SEQ ID NO: 21653 - DNA, 126 bp, Anaeromyces robustus
  Dockerin_dom_fun
atgttttgctcaagttttaggatattcttgttgtaaagaagctacaggaccaattacaaattctaacggagatggtgattggtatgaagatgaaaatggtaaatggtgtggttatagtagcagtgt

SEQ ID NO: 21654 - DNA, 123 bp, Anaeromyces robustus; identical to SEQ ID NO: 19004
  Dockerin_dom_fun

SEQ ID NO: 21655 - DNA, 117 bp, Anaeromyces robustus
  Dockerin_dom_fun
atgttgggcaacaaaattaggttatccatgttgtacaggaaaatatcctggtattagttatactgataaagatggatcatggtctattgaaaatggtcaatggtgtggtgttattat

SEQ ID NO: 21656 - DNA, 99 bp, Anaeromyces robustus
  Dockerin_dom_fun
aggttatccatgttgtattttagaaagtaccgcttttagaacctatgatagaagtggttattggggattagaaggaggtaattattgtcttatagaaga

SEQ ID NO: 21657 - DNA, 123 bp, Anaeromyces robustus
  Dockerin_dom_fun
ttgttggtctgaagcattaggttatccatgttgtcgtgatcctcgaaccaccatttataaaactgaaaaagatggtaaagaatggggtatagaatctaatcaatggtgtggtattaatgaaat

SEQ ID NO: 21658 - DNA, 129 bp, Anaeromyces robustus; identical to SEQ ID NO: 19008
  Dockerin_dom_fun

SEQ ID NO: 21659 - DNA, 117 bp, Anaeromyces robustus
  Dockerin_dom_fun
atgttggtctaatgaattaggttacccatgttgtaaatctactactgaaattgttttcactgatgatcgtggtaattggggtgttgaagataagaaatggtgtggagttattgttga

SEQ ID NO: 21660 - DNA, 108 bp, Anaeromyces robustus; identical to SEQ ID NO: 19009
  Dockerin_dom_fun

SEQ ID NO: 21661 - DNA, 120 bp, Anaeromyces robustus
  Dockerin_dom_fun
ctggtctgaaaaattaggttataaatgctgtaacacttgtttcccagtttattataccgataatgatggtcaatggggtatagtcaatggtgaatggtgtggtattgctaagacttgtac

SEQ ID NO: 21662 - DNA, 109 bp, Anaeromyces robustus
  Dockerin_dom_fun
tagttcaaaatctttaggttatccatgttgtaaatcatctaacaatgtagtctctactgatgaattaggaaaatggggtgttgaaaacggtgattggtgttacattaaa

SEQ ID NO: 21663 - DNA, 114 bp, Anaeromyces robustus
  Dockerin_dom_fun
ttgggcattaaaattaggttcaccatgttgtactttcaataaagatgtttatgctattgatgaaaatggtaaatggagtgttgaaaatggaatttggtgtggtataattgatga

SEQ ID NO: 21664 - DNA, 123 bp, Anaeromyces robustus
  Dockerin_dom_fun
tgaatgttggtcattaaaattaggttcaccatgttgtactaccactaaggaaattatttataccgatgatgatggaaactggggtattgaaaataatgactggtgtggtataattgatgataa

SEQ ID NO: 21665 - DNA, 120 bp, Anaeromyces robustus; identical to SEQ ID NO: 19013
  Dockerin_dom_fun

SEQ ID NO: 21666 - DNA, 120 bp, Anaeromyces robustus; identical to SEQ ID NO: 19017
  Dockerin_dom_fun

SEQ ID NO: 21667 - DNA, 120 bp, Anaeromyces robustus; identical to SEQ ID NO: 19016
  Dockerin_dom_fun

SEQ ID NO: 21668 - DNA, 105 bp, Anaeromyces robustus
  Dockerin_dom_fun
agaaggttataaatgttgtaaatccacctgtacagtatcttataccgatagtaataaatggggagttgaaaataatgaatggtgtattattccttatgaatgtga

SEQ ID NO: 21669 - DNA, 99 bp, Anaeromyces robustus
  Dockerin_dom_fun
aggttatgcttgttgtattatgaataatggttatattgatagtaccgatagtgatggtacatggggtattgaaggaggtagatattgtctttatgaaga

SEQ ID NO: 21670 - DNA, 129 bp, Anaeromyces robustus; identical to SEQ ID NO: 19020
  Dockerin_dom_fun

SEQ ID NO: 21671 - DNA, 114 bp, Anaeromyces robustus
  Dockerin_dom_fun
gtgctggtcattaaaacaaggatatccatgttgtgtaaaaaccgaaattgtagttatagaagatgaaaatggaaaatggggtgttgaaaatgatgattggtgtggtattattgt

SEQ ID NO: 21672 - DNA, 120 bp, Anaeromyces robustus; identical to SEQ ID NO: 19023
  Dockerin_dom_fun

SEQ ID NO: 21673 - DNA, 105 bp, Anaeromyces robustus; identical to SEQ ID NO: 19021
  Dockerin_dom_fun

SEQ ID NO: 21674 - DNA, 99 bp, Anaeromyces robustus
  Dockerin_dom_fun
atacccatgttgtagtccagataataaaaaaataaaatatgttgatcaacatggtcaatggggttttgaaaatggtgattggtgtggtatgcctgatgg

SEQ ID NO: 21675 - DNA, 120 bp, Anaeromyces robustus
  Dockerin_dom_fun
ttgttggtcagaaaaatatggttatccatgttgtaatggctgttatgtttttgaaactgatgatgatggtcaatggggatatgaaaacaatcaatggtgtggtattcaatcctactgttc

SEQ ID NO: 21676 - DNA, 120 bp, Anaeromyces robustus
  Dockerin_dom_fun
atgtttatctgaacttgtaggttatccatgttgtgctaaaggaattaaagctgtttatgctaaagatgaatatggtgaatggggttatgatttcaaaaagaatgaatggtgtggacttac

SEQ ID NO: 21677 - DNA, 114 bp, Anaeromyces robustus
  Dockerin_dom_fun
ttgttgggctgaaaaattaggttatccatgttgtaaaggtaatgaaccaaaagttgaatttactgatgaacatggagattggagtatagaaaatggacaaaaatgtggtatttt

SEQ ID NO: 21678 - DNA, 102 bp, Anaeromyces robustus
  Dockerin_dom_fun
acaattatatgaaatttgtaaagaacaacatgatgtagtatttaaagataatgaaggagtatggagtgtagaaaatggaaattggtgtagtatacaatattg

SEQ ID NO: 21679 - DNA, 120 bp, Anaeromyces robustus; identical to SEQ ID NO: 19027
  Dockerin_dom_fun

SEQ ID NO: 21680 - DNA, 120 bp, Anaeromyces robustus; identical to SEQ ID NO: 19031
  Dockerin_dom_fun

SEQ ID NO: 21681 - DNA, 123 bp, Anaeromyces robustus; identical to SEQ ID NO: 19030
  Dockerin_dom_fun

SEQ ID NO: 21682 - DNA, 120 bp, Anaeromyces robustus; identical to SEQ ID NO: 19033
  Dockerin_dom_fun

SEQ ID NO: 21683 - DNA, 117 bp, Anaeromyces robustus; identical to SEQ ID NO: 19032
  Dockerin_dom_fun

SEQ ID NO: 21684 - DNA, 117 bp, Anaeromyces robustus; identical to SEQ ID NO: 19035
  Dockerin_dom_fun

SEQ ID NO: 21685 - DNA, 108 bp, Anaeromyces robustus
  Dockerin_dom_fun
tccatgttgttccaattgtgatgtcgaaataatttggaatgatgaaaataaaggacaatcttggagtattgaaaataataattggtgtggtatattacaaagttgttt

SEQ ID NO: 21686 - DNA, 99 bp, Anaeromyces robustus
  Dockerin_dom_fun
tgaatgttgtgcttataaaaataccgaatatcaatattctacagatgttggtccatggggtcttcaagatggagcatggtgtcttatggatgaagatca

SEQ ID NO: 21687 - DNA, 99 bp, Anaeromyces robustus; identical to SEQ ID NO: 19036
  Dockerin_dom_fun

SEQ ID NO: 21688 - DNA, 126 bp, Anaeromyces robustus; identical to SEQ ID NO: 19037
  Dockerin_dom_fun

SEQ ID NO: 21689 - DNA, 126 bp, Anaeromyces robustus; identical to SEQ ID NO: 19038
  Dockerin_dom_fun

SEQ ID NO: 21690 - DNA, 120 bp, Anaeromyces robustus
  Dockerin_dom_fun
atgtttatctgaacttgtaggttatccatgttgtgctaaaggaattaaagttgtttatgcaaaagatgaatatggtgaatggggttatgatttcaaaaagaatgaatggtgtggacttac

SEQ ID NO: 21691 - DNA, 120 bp, Anaeromyces robustus
  Dockerin_dom_fun
atgttggtcagaaaaatatggttatccatgttgtaatggctgttatgtttttgaaactgatgatgatggtcaatggggatatgaaaacaatcaatggtgtggtattcaatccttctgttc

SEQ ID NO: 21692 - DNA, 99 bp, Anaeromyces robustus; identical to SEQ ID NO: 19042
  Dockerin_dom_fun

SEQ ID NO: 21693 - DNA, 93 bp, Anaeromyces robustus; identical to SEQ ID NO: 19043
  Dockerin_dom_fun

SEQ ID NO: 21694 - DNA, 117 bp, Anaeromyces robustus; identical to SEQ ID NO: 19041
  Dockerin_dom_fun

SEQ ID NO: 21695 - DNA, 120 bp, Anaeromyces robustus; identical to SEQ ID NO: 19044
  Dockerin_dom_fun

SEQ ID NO: 21696 - DNA, 111 bp, Anaeromyces robustus; identical to SEQ ID NO: 16508
  Dockerin_dom_fun

SEQ ID NO: 21697 - DNA, 126 bp, Anaeromyces robustus
  Dockerin_dom_fun
ttgttgggcaaaagccaaaggttatccatgttgtgataatgatgaaggttatttacaaagttatgatatggatggtaaatggggttatgaaaataatgcctggtgtggatataaaagttccaaacc

SEQ ID NO: 21698 - DNA, 111 bp, Anaeromyces robustus; identical to SEQ ID NO: 19048
  Dockerin_dom_fun

SEQ ID NO: 21699 - DNA, 120 bp, Anaeromyces robustus; identical to SEQ ID NO: 19046
  Dockerin_dom_fun

SEQ ID NO: 21700 - DNA, 120 bp, Anaeromyces robustus; identical to SEQ ID NO: 19050
  Dockerin_dom_fun

SEQ ID NO: 21701 - DNA, 102 bp, Anaeromyces robustus
  Dockerin_dom_fun
tggatacgcttgttgtaagagtagtgatgttaaaatttatgaaaccgatgaatatggtaaatggggtgttgaagataataaatggtgtttattagatagtga

SEQ ID NO: 21702 - DNA, 118 bp, Anaeromyces robustus
  Dockerin_dom_fun
ttgtttctctgaagctttaggttatccatgttgtacatcatgtaatgtaatctttactgacagtgatggtaaatggggtgttgaaaataatagttggtgtggtattaaagactcttgt

SEQ ID NO: 21703 - DNA, 114 bp, Anaeromyces robustus; identical to SEQ ID NO: 19051
  Dockerin_dom_fun

SEQ ID NO: 21704 - DNA, 90 bp, Anaeromyces robustus
  Dockerin_dom_fun
taaatgttgtaccactacttgtgaagttcatttcactgatgatattaaatggggtttagaaaagactggtgaattttgttcccttccata

SEQ ID NO: 21705 - DNA, 93 bp, Anaeromyces robustus
  Dockerin_dom_fun
ctattcctgttgtgtctttagagataccgctgtttatagtaccgatgaaactggtacatggggtattgaaggtaatcgttggtgtctttttaa

SEQ ID NO: 21706 - DNA, 135 bp, Anaeromyces robustus; identical to SEQ ID NO: 19054
  Dockerin_dom_fun

SEQ ID NO: 21707 - DNA, 105 bp, Anaeromyces robustus
  Dockerin_dom_fun
atgtgttaaaaataagaatggattaaaatgttgtagtacttgtgaaattgctttaactgatgctactggtagatatggttatgaaaatggtgaatggtgtaatac

SEQ ID NO: 21708 - DNA, 123 bp, Anaeromyces robustus
  Dockerin_dom_fun
ttggtcacgttctattggttttgtttgttgtgataaatgtaatgttctttatgttgatgaacaaggtaaatggggtattgaagatgaatactggtgtggtattaacccagataaatgtaaata

SEQ ID NO: 21709 - DNA, 114 bp, Anaeromyces robustus
  Dockerin_dom_fun
taatagtgaaaaatatggttattcctgttgtaaaacagagcaaaaagttgtttatacggatagccaaggggattggggaattgaagatggaaattggtgtggtatttattcctg

SEQ ID NO: 21710 - DNA, 111 bp, Anaeromyces robustus
  Dockerin_dom_fun
tagtagtggttacccatgttgtactgatcctcacaccaaagttgtctaccatgatgatgaaggtgactggggggtggaaaataaagaatggtgctttattcctgtggatca

SEQ ID NO: 21711 - DNA, 84 bp, Anaeromyces robustus
  Dockerin_dom_fun
tccagtttgtaaggaaactaccaaggtgatgtataccgatacggaaaaatggggtgtagaacatggagaatggtgtgtcctctg

SEQ ID NO: 21712 - DNA, 123 bp, Anaeromyces robustus; identical to SEQ ID NO: 19061
  Dockerin_dom_fun

SEQ ID NO: 21713 - DNA, 120 bp, Anaeromyces robustus
  Dockerin_dom_fun
gcaaagacaaggatatccatgttgtgaagaaaataattgtaatatctatttcaaggatggtgatggtgactggggtattagttcaaaatctaattggtgtggtattagattcacctgtaa

SEQ ID NO: 21714 - DNA, 129 bp, Anaeromyces robustus; identical to SEQ ID NO: 19062
  Dockerin_dom_fun

SEQ ID NO: 21715 - DNA, 117 bp, Anaeromyces robustus
  Dockerin_dom_fun
ttcttctcgtattttaaatcaaggttataaatgttgttccgataattgtaaggtagtttataccgatgaagatggtacatggggttatgaaaataatcaatggtgtggatgtactat

SEQ ID NO: 21716 - DNA, 118 bp, Anaeromyces robustus
  Dockerin_dom_fun
atgttggtcaaaaatatatggatactcatgttgtaaaagatgtatggtatatgaaactgatgaaaatggtaaatggggttttgaatctaatcaatggtgtggtattccagctagctgt

SEQ ID NO: 21717 - DNA, 120 bp, Anaeromyces robustus
  Dockerin_dom_fun
atgtttggctgaattaataggttatccatgttgtccatctataattaaaacaatttatgcccaagatgaatatggagattggggatttgatttcaaaaaacaagaatggtgtggacttac

SEQ ID NO: 21718 - DNA, 117 bp, Anaeromyces robustus; identical to SEQ ID NO: 19067
  Dockerin_dom_fun

SEQ ID NO: 21719 - DNA, 114 bp, Anaeromyces robustus; identical to SEQ ID NO: 16531
  Dockerin_dom_fun

SEQ ID NO: 21720 - DNA, 117 bp, Anaeromyces robustus
  Dockerin_dom_fun
ttgttgggcttatcaatatggattccaatgttgtttctattacacaaaaccatatcttgtcgatgaacgtggttcatggtcatttgaacgtggtaattggtgtggtattgtcacaaa

SEQ ID NO: 21721 - DNA, 90 bp, Anaeromyces robustus
  Dockerin_dom_fun
ttgttgtaaaaatgataataccccagtagtttattttaatatggatggaagattaggaatggaagatggtcattattgtggaattaaagg

SEQ ID NO: 21722 - DNA, 129 bp, Anaeromyces robustus; identical to SEQ ID NO: 19070
  Dockerin_dom_fun

SEQ ID NO: 21723 - DNA, 129 bp, Anaeromyces robustus; identical to SEQ ID NO: 19071
  Dockerin_dom_fun

SEQ ID NO: 21724 - DNA, 129 bp, Anaeromyces robustus; identical to SEQ ID NO: 19073
  Dockerin_dom_fun

SEQ ID NO: 21725 - DNA, 111 bp, Anaeromyces robustus
  Dockerin_dom_fun
attattaggttatccatgttgtaaaagatgtgattcatttttacttacagacgatgatgctaattggggtgttgaaaattcagaatggtgtattataaaaagcaactgtga

SEQ ID NO: 21726 - DNA, 123 bp, Anaeromyces robustus; identical to SEQ ID NO: 19074
  Dockerin_dom_fun

SEQ ID NO: 21727 - DNA, 120 bp, Anaeromyces robustus
  Dockerin_dom_fun
ttgtttagctgaattattaggatattcttgttgttcacctgaaaatactaacatatatttacaagatgaaaatggtgattggggttttgattttgaaaaaaatgaatggtgtggtcttac

SEQ ID NO: 21728 - DNA, 120 bp, Anaeromyces robustus
  Dockerin_dom_fun
ttggtccgaagctcttggtttcccatgttgtagtactaacggttgtcaagtcgtttattacactgataccgatggtaagtggggtgttgaaaacaacaattggtgtggtattactgctgc

SEQ ID NO: 21729 - DNA, 117 bp, Anaeromyces robustus; identical to SEQ ID NO: 19077
  Dockerin_dom_fun

SEQ ID NO: 21730 - DNA, 126 bp, Anaeromyces robustus; identical to SEQ ID NO: 19079
  Dockerin_dom_fun

SEQ ID NO: 21731 - DNA, 121 bp, Anaeromyces robustus
  Dockerin_dom_fun
atgtaatacatataataataaatatccatgttgtagtcactgtaatgtttatcacacagatactgatggcagcagatggggtattgaaaatgataactggtgttctattaattattcatgt

SEQ ID NO: 21732 - DNA, 114 bp, Anaeromyces robustus
  Dockerin_dom_fun
ttggagtttcttattaggttatgatacttgtaaagaacaacatgaatacatatataaagataatgaaggattatggagtatagaaggtggaaaatggtgtggtatacaatattg

SEQ ID NO: 21733 - DNA, 114 bp, Anaeromyces robustus
  Dockerin_dom_fun
ttgttgggctgaaaaattaggttatccatgttgtaaaggtaatgaaccaaaagttgaatttactgatgaatatggagattggagtaccgaagatggtcaaaaatgtggtatttt

SEQ ID NO: 21734 - DNA, 120 bp, Anaeromyces robustus; identical to SEQ ID NO: 19082
  Dockerin_dom_fun

SEQ ID NO: 21735 - DNA, 99 bp, Anaeromyces robustus
  Dockerin_dom_fun
tccatattgtgatggatgtgaaacaaattatactgataaagatggtggttggtattacactaataaaacttggtgtaaagttaatgaaaagaaatgttt

SEQ ID NO: 21736 - DNA, 114 bp, Anaeromyces robustus
  Dockerin_dom_fun
ttgttacgctcgtagtttaggattaccatgttgtaatgaaaatgaaattattgaaaccaacgaatatggaaattggggtaaaattgaaggtacagacttttattgtggtattgg

SEQ ID NO: 21737 - DNA, 96 bp, Anaeromyces robustus
  Dockerin_dom_fun
atatcaatgttgtaaagattcttctactaaagttatctctgaagataatgatggtacttggggtattgaaaataaaaaatggtgtcttattcaaac

SEQ ID NO: 21738 - DNA, 120 bp, Anaeromyces robustus; identical to SEQ ID NO: 19086
  Dockerin_dom_fun

SEQ ID NO: 21739 - DNA, 126 bp, Anaeromyces robustus
  Dockerin_dom_fun
atgttggtctgaagttttcggttacccatgttgtcaaagttgttatgtatatgaagaagatgaaaatggcaaatggggttatgatttcaatgaatctacctggtgtggtattcaatcttattgtaa

SEQ ID NO: 21740 - DNA, 99 bp, Anaeromyces robustus
  Dockerin_dom_fun
atgttgtcaagatccaagaactaaaattaagaaaatagatgaaaaaggaaaagaatggggagaagaaaataatgaaaaatgtggtattaccaaaaatca

SEQ ID NO: 21741 - DNA, 117 bp, Anaeromyces robustus
  Dockerin_dom_fun
atgtccagattatgccacaggatattcctgttgttatgaatgtaatattgtttataatgatggacatgattggggaattgaaaatggtaaatggtgttccattccatattcttgtaa

SEQ ID NO: 21742 - DNA, 99 bp, Anaeromyces robustus
  Dockerin_dom_fun
ctatgatgaatgtaaatcttgcttaacatattacattgaagatggtgtcaaatggggtgttgaaaacaatgactggtgtcttattccatctaaatgtga

SEQ ID NO: 21743 - DNA, 114 bp, Anaeromyces robustus
  Dockerin_dom_fun
tttttcttatccacaatatccatgttgtgaaggctgtacagttattgaagaaacagctgaaggtaaatggggtattgaaaatagtcaatggtgtggtattaaagattcttgctt

SEQ ID NO: 21744 - DNA, 117 bp, Anaeromyces robustus
  Dockerin_dom_fun
ttgggctggtcaattaggttacccatattgtacttctactactagagaagtttataaggataatgatggtaaatggggtattgaaaacaataattggtgttgtttatcatcatcagg

SEQ ID NO: 21745 - DNA, 120 bp, Anaeromyces robustus; identical to SEQ ID NO: 19091
  Dockerin_dom_fun

SEQ ID NO: 21746 - DNA, 114 bp, Anaeromyces robustus
  Dockerin_dom_fun
ttgttttgcaactagattaggttatgaatgttgtaattataatgaaattctttattcagatgatgatggagattggggtgttaatgataatcgttggtgtggtatcggtgcagg

SEQ ID NO: 21747 - DNA, 96 bp, Anaeromyces robustus
  Dockerin_dom_fun
taaatgttgtcaaaaatgtgaaatagtatatgaagataaagaaggtaaatggggagttgaaaatgatgaatggtgtgtcataggaagaaattgttg

SEQ ID NO: 21748 - DNA, 126 bp, Anaeromyces robustus
  Dockerin_dom_fun
ttggtctttaaaatatggttatccatgttgtaaagaaaatgctactactattcgtaaagataaaaatggtgaatggggatttgattttcaaaaatttagatggtgtggtatccaaaaaaaaaaaat

SEQ ID NO: 21749 - DNA, 117 bp, Anaeromyces robustus; identical to SEQ ID NO: 19096
  Dockerin_dom_fun

SEQ ID NO: 21750 - DNA, 120 bp, Anaeromyces robustus; identical to SEQ ID NO: 19095
  Dockerin_dom_fun

SEQ ID NO: 21751 - DNA, 123 bp, Anaeromyces robustus
  Dockerin_dom_fun
atgtttctcaattaaattaggatacccatgttgtaaaaaaactactgaagtagctcatattgataaaaatggtaaatggggtattgaagataatcattggtgtggtttaaaagataaaaagaa

SEQ ID NO: 21752 - DNA, 114 bp, Anaeromyces robustus
  Dockerin_dom_fun
atttgaagatcttggttttaaatgttgttcacattgtgttcatatctatgatgataaaactggtttatggggtgtcgaagccaatgaatggtgtggtatctctgatgaatgttt

SEQ ID NO: 21753 - DNA, 114 bp, Anaeromyces robustus; identical to SEQ ID NO: 19098
  Dockerin_dom_fun

SEQ ID NO: 21754 - DNA, 123 bp, Anaeromyces robustus; identical to SEQ ID NO: 19100
  Dockerin_dom_fun

SEQ ID NO: 21755 - DNA, 123 bp, Anaeromyces robustus; identical to SEQ ID NO: 19101
  Dockerin_dom_fun

SEQ ID NO: 21756 - DNA, 105 bp, Anaeromyces robustus
  Dockerin_dom_fun
ttcaggttatagttgttgtgtttctacaactaaagttttatcaggagatggtacaggtgattggggtgttgaatttaatgactggtgtttatttgatgaatctgc

SEQ ID NO: 21757 - DNA, 96 bp, Anaeromyces robustus
  Dockerin_dom_fun
taaatgttgtaaatcatcttgcagtgtttattatgttgatacggaagaatggggttatgaacatggtgaatggtgtttaattccttataaatgtaa

SEQ ID NO: 21758 - DNA, 123 bp, Anaeromyces robustus; identical to SEQ ID NO: 19104
  Dockerin_dom_fun

SEQ ID NO: 21759 - DNA, 93 bp, Anaeromyces robustus
  Dockerin_dom_fun
tccttgttgtaaaggttgtgatgtttattatactgatgatgtagaatggggtattgaaaatggtgattggtgttctattccatatgaatgtaa

SEQ ID NO: 21760 - DNA, 123 bp, Anaeromyces robustus
  Dockerin_dom_fun
atgctggtcacttagtcaaggttatccatgttgtgtaaataaaaacacaaaaataaaatctacttctagtaatggagatgaatggggtgttgaaaataatgaatggtgtggtataactgattt

SEQ ID NO: 21761 - DNA, 117 bp, Anaeromyces robustus
  Dockerin_dom_fun
atgttggtcagaaatatatggatactcatgttgtaaaggatgtattatttatgaatcggatgaaaatggtaaatggggttataaaaatggtaaatggtgtggtattccatcttattg

SEQ ID NO: 21762 - DNA, 123 bp, Anaeromyces robustus; identical to SEQ ID NO: 19107
  Dockerin_dom_fun

SEQ ID NO: 21763 - DNA, 117 bp, Anaeromyces robustus; identical to SEQ ID NO: 19109
  Dockerin_dom_fun

SEQ ID NO: 21764 - DNA, 126 bp, Anaeromyces robustus
  Dockerin_dom_fun
atgtttttctcaagcacttaatccatcttacccatgttgtaaaagtaataaagtcgtctatactgataaaagtggggattggggtgtagaaaatgatcaatggtgtggtattggaaatagtactac

SEQ ID NO: 21765 - DNA, 126 bp, Anaeromyces robustus
  Dockerin_dom_fun
atgttggtctgaagagcaaggctttccatgttgtaaaggatgtgtagttatttatactgaaaataatgaaaaatggggaatagaaaatgatgaatggtgtggtattaataaaacaacatgtcaaga

SEQ ID NO: 21766 - DNA, 94 bp, Anaeromyces robustus
  Dockerin_dom_fun
tgaatgttgtgaaacttgtacagagtattttagcgataatactggcagatatggatatgaaaatgaaaaatggtgtcttcttaaagatagttgc

SEQ ID NO: 21767 - DNA, 120 bp, Anaeromyces robustus
  Dockerin_dom_fun
ttcccatattttagatcaaggttataattgttgtattcatgattgtatttatattacttcagatgaaaatagaaattggagtgttgaaaatggagaatggtgttggtgtattatggataa

SEQ ID NO: 21768 - DNA, 129 bp, Anaeromyces robustus
  Dockerin_dom_fun
tacctgttggtctattcaatatggttatgaatgttgtaaagatccagaaactccagtatatagtaaagatagtactggggaatggggtattgaaaacaataattggtgtggaattgttaagaataataa

SEQ ID NO: 21769 - DNA, 96 bp, Anaeromyces robustus
  Dockerin_dom_fun
tgattgttgtccaaaaaatcaacccgtatatgaagaaaattctctcggaaaatggggtaaaattaatggaaattattgtggtataaaaacctctat

SEQ ID NO: 21770 - DNA, 120 bp, Anaeromyces robustus; identical to SEQ ID NO: 19115
  Dockerin_dom_fun

SEQ ID NO: 21771 - DNA, 111 bp, Anaeromyces robustus
  Dockerin_dom_fun
ttgctggtcaattccacttggttatccatgttgttctaattcctatcttccaacactttttacagatgataatggtgaatggagtgttgaaaatgataattggtgtggtaa

SEQ ID NO: 21772 - DNA, 120 bp, Anaeromyces robustus
  Dockerin_dom_fun
ttgtttttcagtgaaattaggttatccatgttgtcaatatacagatgaagtagtttatgttgatgatgatggggattggggtgttgaaaataatgactggtgtggtattggtgaagatct

SEQ ID NO: 21773 - DNA, 102 bp, Anaeromyces robustus
  Dockerin_dom_fun
aggttatgaatgttgtgaaggatgtacagttgaatctgaagaagataatattaaatggggttatgaaaatagaaattggtgtgtaattccatattcctgtaa

SEQ ID NO: 21774 - DNA, 108 bp, Anaeromyces robustus; identical to SEQ ID NO: 19121
  Dockerin_dom_fun

SEQ ID NO: 21775 - DNA, 114 bp, Anaeromyces robustus; identical to SEQ ID NO: 19120
  Dockerin_dom_fun

SEQ ID NO: 21776 - DNA, 114 bp, Anaeromyces robustus; identical to SEQ ID NO: 19123
  Dockerin_dom_fun

SEQ ID NO: 21777 - DNA, 120 bp, Anaeromyces robustus
  Dockerin_dom_fun
atgttgggctgaatttattggatatccatgttgttcagaaaaggatacatatgtttacgatacagatagttatggtgattggagttatgatttcgataataatgaatggtgtggtcttac

SEQ ID NO: 21778 - DNA, 120 bp, Anaeromyces robustus; identical to SEQ ID NO: 19124
  Dockerin_dom_fun

SEQ ID NO: 21779 - DNA, 123 bp, Anaeromyces robustus
  Dockerin_dom_fun
ttgttgggcaacacgtcttggttttccatgttgtgaatattctgcacaagttttttatacagataatgatggtaagtggagtattgaaaatggtgaatggtgtggtataattgaaaatcaaaa

SEQ ID NO: 21780 - DNA, 126 bp, Anaeromyces robustus
  Dockerin_dom_fun
ttgttgggctacttctataggttatggatgttgtaatcactgtaattctatatatacagatggtacatacagatggggtgttcaaaataatcaatggtgtggtattattgaatccaattgtaaaaa

SEQ ID NO: 21781 - DNA, 123 bp, Anaeromyces robustus; identical to SEQ ID NO: 19127
  Dockerin_dom_fun

SEQ ID NO: 21782 - DNA, 111 bp, Anaeromyces robustus
  Dockerin_dom_fun
tacaaagcttggatattcttgttgtaaaacttgtatggtagctttaactgataaagatggtaaatggggtgttgaaaataagaactggtgtggaattgattcagtttgtaa

SEQ ID NO: 21783 - DNA, 99 bp, Anaeromyces robustus
  Dockerin_dom_fun
taattgctgtaaaaccaatactgaaattctctattcagatgatgaaggtgcatggggttatgaaaatgatgcctggtgtattgtaagaaaatttgaatg

SEQ ID NO: 21784 - DNA, 126 bp, Anaeromyces robustus
  Dockerin_dom_fun
atgttgggctgaaaaatacggaagaccttgttgtaaaaacagttcaactaaaaatgtttatactgataatgaaggtatgtggggtgttgaaaatgatgaatggtgtggtataactgaagaacaatg

SEQ ID NO: 21785 - DNA, 123 bp, Anaeromyces robustus
  Dockerin_dom_fun
ttgggccaaaaaatacggaagaccttgttgtttaaataatttaactgaatatgtttatgctgatgatgaaggtatgtggggtgttgaaaacggtgattggtgtggtataaatgaacatcaatg

SEQ ID NO: 21786 - DNA, 120 bp, Anaeromyces robustus
  Dockerin_dom_fun
ttgggcccaaaaattaggatttaaatgttgtaagaatccaaatgcaacagttattaacattgatgaagacggtacaaaatggggtattgaaaatgatgaatggtgtggtattttagaaat

SEQ ID NO: 21787 - DNA, 123 bp, Anaeromyces robustus
  Dockerin_dom_fun
taaatctgaaaaactcggtattgaatgttgtaaagatatttcaactgaaaatgtttatactgatgatgaaggtattaagtttggtgttgaaaaagatgattggtgtggtattaaggatattga

SEQ ID NO: 21788 - DNA, 102 bp, Anaeromyces robustus
  Dockerin_dom_fun
tccatgttgtaatggctgtgatgttaaatacactgataacagtggtaaatggggtgttgaaaataataattggtgtaaaatagataataataaatgtaattc

SEQ ID NO: 21789 - DNA, 120 bp, Anaeromyces robustus; identical to SEQ ID NO: 19135
  Dockerin_dom_fun

SEQ ID NO: 21790 - DNA, 126 bp, Anaeromyces robustus; identical to SEQ ID NO: 19136
  Dockerin_dom_fun

SEQ ID NO: 21791 - DNA, 123 bp, Anaeromyces robustus; identical to SEQ ID NO: 19137
  Dockerin_dom_fun

SEQ ID NO: 21792 - DNA, 117 bp, Anaeromyces robustus
  Dockerin_dom_fun
ttggtcaaaagaattaggttttccatgttgtaaaggatgtttagttattgataaagatgaatttggatcatggggatttgaattagatcattggtgtggtattcaatcctattgtaa

SEQ ID NO: 21793 - DNA, 123 bp, Anaeromyces robustus; identical to SEQ ID NO: 19139
  Dockerin_dom_fun

SEQ ID NO: 21794 - DNA, 123 bp, Anaeromyces robustus
  Dockerin_dom_fun
ttgttgggctgaacttttaggatataattgttgtaaaagtaagaatccaattattattcaaactgatgaatatggtgattgggcaattgaaaagaataattggtgtggtattccaggtagtta

SEQ ID NO: 21795 - DNA, 120 bp, Anaeromyces robustus; identical to SEQ ID NO: 19140
  Dockerin_dom_fun

SEQ ID NO: 21796 - DNA, 117 bp, Anaeromyces robustus; identical to SEQ ID NO: 19143
  Dockerin_dom_fun

SEQ ID NO: 21797 - DNA, 120 bp, Anaeromyces robustus; identical to SEQ ID NO: 19146
  Dockerin_dom_fun

SEQ ID NO: 21798 - DNA, 111 bp, Anaeromyces robustus; identical to SEQ ID NO: 19144
  Dockerin_dom_fun

SEQ ID NO: 21799 - DNA, 93 bp, Anaeromyces robustus
  Dockerin_dom_fun
cccatgttgtaaaaattcaaaagccaaaatgcaagcatttgaaatggacggatttcttggtgttgaaaataattcttattgtggtataaaagg

SEQ ID NO: 21800 - DNA, 123 bp, Anaeromyces robustus; identical to SEQ ID NO: 19145
  Dockerin_dom_fun

SEQ ID NO: 21801 - DNA, 123 bp, Anaeromyces robustus; identical to SEQ ID NO: 19142
  Dockerin_dom_fun

SEQ ID NO: 21802 - DNA, 120 bp, Anaeromyces robustus
  Dockerin_dom_fun
atgttgggctgaacttgctggttacccatgttgttctgaaagaataaagattgtttatgaacatgatgaatttggtgattggggttatgattactctattaaacaatggtgtggtcttac

SEQ ID NO: 21803 - DNA, 117 bp, Anaeromyces robustus
  Dockerin_dom_fun
ttggtcagaagtatttggttatccatgttgtgaaagttgttacgtttttgaaactgatgattatggaaaatggggttatgaaaataatcattggtgtggtattcaatcttactgctc

SEQ ID NO: 21804 - DNA, 120 bp, Anaeromyces robustus; identical to SEQ ID NO: 19150
  Dockerin_dom_fun

SEQ ID NO: 21805 - DNA, 117 bp, Anaeromyces robustus
  Dockerin_dom_fun
atgtttatcagaattaatcggatatgcatgttgttcattagaattaacatccatttatactgatgaatatggagattggggttatgattataataaaaaagaatggtgtggccttac

SEQ ID NO: 21806 - DNA, 120 bp, Anaeromyces robustus; identical to SEQ ID NO: 19152
  Dockerin_dom_fun

SEQ ID NO: 21807 - DNA, 120 bp, Anaeromyces robustus; identical to SEQ ID NO: 19151
  Dockerin_dom_fun

SEQ ID NO: 21808 - DNA, 120 bp, Anaeromyces robustus; identical to SEQ ID NO: 19153
  Dockerin_dom_fun

SEQ ID NO: 21809 - DNA, 120 bp, Anaeromyces robustus
  Dockerin_dom_fun
atgttggtctgaagctttaggttacaaatgttgttcaaaaggttgtgatgctgtagttttagctattgacaatagtggtaactggggagctgaaaatggtgaatggtgtggtattcaatg

SEQ ID NO: 21810 - DNA, 123 bp, Anaeromyces robustus; identical to SEQ ID NO: 19155
  Dockerin_dom_fun

SEQ ID NO: 21811 - DNA, 117 bp, Anaeromyces robustus; identical to SEQ ID NO: 19156
  Dockerin_dom_fun

SEQ ID NO: 21812 - DNA, 120 bp, Anaeromyces robustus; identical to SEQ ID NO: 19158
  Dockerin_dom_fun

SEQ ID NO: 21813 - DNA, 114 bp, Anaeromyces robustus
  Dockerin_dom_fun
ctgttgggcaaataatttaggttatccatgttgttcaagtaatactcaagtaatttatacagataataatggtcaatggggtgttgaaaacaataattggtgtggtattgttaa

SEQ ID NO: 21814 - DNA, 123 bp, Anaeromyces robustus; identical to SEQ ID NO: 19159
  Dockerin_dom_fun

SEQ ID NO: 21815 - DNA, 126 bp, Anaeromyces robustus
  Dockerin_dom_fun
tacttgttggtcaagcggttatggctacccatgttgtactacatgtaaggtttattacgaagattactctggtgaatggggtgtagaaaatggcgattggtgtggtatcgttagtcaatattgtgg

SEQ ID NO: 21816 - DNA, 55 bp, Anaeromyces robustus
  Dockerin_dom_fun
ttgctgggctgaaaaattaggttactcttgctgtacttctacttctcaagttgtt

SEQ ID NO: 21817 - DNA, 114 bp, Anaeromyces robustus
  Dockerin_dom_fun
ttgctgggctgaaaaattaggttactcttgctgtacttctacttctcaagttgtttacactgatggtgatggtaactggggtgttgaaaacggtaactggtgtggtattccagt

SEQ ID NO: 21818 - DNA, 126 bp, Anaeromyces robustus; identical to SEQ ID NO: 19162
  Dockerin_dom_fun

SEQ ID NO: 21819 - DNA, 102 bp, Anaeromyces robustus
  Dockerin_dom_fun
tcttggatacccatgttgtaatgattgtagagttgtttaccaagatgaatataactggggtgttttaaataaccaatggtgtgtaactccatattcatgtga

SEQ ID NO: 21820 - DNA, 124 bp, Anaeromyces robustus; identical to SEQ ID NO: 19164
  Dockerin_dom_fun

SEQ ID NO: 21821 - DNA, 117 bp, Anaeromyces robustus; identical to SEQ ID NO: 19165
  Dockerin_dom_fun

SEQ ID NO: 21822 - DNA, 120 bp, Anaeromyces robustus; identical to SEQ ID NO: 19166
  Dockerin_dom_fun

SEQ ID NO: 21823 - DNA, 129 bp, Anaeromyces robustus
  Dockerin_dom_fun
ttgttgggctgaagtacttggattcccatgttgtagcaccgataaatgtagaactgtctatttcactgatgatgatggtgaatgggatgttgaaaacaataattggtgtggtattactgcttctaacaa

SEQ ID NO: 21824 - DNA, 123 bp, Anaeromyces robustus; identical to SEQ ID NO: 19169
  Dockerin_dom_fun

SEQ ID NO: 21825 - DNA, 84 bp, Anaeromyces robustus
  Dockerin_dom_fun
taaatgttgtaaaagttgtgatatattttatgttgataattataaatggggtgttgaaaataatgaatggtgttctattccatt

SEQ ID NO: 21826 - DNA, 93 bp, Anaeromyces robustus
  Dockerin_dom_fun
ttacccatgctgtgaaaatacttgtgctgttcaatatactgacgctgatggtcaatggggtattgaaaatggaaattggtgtggtatgagtag

SEQ ID NO: 21827 - DNA, 93 bp, Anaeromyces robustus; identical to SEQ ID NO: 21826
  Dockerin_dom_fun

SEQ ID NO: 21828 - DNA, 114 bp, Anaeromyces robustus; identical to SEQ ID NO: 19173
  Dockerin_dom_fun

SEQ ID NO: 21829 - DNA, 114 bp, Anaeromyces robustus; identical to SEQ ID NO: 19172
  Dockerin_dom_fun

SEQ ID NO: 21830 - DNA, 111 bp, Anaeromyces robustus; identical to SEQ ID NO: 16637
  Dockerin_dom_fun

SEQ ID NO: 21831 - DNA, 108 bp, Anaeromyces robustus
  Dockerin_dom_fun
tgaagatatgggttacactatttgtcccgtaggaactaaaataacttatgctaatacgcaggccacttggggtaaaaataatgatgattggtgtgtaatccttgaaaa

SEQ ID NO: 21832 - DNA, 120 bp, Anaeromyces robustus
  Dockerin_dom_fun
ttgttggtctgaaatttttggttattcatgttgtaaaggatgtactatttatgaagttgataatgatggttcatggggttatgaaaatggagaatggtgtggtattcaatcctattgttc

SEQ ID NO: 21833 - DNA, 117 bp, Anaeromyces robustus
  Dockerin_dom_fun
tattgctgaattaattggttataaatgttgttcaccaaataatactaaagtatatgcacatgatgaaaatggtgattggggttatgattttaaaaaaggagaatggtgtggtcttac

SEQ ID NO: 21834 - DNA, 103 bp, Anaeromyces robustus; identical to SEQ ID NO: 19178
  Dockerin_dom_fun

SEQ ID NO: 21835 - DNA, 117 bp, Anaeromyces robustus; identical to SEQ ID NO: 19179
  Dockerin_dom_fun

SEQ ID NO: 21836 - DNA, 123 bp, Anaeromyces robustus
  Dockerin_dom_fun
atgctggtctcttatattaggttataagtgctgtagttcatgcttacctattgtggaaacagatagtagtggtaattggagtattgaagataatcaatggtgtggtcttgaagaaagatgtaa

SEQ ID NO: 21837 - DNA, 120 bp, Anaeromyces robustus; identical to SEQ ID NO: 19180
  Dockerin_dom_fun

SEQ ID NO: 21838 - DNA, 117 bp, Anaeromyces robustus
  Dockerin_dom_fun
tttttcagaacgtttaggtttcccatgttgtccacctggtacaaaagttgaatactctgatgaggaaggggattggggtattataaacgaagaatggtgtggtattagtgatcgtgg

SEQ ID NO: 21839 - DNA, 117 bp, Anaeromyces robustus
  Dockerin_dom_fun
ttgggctgaagaatttggttatccatgttgttcaaatcttaataataaaattgtttattacattgatgaatatggtaataaatggggtgttgaaaatgatgattggtgtggtttaat

SEQ ID NO: 21840 - DNA, 45 bp, Anaeromyces robustus
  Dockerin_dom_fun
tcaatggagtgttgaaaatgataattggtgtggtattccaaaagg

SEQ ID NO: 21841 - DNA, 117 bp, Anaeromyces robustus; identical to SEQ ID NO: 19184
  Dockerin_dom_fun

SEQ ID NO: 21842 - DNA, 117 bp, Anaeromyces robustus
  Dockerin_dom_fun
ttggtctgaagctttaggttacccatgttgttctacttgttccagtcctgtctacagtgataatgatggtaactggggtgttgaaaatggtgactggtgtggtattactaaggctca

SEQ ID NO: 21843 - DNA, 39 bp, Anaeromyces robustus
  Dockerin_dom_fun
ttggtctgaagctttaggttacccatgttgttctacttg

SEQ ID NO: 21844 - DNA, 39 bp, Anaeromyces robustus
  Dockerin_dom_fun
tgttgaaaatggtgactggtgtggtattactaaggctca

SEQ ID NO: 21845 - DNA, 73 bp, Anaeromyces robustus
  Dockerin_dom_fun
tccatgttgtagtcattgtgatgtattatttactgatagaactgctcgttggggtattgaaaacaatgattgg

SEQ ID NO: 21846 - DNA, 126 bp, Anaeromyces robustus; identical to SEQ ID NO: 19186
  Dockerin_dom_fun

SEQ ID NO: 21847 - DNA, 114 bp, Anaeromyces robustus; identical to SEQ ID NO: 19188
  Dockerin_dom_fun

SEQ ID NO: 21848 - DNA, 114 bp, Anaeromyces robustus; identical to SEQ ID NO: 19188
  Dockerin_dom_fun

SEQ ID NO: 21849 - DNA, 96 bp, Anaeromyces robustus
  Dockerin_dom_fun
ttataaatgttgttcatcatgtattgtttatttcgaagataattataaatggggaactatgaatggtgaatggtgtagtcttacttatgattgtct

SEQ ID NO: 21850 - DNA, 120 bp, Anaeromyces robustus
  Dockerin_dom_fun
tcaatgttgggctgaagcttatggttatagttgttgtagtaaatgtgttaaagttattgatacctcatataataaaaaatggggtttagaaaatggaaaatggtgtggtcttccatctta

SEQ ID NO: 21851 - DNA, 93 bp, Anaeromyces robustus; identical to SEQ ID NO: 19192
  Dockerin_dom_fun

SEQ ID NO: 21852 - DNA, 120 bp, Anaeromyces robustus
  Dockerin_dom_fun
ttgtttttctttagcccaaggttatccatgttgtcaatcgtgcaaagtattatacactgataaatctggtaaatggggtgtagaaaatggtaaatggtgtggtataaaggacaattgtac

SEQ ID NO: 21853 - DNA, 108 bp, Anaeromyces robustus; identical to SEQ ID NO: 19194
  Dockerin_dom_fun

SEQ ID NO: 21854 - DNA, 117 bp, Anaeromyces robustus; identical to SEQ ID NO: 19193
  Dockerin_dom_fun

SEQ ID NO: 21855 - DNA, 114 bp, Anaeromyces robustus; identical to SEQ ID NO: 19195
  Dockerin_dom_fun

SEQ ID NO: 21856 - DNA, 57 bp, Anaeromyces robustus; identical to SEQ ID NO: 19196
  Dockerin_dom_fun

SEQ ID NO: 21857 - DNA, 123 bp, Anaeromyces robustus; identical to SEQ ID NO: 19198
  Dockerin_dom_fun

SEQ ID NO: 21858 - DNA, 117 bp, Anaeromyces robustus
  Dockerin_dom_fun
ttggtctgagaccctgggttatccatgttgtaatactaatggatgtcaaactatttatttcatcgattcaaatggtatgtggagtgttgaaaatgataattggtgtggtataactcc

SEQ ID NO: 21859 - DNA, 123 bp, Anaeromyces robustus; identical to SEQ ID NO: 19200
  Dockerin_dom_fun

SEQ ID NO: 21860 - DNA, 108 bp, Anaeromyces robustus; identical to SEQ ID NO: 19199
  Dockerin_dom_fun

SEQ ID NO: 21861 - DNA, 123 bp, Anaeromyces robustus; identical to SEQ ID NO: 19200
  Dockerin_dom_fun

SEQ ID NO: 21862 - DNA, 108 bp, Anaeromyces robustus; identical to SEQ ID NO: 19199
  Dockerin_dom_fun

SEQ ID NO: 21863 - DNA, 129 bp, Anaeromyces robustus
  Dockerin_dom_fun
tttttcaaaatttttaggatctccatatccatgttgtagtccagacaatcaaaaaatagaatttattgatcatgatggtttatggggtagagaaaacggtaaatggtgtggaataatgaatagtaaacc

SEQ ID NO: 21864 - DNA, 105 bp, Anaeromyces robustus; identical to SEQ ID NO: 19203
  Dockerin_dom_fun

SEQ ID NO: 21865 - DNA, 60 bp, Anaeromyces robustus
  Dockerin_dom_fun
ctggtcaactaaattaggatatccatgttgtagtgccggtaacaaagatgtttattataa

SEQ ID NO: 21866 - DNA, 129 bp, Anaeromyces robustus
  Dockerin_dom_fun
ttcttgctggtcaactaaattaggatatccatgttgtagtgccggtaacaaagatgtttattataatgacgatgatggattatggggtgttgaaaataataactggtgtggtattccttctaattcttg

SEQ ID NO: 21867 - DNA, 99 bp, Anaeromyces robustus
  Dockerin_dom_fun
tccatattgtgatggatgtgatgcaaattatgttgataaagatggtcgttggaatttagttgataaaacatggtgtaaagttaaggaaaagaaatgttt

SEQ ID NO: 21868 - DNA, 96 bp, Anaeromyces robustus
  Dockerin_dom_fun
atatcaatgttgtaaagattcatccactcaagttatcttaacagatgatgatggtacttggggtattgaaaataatcattggtgtcatattaaaac

SEQ ID NO: 21869 - DNA, 120 bp, Anaeromyces robustus; identical to SEQ ID NO: 19208
  Dockerin_dom_fun

SEQ ID NO: 21870 - DNA, 42 bp, Anaeromyces robustus
  Dockerin_dom_fun
tattgaaaataatcaatggtgtggtattccatcttcatgtaa

SEQ ID NO: 21871 - DNA, 120 bp, Anaeromyces robustus; identical to SEQ ID NO: 19210
  Dockerin_dom_fun

SEQ ID NO: 21872 - DNA, 117 bp, Anaeromyces robustus
  Dockerin_dom_fun
atgctggtcattaaaacatggatatccatgttgtcaaaaaactaaagttgttactcttgaagatgaaaatggaaaatggggtgttgaaaatgatgattggtgtggtattattgatga

SEQ ID NO: 21873 - DNA, 123 bp, Anaeromyces robustus; identical to SEQ ID NO: 19211
  Dockerin_dom_fun

SEQ ID NO: 21874 - DNA, 48 bp, Anaeromyces robustus
  Dockerin_dom_fun
gggtgttgaaaataatgaatggtgtttaattaagaaatctaaatgtgg

SEQ ID NO: 21875 - DNA, 124 bp, Anaeromyces robustus; identical to SEQ ID NO: 19212
  Dockerin_dom_fun

SEQ ID NO: 21876 - DNA, 123 bp, Anaeromyces robustus
  Dockerin_dom_fun
atgttggtctgaagtttttggttttccatgttgtacttcttcatgtcatgtttatgaaattgatgatagtggtgaatggggttatgaagataatcattggtgtggtattccatctacttgtaa

SEQ ID NO: 21877 - DNA, 109 bp, Anaeromyces robustus
  Dockerin_dom_fun
cgaatgttgggctaatgaacttggttacaaatgttgtccaaaaggttgtgatgctactgtcgttgttgaagatgatctcggtaaatggggtatccttggtggtgaatgg

SEQ ID NO: 21878 - DNA, 129 bp, Anaeromyces robustus; identical to SEQ ID NO: 19215
  Dockerin_dom_fun

SEQ ID NO: 21879 - DNA, 129 bp, Anaeromyces robustus
  Dockerin_dom_fun
taaatgttggtcagaattaattggatatccatgttgtgattcttccgtaacaaccgtatttgttcaagatgattatggagattggggatatgattttaataaaaatgaatggtgtggaataacttccta

SEQ ID NO: 21880 - DNA, 105 bp, Anaeromyces robustus
  Dockerin_dom_fun
aggttatgcttgttgtaaatttaatactactactgttactactaccgattatactggtaaatggggtattgaaggtttaagatattgtcttatcgatgaagatgc

SEQ ID NO: 21881 - DNA, 114 bp, Anaeromyces robustus
  Dockerin_dom_fun
aaaaggatatccatgttgtactaaaaagacaagtaatgttaattatattagtaaaaatggagatcaatatggttatgaaaataataaatggtgtggtataacaactattcaatg

SEQ ID NO: 21882 - DNA, 123 bp, Anaeromyces robustus
  Dockerin_dom_fun
ttgttggtctaaagaatatggcatcagttgttgtgaagataaagcaactcaagtagaatacattgaaacaaatagtggaagagaatttggtgttgaaaatggacatatttgtggtataaatga

SEQ ID NO: 21883 - DNA, 93 bp, Anaeromyces robustus
  Dockerin_dom_fun
caagtgttgtaattcttgtaaagttcgttacaccgatgactatgaatggggtgttgaaggtggtgaatggtgttctattccttactcttgtaa

SEQ ID NO: 21884 - DNA, 93 bp, Anaeromyces robustus
  Dockerin_dom_fun
caagtgttgtaattcttgtaaagttcgttacaccgataattatgaatggggtgttgaagatggtgaatggtgttctattccttactcttgtaa

SEQ ID NO: 21885 - DNA, 123 bp, Anaeromyces robustus
  Dockerin_dom_fun
atgttggtcagaattaattggatataaatgttgtgctcctaatgttactgcaatttatgcaagtgatgaatatggatattggggttatgactttgaaaataatgaatggtgtggtattaccac

SEQ ID NO: 21886 - DNA, 72 bp, Anaeromyces robustus
  Dockerin_dom_fun
ttgttggtcacaaaaatatggttatccatgttgtcaaacttgtatagtatatcataatgataatgaaggttc

SEQ ID NO: 21887 - DNA, 123 bp, Anaeromyces robustus; identical to SEQ ID NO: 21885
  Dockerin_dom_fun

SEQ ID NO: 21888 - DNA, 120 bp, Anaeromyces robustus; identical to SEQ ID NO: 19222
  Dockerin_dom_fun

SEQ ID NO: 21889 - DNA, 117 bp, Anaeromyces robustus
  Dockerin_dom_fun
atgttggtctgaaaaaatcggatataaatgttgtactgatgcagaaatttatttaacagacacatttggacattggagtattgaagatggagaatggtgtcttgttaaacgaagttg

SEQ ID NO: 21890 - DNA, 126 bp, Anaeromyces robustus; identical to SEQ ID NO: 19225
  Dockerin_dom_fun

SEQ ID NO: 21891 - DNA, 123 bp, Anaeromyces robustus; identical to SEQ ID NO: 19228
  Dockerin_dom_fun

SEQ ID NO: 21892 - DNA, 117 bp, Anaeromyces robustus
  Dockerin_dom_fun
ttttgccgaaaaattaggttattcatgttgtatatctccttcatcggctgttttacatgaagataaagatggtaaatggggtattgaatatggtaaatggtgtggtttgccttatga

SEQ ID NO: 21893 - DNA, 117 bp, Anaeromyces robustus
  Dockerin_dom_fun
ttgtttttctgaaaaattaggttttccttgttgttcagatccttcaactgttgtagtatttgtagatgaaagtagtgaatggggcgtcgaaaatgatggatggtgtggttttcctta

SEQ ID NO: 21894 - DNA, 114 bp, Anaeromyces robustus
  Dockerin_dom_fun
tttttctgaaaaattaggttttccttgttgttcagatccttcaactgttatagtatttgtagatgaaagtggtgaatggggcgtcgaaaatgatggatggtgtggttttcctta

SEQ ID NO: 21895 - DNA, 120 bp, Anaeromyces robustus; identical to SEQ ID NO: 19230
  Dockerin_dom_fun

SEQ ID NO: 21896 - DNA, 114 bp, Anaeromyces robustus
  Dockerin_dom_fun
tttctcagaaccatattttccatgttgtaaagaaaataaagttgtattagttgatgaagaaggtgaatggggtatagaaaataaaaaatggtgtggtatttcttccagtaacaa

SEQ ID NO: 21897 - DNA, 129 bp, Anaeromyces robustus
  Dockerin_dom_fun
atgttggtcagaagaacaaggatattcatgttgtcaaggatgtaatattcttttagttgaagaaggacaacaaaaatggggatttgaaaataataaatggtgtggaattgttgaaagtgtttgtcaaca

SEQ ID NO: 21898 - DNA, 63 bp, Anaeromyces robustus; identical to SEQ ID NO: 16696
  Dockerin_dom_fun

SEQ ID NO: 21899 - DNA, 120 bp, Anaeromyces robustus; identical to SEQ ID NO: 19233
  Dockerin_dom_fun

SEQ ID NO: 21900 - DNA, 114 bp, Anaeromyces robustus
  Dockerin_dom_fun
atctattttaagccaaggttataaatgttgttctgacaattgtcttgttgtatatactgatgatgatggtacatggggttatgaaaatgataaatggtgtggatgtgaacaaaa

SEQ ID NO: 21901 - DNA, 106 bp, Anaeromyces robustus
  Dockerin_dom_fun
aggttattcatgttgtagtgaaaataactgtaaaataagatatgtagatgaagatggtaattggggtgctgaaaacggccaatggtgcggtatttctaacaaatgt

SEQ ID NO: 21902 - DNA, 117 bp, Anaeromyces robustus
  Dockerin_dom_fun
ttggtccaatgaatataattatccttgttgtaaaacttgtatagtatatgaaatagatgataaaggatcatggggttatgaaaataatgaatggtgtggtattccatctcattgtaa

SEQ ID NO: 21903 - DNA, 126 bp, Anaeromyces robustus; identical to SEQ ID NO: 19236
  Dockerin_dom_fun

SEQ ID NO: 21904 - DNA, 103 bp, Anaeromyces robustus
  Dockerin_dom_fun
atcaaccattactaacaaaggttattcatgttgttcaacatgttccaaagttcgttatgttgatgaagatggtaaatggggtgttgaaaaccatcaatggtgt

SEQ ID NO: 21905 - DNA, 126 bp, Anaeromyces robustus; identical to SEQ ID NO: 19238
  Dockerin_dom_fun

SEQ ID NO: 21906 - DNA, 123 bp, Anaeromyces robustus; identical to SEQ ID NO: 19240
  Dockerin_dom_fun

SEQ ID NO: 21907 - DNA, 120 bp, Anaeromyces robustus; identical to SEQ ID NO: 19242
  Dockerin_dom_fun

SEQ ID NO: 21908 - DNA, 120 bp, Anaeromyces robustus; identical to SEQ ID NO: 19241
  Dockerin_dom_fun

SEQ ID NO: 21909 - DNA, 103 bp, Anaeromyces robustus
  Dockerin_dom_fun
tattacttcccaaggatacaaatgttgttcaaaggattgtttcatagtttttactgatgatgatggtacatggggtattgaaaatgatcaatggtgtggttgt

SEQ ID NO: 21910 - DNA, 66 bp, Anaeromyces robustus
  Dockerin_dom_fun
agtttttactgatgatgatggtacatggggtattgaaaatgatcaatggtgtggttgtgatactcc

SEQ ID NO: 21911 - DNA, 117 bp, Anaeromyces robustus; identical to SEQ ID NO: 19245
  Dockerin_dom_fun

SEQ ID NO: 21912 - DNA, 73 bp, Anaeromyces robustus; identical to SEQ ID NO: 16709
  Dockerin_dom_fun

SEQ ID NO: 21913 - DNA, 120 bp, Anaeromyces robustus; identical to SEQ ID NO: 19246
  Dockerin_dom_fun

SEQ ID NO: 21914 - DNA, 120 bp, Anaeromyces robustus; identical to SEQ ID NO: 19248
  Dockerin_dom_fun

SEQ ID NO: 21915 - DNA, 120 bp, Anaeromyces robustus
  Dockerin_dom_fun
atgtttttcagttaaattaggatatccatgttgtactaaaactaatgaagttatttacactgatgaacaaggtcaatggggtgttgaagattatcattggtgtggtattgataacactca

SEQ ID NO: 21916 - DNA, 132 bp, Anaeromyces robustus
  Dockerin_dom_fun
gtgttggtcattaaaattacaaccagcttatccatgttgttatatgagaaataaagaagttgtatccattgattctaatggtaaatggagtactgaacatggtacatggtgtggcataattgaagaacaaga

SEQ ID NO: 21917 - DNA, 75 bp, Anaeromyces robustus; identical to SEQ ID NO: 16720
  Dockerin_dom_fun

SEQ ID NO: 21918 - DNA, 120 bp, Anaeromyces robustus; identical to SEQ ID NO: 19251
  Dockerin_dom_fun

SEQ ID NO: 21919 - DNA, 123 bp, Anaeromyces robustus; identical to SEQ ID NO: 19253
  Dockerin_dom_fun

SEQ ID NO: 21920 - DNA, 106 bp, Anaeromyces robustus; identical to SEQ ID NO: 16723
  Dockerin_dom_fun

SEQ ID NO: 21921 - DNA, 69 bp, Anaeromyces robustus
  Dockerin_dom_fun
taacgtatattacacagataatgatggtgaatggggtgtagaaaatggaaattggtgtggtattggtgg

SEQ ID NO: 21922 - DNA, 39 bp, Anaeromyces robustus
  Dockerin_dom_fun
ctgggctactaagcttggttataagtgttgtactgctaa

SEQ ID NO: 21923 - DNA, 126 bp, Anaeromyces robustus
  Dockerin_dom_fun
ttgctgggctactaagcttggttataagtgttgtactgctaaatgtccagaagtttcttacgttgaccaagatggtgcttggggtattgaaaatggtaattggtgtggtattattgaaagttcttg

SEQ ID NO: 21924 - DNA, 105 bp, Anaeromyces robustus; identical to SEQ ID NO: 19257
  Dockerin_dom_fun

SEQ ID NO: 21925 - DNA, 111 bp, Anaeromyces robustus
  Dockerin_dom_fun
taatgcttacaataactgtactcacacttgtagagtattagttactgaagacggtgttgaatggggagctgaaaataatgactggtgcattattgatcaatctctctgtgt

SEQ ID NO: 21926 - DNA, 96 bp, Anaeromyces robustus
  Dockerin_dom_fun
tctttgttgtaatgaatgtaatgttgtattagaagatgaagaaggtaaatggggttatgaaaacaacagatggtgtggtatcaaggatacttgtac

SEQ ID NO: 21927 - DNA, 111 bp, Anaeromyces robustus; identical to SEQ ID NO: 21925
  Dockerin_dom_fun

SEQ ID NO: 21928 - DNA, 96 bp, Anaeromyces robustus; identical to SEQ ID NO: 21926
  Dockerin_dom_fun

SEQ ID NO: 21929 - DNA, 108 bp, Anaeromyces robustus; identical to SEQ ID NO: 16731
  Dockerin_dom_fun

SEQ ID NO: 21930 - DNA, 108 bp, Anaeromyces robustus
  Dockerin_dom_fun
attcttatataattgttgtaaaaatacctgtaaattagttgccatacaagataaaatacaattaggtattgaaaatggtgaatattgttctataccttattcttgttt

SEQ ID NO: 21931 - DNA, 69 bp, Anaeromyces robustus; identical to SEQ ID NO: 16733
  Dockerin_dom_fun

SEQ ID NO: 21932 - DNA, 126 bp, Anaeromyces robustus
  Dockerin_dom_fun
tataggtgaagttgctggttatccatgttgttcagaaggtgttaataaagtttatgaacatgatattaatggagaatggggttatgatttcagtaagaaacaatggtgtagtcttacaccatcaaa

SEQ ID NO: 21933 - DNA, 114 bp, Anaeromyces robustus; identical to SEQ ID NO: 19265
  Dockerin_dom_fun

SEQ ID NO: 21934 - DNA, 99 bp, Anaeromyces robustus
  Dockerin_dom_fun
cccatgttgtacttcaactaaaactgtaatgtatactgatgaaaagggaccatggggtattgaaaatggtaactggtgtggtattaaagattcttgtac

SEQ ID NO: 21935 - DNA, 72 bp, Anaeromyces robustus
  Dockerin_dom_fun
tgttatattcactgattctaacggtcaatggggtattgaaaatggtaactggtgtggtaaaccaaacagtaa

SEQ ID NO: 21936 - DNA, 94 bp, Anaeromyces robustus; identical to SEQ ID NO: 19268
  Dockerin_dom_fun

SEQ ID NO: 21937 - DNA, 106 bp, Anaeromyces robustus; identical to SEQ ID NO: 16723
  Dockerin_dom_fun

SEQ ID NO: 21938 - DNA, 48 bp, Anaeromyces robustus
  Dockerin_dom_fun
ttggggtgttgaagatggtcaatggtgtggtataactaaaaattgtgg

SEQ ID NO: 21939 - DNA, 91 bp, Anaeromyces robustus; identical to SEQ ID NO: 16739
  Dockerin_dom_fun

SEQ ID NO: 21940 - DNA, 97 bp, Anaeromyces robustus
  Dockerin_dom_fun
tattacttcccaaggttacaagtgttgtaaagaagataactgttcagtttttgaaactgatgatgatggtacatggggtattgaaaatgatcaatgg

SEQ ID NO: 21941 - DNA, 84 bp, Anaeromyces robustus
  Dockerin_dom_fun
agctgtaatttaccatgataacgatggtgactggggtgttgaaaataaccaatggtgtttaattaagagtagtaaatgtaatgt

SEQ ID NO: 21942 - DNA, 97 bp, Piromyces finnis
  Dockerin_dom_fun
ttgggccgaagctcttggttacaagtgttgttcagctggtaactacatggttcttcttacagatgaaagtggagcctggggtgccgaaaatggagaa

SEQ ID NO: 21943 - DNA, 82 bp, Piromyces finnis; identical to SEQ ID NO: 16742
  Dockerin_dom_fun

SEQ ID NO: 21944 - DNA, 109 bp, Piromyces finnis; identical to SEQ ID NO: 19277
  Dockerin_dom_fun

SEQ ID NO: 21945 - DNA, 93 bp, Piromyces finnis
  Dockerin_dom_fun
ttgttgtacaaagacagatactcatgtttcatttattgatgatgaaaaatctttatggggtattgaatcaggatcatggtgtaaaataaatat

SEQ ID NO: 21946 - DNA, 120 bp, Piromyces finnis; identical to SEQ ID NO: 19278
  Dockerin_dom_fun

SEQ ID NO: 21947 - DNA, 120 bp, Piromyces finnis
  Dockerin_dom_fun
atgttcatttgaagtattaggatatcattgttgttcatctattaatccaaaagttgtcaaagaagattcatatggaaaatggggtgaagaagatggagaattatgtggtattggtgaaat

SEQ ID NO: 21948 - DNA, 91 bp, Piromyces finnis; identical to SEQ ID NO: 16746
  Dockerin_dom_fun

SEQ ID NO: 21949 - DNA, 117 bp, Piromyces finnis
  Dockerin_dom_fun
atgttggtctgaaccagaatatccatgttgtaaggaatcttgtacagtttactacgttgacgatcatcaatggggtattgaaaacggagaatggtgtggtattccagattcatgtgg

SEQ ID NO: 21950 - DNA, 120 bp, Piromyces finnis
  Dockerin_dom_fun
aacaaagcaaggattcccaatttgtaaagaatgtattataactgcaactggatctgatggtatatcattatggggatgggaaaatagtgagtcatgtcgtatagataatgatatatgctt

SEQ ID NO: 21951 - DNA, 126 bp, Piromyces finnis
  Dockerin_dom_fun
atgttggtctgaagaattaggttattcctgctgttctcattgtactgttcttcttaaggatgaatctggtttatggggtgctgaagatggtaagtggtgtggtattccaaatgaatcatgtaaaga

SEQ ID NO: 21952 - DNA, 121 bp, Piromyces finnis; identical to SEQ ID NO: 19283
  Dockerin_dom_fun

SEQ ID NO: 21953 - DNA, 124 bp, Piromyces finnis
  Dockerin_dom_fun
ttcttctggagtcaaggctcaaggttacccatgctgtaaatcctgtggtcaagttgtatatgttgacgaagatggtaaatggggtgtagaaaacaatgattggtgtggaattccaaccaactgt

SEQ ID NO: 21954 - DNA, 51 bp, Piromyces finnis
  Dockerin_dom_fun
tggtaattggggtgttgaaaataataaatggtgtggctgtggtaatagtag

SEQ ID NO: 21955 - DNA, 117 bp, Piromyces finnis
  Dockerin_dom_fun
tagtgaaaaaatcattaatcaaggctacccatgttgttcaaaagaaactcaagtttattacactgatgaaagtggtgaatggggtgtcgaaaataacaattggtgtggaatattaaa

SEQ ID NO: 21956 - DNA, 123 bp, Piromyces finnis; identical to SEQ ID NO: 19286
  Dockerin_dom_fun

SEQ ID NO: 21957 - DNA, 73 bp, Piromyces finnis
  Dockerin_dom_fun
caaatgttgtaaaaaatgtaacatttatgtaaatgaactcggtcaagattggggtattgaaaataatgattgg

SEQ ID NO: 21958 - DNA, 117 bp, Piromyces finnis
  Dockerin_dom_fun
tggatatccatgttgtgaaaataaaaatactgttgttgaaattaatgattctgaatataatcttcaatttggtattgaaaatggtaaattatgtggtatttcaagtattcaatgtga

SEQ ID NO: 21959 - DNA, 114 bp, Piromyces finnis; identical to SEQ ID NO: 19290
  Dockerin_dom_fun

SEQ ID NO: 21960 - DNA, 102 bp, Piromyces finnis
  Dockerin_dom_fun
aggttatgactgctgtgaaggttgtacaatagaaacagaagaagatggtataaaatggggttacgaaaatagaaattggtgtgtaattccttacacatgtaa

SEQ ID NO: 21961 - DNA, 108 bp, Piromyces finnis; identical to SEQ ID NO: 19289
  Dockerin_dom_fun

SEQ ID NO: 21962 - DNA, 111 bp, Piromyces finnis; identical to SEQ ID NO: 19292
  Dockerin_dom_fun

SEQ ID NO: 21963 - DNA, 106 bp, Piromyces finnis; identical to SEQ ID NO: 16760
  Dockerin_dom_fun

SEQ ID NO: 21964 - DNA, 120 bp, Piromyces finnis; identical to SEQ ID NO: 19294
  Dockerin_dom_fun

SEQ ID NO: 21965 - DNA, 120 bp, Piromyces finnis; identical to SEQ ID NO: 19296
  Dockerin_dom_fun

SEQ ID NO: 21966 - DNA, 114 bp, Piromyces finnis
  Dockerin_dom_fun
tatagaccaaggctatggatgttgtctaaatgataatggaaaaagagaaataataaatatggatggagaatggggtttagaaaatgataattggtgtggatttaggaatagtac

SEQ ID NO: 21967 - DNA, 120 bp, Piromyces finnis
  Dockerin_dom_fun
gtgtgccaaaaacaagaataatttaccatgctgttcaacatgtgaaattgcattgattgatggctctggtagatatggttatgaaaatggtcaatggtgtaatatcccattcaattgttc

SEQ ID NO: 21968 - DNA, 123 bp, Piromyces finnis
  Dockerin_dom_fun
ttggtctcgtgctattggttttgtatgttgtgataaatgtaatgtactctttgttgatgaacaaggtaaatggagtgtcgaagatggttactggtgtggtattaatccaagtaaatgtaaata

SEQ ID NO: 21969 - DNA, 100 bp, Piromyces finnis
  Dockerin_dom_fun
taaatgcttttctgaaaatttaggatattcttgttgtgaagaatgtaatgtggtttataccgataatgatggtaagtggggatatgaaaataatgaatgg

SEQ ID NO: 21970 - DNA, 126 bp, Piromyces finnis
  Dockerin_dom_fun
atgcttttctgaggttttaggatatccttgttgtaatgaatgctctattatttattctgatgctgatggcgactggggatatgaaaatggaatgtggtgtggaattaatacttcacaatgtaatag

SEQ ID NO: 21971 - DNA, 120 bp, Piromyces finnis
  Dockerin_dom_fun
atgttggtctgaaaaatttggaataccttgttgtaaggaggcactaatgccacttcgtactacttacgatggtggatggagtcaagaaaatggtgaatggtgtggtttaggagaaagttt

SEQ ID NO: 21972 - DNA, 102 bp, Piromyces finnis
  Dockerin_dom_fun
tgcttgttgtaaaggatgtgacgtagtatccgtcacttccaatggtaatagtaaatggggtgtagaaaataaaaaatggtgttctattccatattcctgtaa

SEQ ID NO: 21973 - DNA, 126 bp, Piromyces finnis
  Dockerin_dom_fun
gtgttgggctaaagctcaaggttataattgttgtgaaaaacgtactaccgccgttacctacgttgataaaaagactggtgaagaatggggttatgaaggtggaaaatggtgtggtattactgattt

SEQ ID NO: 21974 - DNA, 105 bp, Piromyces finnis
  Dockerin_dom_fun
ttactcttgttgtatctttgatgataccctaatcattacttccgatagcactggaaattggggttttgaaggagatagatggtgtttaattaaaaataataagga

SEQ ID NO: 21975 - DNA, 120 bp, Piromyces finnis; identical to SEQ ID NO: 19305
  Dockerin_dom_fun

SEQ ID NO: 21976 - DNA, 120 bp, Piromyces finnis; identical to SEQ ID NO: 19306
  Dockerin_dom_fun

SEQ ID NO: 21977 - DNA, 99 bp, Piromyces finnis; identical to SEQ ID NO: 19307
  Dockerin_dom_fun

SEQ ID NO: 21978 - DNA, 96 bp, Piromyces finnis
  Dockerin_dom_fun
tatgtgctgtgaaggatgtgaagttgttgaagaaaccgctgaaggaaagtggggtattgaaaagaacaattggtgtggtattaaggattcttgctt

SEQ ID NO: 21979 - DNA, 120 bp, Piromyces finnis; identical to SEQ ID NO: 19309
  Dockerin_dom_fun

SEQ ID NO: 21980 - DNA, 129 bp, Piromyces finnis; identical to SEQ ID NO: 19310
  Dockerin_dom_fun

SEQ ID NO: 21981 - DNA, 129 bp, Piromyces finnis
  Dockerin_dom_fun
ttggagtgaagaacttggttacagatgctgtaacaatggtgaaagtattgttgaatacattgatgaaagtggatggtggggtgttactaaggacacaaaggaatggtgtggtattattaagaacaagaa

SEQ ID NO: 21982 - DNA, 73 bp, Piromyces finnis; identical to SEQ ID NO: 16777
  Dockerin_dom_fun

SEQ ID NO: 21983 - DNA, 63 bp, Piromyces finnis; identical to SEQ ID NO: 19313
  Dockerin_dom_fun

SEQ ID NO: 21984 - DNA, 118 bp, Piromyces finnis; identical to SEQ ID NO: 19312
  Dockerin_dom_fun

SEQ ID NO: 21985 - DNA, 96 bp, Piromyces finnis
  Dockerin_dom_fun
ttcatgttgtgaaggttgtgaggttatcgaagaaactgaagaaggtaaatggggtatagaaaattacgcatggtgtggtattaaagattcatgttt

SEQ ID NO: 21986 - DNA, 91 bp, Piromyces finnis
  Dockerin_dom_fun
agcttctattactaaacaaggttacaaatgttgtaaggcaggatgtgaagttatttacactgatgccgatggtgattggggtgttgaaaac

SEQ ID NO: 21987 - DNA, 85 bp, Piromyces finnis; identical to SEQ ID NO: 16782
  Dockerin_dom_fun

SEQ ID NO: 21988 - DNA, 102 bp, Piromyces finnis
  Dockerin_dom_fun
tgatgtatgtgaaggctgtgaagttttagttactgatttagaaggtaagtggggtgctcaagatggtaaatggtgccatatcgatgaagttaaatgcaataa

SEQ ID NO: 21989 - DNA, 102 bp, Piromyces finnis
  Dockerin_dom_fun
tgaatgctgtactggttgtaaaccaattgttgctgatgatgaaggaagatggggagctcaaaatggtgaatggtgtttaattgatgaagaaagatgtaaagg

SEQ ID NO: 21990 - DNA, 100 bp, Piromyces finnis; identical to SEQ ID NO: 19319
  Dockerin_dom_fun

SEQ ID NO: 21991 - DNA, 105 bp, Piromyces finnis
  Dockerin_dom_fun
tgcttatccaaaatgttctgattgtattgttttcgccactggtaaggatggttctctttggggttgggaaaatgaatctttttgtagaatttcaaagaaatgtta

SEQ ID NO: 21992 - DNA, 105 bp, Piromyces finnis; identical to SEQ ID NO: 21991
  Dockerin_dom_fun

SEQ ID NO: 21993 - DNA, 114 bp, Piromyces finnis
  Dockerin_dom_fun
agaaaaaaaactaggttatccatgttgtaaatattgtactattattgaaagtgattcctatggagactatggtgttgaaaataatgcctggtgtagtatatcctacgcctgtta

SEQ ID NO: 21994 - DNA, 117 bp, Piromyces finnis
  Dockerin_dom_fun
ttcttgttggtcagaatccttaggctatccatgttgtcatcatcaagatatcatctacaccgatgaaagtggaccatggggattagaaaataatcaatggtgtggtattcagacctg

SEQ ID NO: 21995 - DNA, 88 bp, Piromyces finnis
  Dockerin_dom_fun
ttatccatgttgtaaaactaataagacagttgtattcactgatgaatacggaaaatggagtgttgaaaataacgattggtgtttaatt

SEQ ID NO: 21996 - DNA, 117 bp, Piromyces finnis
  Dockerin_dom_fun
ctcttccaaaattacccaacaaggttacaaatgttgttcaaagaactgtgtcgtctattacactgatagtgatggtaactggggttatgaaaacgactggtgtggttgtgccaacgt

SEQ ID NO: 21997 - DNA, 117 bp, Piromyces finnis; identical to SEQ ID NO: 21996
  Dockerin_dom_fun

SEQ ID NO: 21998 - DNA, 88 bp, Piromyces finnis; identical to SEQ ID NO: 21995
  Dockerin_dom_fun

SEQ ID NO: 21999 - DNA, 79 bp, Piromyces finnis
  Dockerin_dom_fun
ttatacctatccatattgtaaaaccacctctgatgttgtttacaccgataccatggaatggggtgttgaaaataatgaa

SEQ ID NO: 22000 - DNA, 120 bp, Piromyces finnis; identical to SEQ ID NO: 19326
  Dockerin_dom_fun

SEQ ID NO: 22001 - DNA, 123 bp, Piromyces finnis; identical to SEQ ID NO: 19327
  Dockerin_dom_fun

SEQ ID NO: 22002 - DNA, 123 bp, Piromyces finnis; identical to SEQ ID NO: 19327
  Dockerin_dom_fun

SEQ ID NO: 22003 - DNA, 120 bp, Piromyces finnis; identical to SEQ ID NO: 19326
  Dockerin_dom_fun

SEQ ID NO: 22004 - DNA, 120 bp, Piromyces finnis
  Dockerin_dom_fun
atgttggtctcttaaagaaggatataactgttgtataggttgtgctgtctatgctattacagatgaaggttcttggggtgttgaaaatggaaaatggtgtggtattccatcctattgttc

SEQ ID NO: 22005 - DNA, 126 bp, Piromyces finnis; identical to SEQ ID NO: 19330
  Dockerin_dom_fun

SEQ ID NO: 22006 - DNA, 129 bp, Piromyces finnis
  Dockerin_dom_fun
atgttggtcattatcccaaggctacccatgttgtgatccagatgccgaaactatttactccgatgaatccggtgattggggtcttgcattaaacagtaataatgaattggattggtgtggtattatttc

SEQ ID NO: 22007 - DNA, 138 bp, Piromyces finnis; identical to SEQ ID NO: 19333
  Dockerin_dom_fun

SEQ ID NO: 22008 - DNA, 111 bp, Piromyces finnis; identical to SEQ ID NO: 19334
  Dockerin_dom_fun

SEQ ID NO: 22009 - DNA, 94 bp, Piromyces finnis; identical to SEQ ID NO: 16811
  Dockerin_dom_fun

SEQ ID NO: 22010 - DNA, 70 bp, Piromyces finnis; identical to SEQ ID NO: 16813
  Dockerin_dom_fun

SEQ ID NO: 22011 - DNA, 114 bp, Piromyces finnis
  Dockerin_dom_fun
ctgtttcgccactaaattaggatacccatgttgtaagaacaaccaaattgtttacactgattcagatggtgactggggatttgaaaacaacgaatggtgtggtattggtggagc

SEQ ID NO: 22012 - DNA, 114 bp, Piromyces finnis; identical to SEQ ID NO: 22011
  Dockerin_dom_fun

SEQ ID NO: 22013 - DNA, 114 bp, Piromyces finnis; identical to SEQ ID NO: 22011
  Dockerin_dom_fun

SEQ ID NO: 22014 - DNA, 120 bp, Piromyces finnis; identical to SEQ ID NO: 19340
  Dockerin_dom_fun

SEQ ID NO: 22015 - DNA, 117 bp, Piromyces finnis; identical to SEQ ID NO: 19341
  Dockerin_dom_fun

SEQ ID NO: 22016 - DNA, 103 bp, Piromyces finnis; identical to SEQ ID NO: 16819
  Dockerin_dom_fun

SEQ ID NO: 22017 - DNA, 106 bp, Piromyces finnis; identical to SEQ ID NO: 16820
  Dockerin_dom_fun

SEQ ID NO: 22018 - DNA, 112 bp, Piromyces finnis
  Dockerin_dom_fun
atgttggtctgaagctcttggttataaatgttgttctagtggatgtaattctatcgtaatattcactgatgaaaacggttcatggagtgctgaaaataatgaatggtgtggt

SEQ ID NO: 22019 - DNA, 70 bp, Piromyces finnis
  Dockerin_dom_fun
cgttataagactcggttatttatgttgtagtctaccatgtactgttatttatactgatgatgatggtgat

SEQ ID NO: 22020 - DNA, 54 bp, Piromyces finnis
  Dockerin_dom_fun
tgatgatgatggtgattgggcatttcaaaataatgagtggtgtggttgtggagg

SEQ ID NO: 22021 - DNA, 79 bp, Piromyces finnis; identical to SEQ ID NO: 16824
  Dockerin_dom_fun

SEQ ID NO: 22022 - DNA, 118 bp, Piromyces finnis
  Dockerin_dom_fun
atgcttttcaattaatttaggctatccatgttgtagtacttgtactttatactttgaaaattctattggaagatggggcattgaaaataatgagtggtgtggtctaaaaagttcttgc

SEQ ID NO: 22023 - DNA, 120 bp, Piromyces finnis
  Dockerin_dom_fun
atgttgggcagaggaacaagggtatcaatgttgttctgattgtgatgttatctatgaagacaataatggtttgtggggaatagagaatggtacttggtgtggtattaactctacatgcaa

SEQ ID NO: 22024 - DNA, 61 bp, Piromyces finnis
  Dockerin_dom_fun
cgcctgctgtagtggatgtgaatcagtctatgttgacaatgatggtaaatggggtgttgaa

SEQ ID NO: 22025 - DNA, 114 bp, Piromyces finnis; identical to SEQ ID NO: 19349
  Dockerin_dom_fun

SEQ ID NO: 22026 - DNA, 97 bp, Piromyces finnis; identical to SEQ ID NO: 16829
  Dockerin_dom_fun

SEQ ID NO: 22027 - DNA, 120 bp, Piromyces finnis
  Dockerin_dom_fun
atgttggtcagaattattaggaagtccatgttgtccaccaaaggttacaattgtttacagtcatgatgaatatggagattggggatatgattttaagcgtaaggaatggtgtggacttac

SEQ ID NO: 22028 - DNA, 117 bp, Piromyces finnis
  Dockerin_dom_fun
tcaaactaatattgttgaacttggttataaatgttgttctagttttattaagattgatcatacagataaaataggtacttggggatatgaaaatggtgaattgtgtggtattccatt

SEQ ID NO: 22029 - DNA, 96 bp, Piromyces finnis
  Dockerin_dom_fun
cttatgttgtgatggttgtaatgttgttgaagaaactgctgaaggtaaatggggtgttgaaaacaacaaatggtgtggtattccaagtaactgtaa

SEQ ID NO: 22030 - DNA, 78 bp, Piromyces finnis; identical to SEQ ID NO: 19355
  Dockerin_dom_fun

SEQ ID NO: 22031 - DNA, 126 bp, Piromyces finnis
  Dockerin_dom_fun
atgttggtctgaaaatattggttatccatgttgtcaaaataaggataccaaggtaacctatcattccaaatctcttaataaagactatggtactgaaaatggagaatggtgcggtattaatgatat

SEQ ID NO: 22032 - DNA, 93 bp, Piromyces finnis
  Dockerin_dom_fun
ttacaactgctgtaaaattccagctaacgtcgatacagtagatgatgttggttactgggctattcaaaatggtcaatggtgttttattgatat

SEQ ID NO: 22033 - DNA, 87 bp, Piromyces finnis
  Dockerin_dom_fun
caagtgttgtgaaacttgtaaagtttcctacactgattccacaaagtggggtgttgaacatggtaaatggtgttctattccatattc

SEQ ID NO: 22034 - DNA, 85 bp, Piromyces finnis; identical to SEQ ID NO: 19359
  Dockerin_dom_fun

SEQ ID NO: 22035 - DNA, 93 bp, Piromyces finnis; identical to SEQ ID NO: 19360
  Dockerin_dom_fun

SEQ ID NO: 22036 - DNA, 132 bp, Piromyces finnis
  Dockerin_dom_fun
atgttggtcattatcctatggaacaggttatccatgttgtaaagataaaaacaccaaagttaactatgtttctaaatctactggaaaagaatggggtgtagaaaatggtaattggtgtggaataacagatct

SEQ ID NO: 22037 - DNA, 97 bp, Piromyces finnis; identical to SEQ ID NO: 16840
  Dockerin_dom_fun

SEQ ID NO: 22038 - DNA, 123 bp, Piromyces finnis
  Dockerin_dom_fun
tacatgttggtcatcaagcctaggttatccatgttgtactaatactaatgaagtaatttatgaagatagtgatggtaagtggggtatcgaaaacaataactggtgtggtataattaataatgc

SEQ ID NO: 22039 - DNA, 123 bp, Piromyces finnis; identical to SEQ ID NO: 19363
  Dockerin_dom_fun

SEQ ID NO: 22040 - DNA, 88 bp, Piromyces finnis; identical to SEQ ID NO: 19365
  Dockerin_dom_fun

SEQ ID NO: 22041 - DNA, 88 bp, Piromyces finnis; identical to SEQ ID NO: 16844
  Dockerin_dom_fun

SEQ ID NO: 22042 - DNA, 135 bp, Piromyces finnis; identical to SEQ ID NO: 19367
  Dockerin_dom_fun

SEQ ID NO: 22043 - DNA, 129 bp, Piromyces finnis
  Dockerin_dom_fun
ttggtcagagaatttaccagatccatatccatgctgttcaagtgaccaagtccaaagaatagactcaacctatgatggtgactggggtaaagaaaatggtaaaaagtgtggtatagtatatgaatgcaa

SEQ ID NO: 22044 - DNA, 120 bp, Piromyces finnis; identical to SEQ ID NO: 19369
  Dockerin_dom_fun

SEQ ID NO: 22045 - DNA, 73 bp, Piromyces finnis
  Dockerin_dom_fun
tccatgttgccaaccaggagccgaagtagtctatgttgatgaaactggtaattggggtgttgaaaatggtaac

SEQ ID NO: 22046 - DNA, 120 bp, Piromyces finnis
  Dockerin_dom_fun
atgtttcagtgttgctttaggttacccatgttgtagtggaaacaatgttgtttacagtgactctgatggtaagtggggatttgaaaataatagctggtgtggtattgctgaaaagcaatc

SEQ ID NO: 22047 - DNA, 91 bp, Piromyces finnis; identical to SEQ ID NO: 19371
  Dockerin_dom_fun

SEQ ID NO: 22048 - DNA, 120 bp, Piromyces finnis
  Dockerin_dom_fun
aagttgtttctcgattaaacttggttatccatgttgtaacagcaatattgtatattatgttgacaatgatggtcaatggggatttgaaaataataattggtgtggtattatatctaataa

SEQ ID NO: 22049 - DNA, 120 bp, Piromyces finnis; identical to SEQ ID NO: 19374
  Dockerin_dom_fun

SEQ ID NO: 22050 - DNA, 94 bp, Piromyces finnis
  Dockerin_dom_fun
cccatgctgtcaaggatgtatagtagtcaccactgataaaaatggtagatggggtgttgaaaacaatgcctggtgctccattagctattcatgt

SEQ ID NO: 22051 - DNA, 120 bp, Piromyces finnis; identical to SEQ ID NO: 19376
  Dockerin_dom_fun

SEQ ID NO: 22052 - DNA, 90 bp, Piromyces finnis
  Dockerin_dom_fun
ttcatgttgtagttcatgtatagatattgttgagcaagatgatgatagtagctggggtattgaaaatggacaatggtgttcaatcccatt

SEQ ID NO: 22053 - DNA, 120 bp, Piromyces finnis; identical to SEQ ID NO: 19377
  Dockerin_dom_fun

SEQ ID NO: 22054 - DNA, 93 bp, Piromyces finnis
  Dockerin_dom_fun
tttcgattgttgtccagatggtactgaagttgcctatgtcgatgaatatggtgaatggggtataattaatggagaatggtgtggttttagttc

SEQ ID NO: 22055 - DNA, 117 bp, Piromyces finnis
  Dockerin_dom_fun
ctcttgtttttctatggcattgggtttttcatgttgtgaaggcaacaaaatagtttatactgatgatgatggtgattggggatatgaaaatggcgaatggtgtggtattataaaagg

SEQ ID NO: 22056 - DNA, 126 bp, Piromyces finnis
  Dockerin_dom_fun
tgaatgcttttctactaaattaggatataaatgttgttcatcttgtactgatgttatatatattgataatgatggacagtggggattagaaaacgacaattggtgtggaatagctgataaatgtaa

SEQ ID NO: 22057 - DNA, 97 bp, Piromyces finnis; identical to SEQ ID NO: 19380
  Dockerin_dom_fun

SEQ ID NO: 22058 - DNA, 94 bp, Piromyces finnis; identical to SEQ ID NO: 19383
  Dockerin_dom_fun

SEQ ID NO: 22059 - DNA, 109 bp, Piromyces finnis; identical to SEQ ID NO: 16862
  Dockerin_dom_fun

SEQ ID NO: 22060 - DNA, 93 bp, Piromyces finnis
  Dockerin_dom_fun
ttacgaatgttgtttcgataatgaagttgtttatgaagatgaaagtggtaaatggggtattaatgaaaagggagaatggtgtggtgttgaaca

SEQ ID NO: 22061 - DNA, 87 bp, Piromyces finnis
  Dockerin_dom_fun
cccatgttgtcaaaacactaatttctcctactacactgattccgctggtaatgaatggggtattgaaaacaacaactggtgtggtat

SEQ ID NO: 22062 - DNA, 120 bp, Piromyces finnis; identical to SEQ ID NO: 19387
  Dockerin_dom_fun

SEQ ID NO: 22063 - DNA, 91 bp, Piromyces finnis; identical to SEQ ID NO: 19388
  Dockerin_dom_fun

SEQ ID NO: 22064 - DNA, 120 bp, Piromyces finnis; identical to SEQ ID NO: 19392
  Dockerin_dom_fun

SEQ ID NO: 22065 - DNA, 111 bp, Piromyces finnis; identical to SEQ ID NO: 19389
  Dockerin_dom_fun

SEQ ID NO: 22066 - DNA, 132 bp, Piromyces finnis; identical to SEQ ID NO: 19390
  Dockerin_dom_fun

SEQ ID NO: 22067 - DNA, 108 bp, Piromyces finnis
  Dockerin_dom_fun
tggttatccatgttgttcttcagtaaatcctgaagttcaatatactgatgataatggtaataaatggggtgttgaagatggcgaatggtgcggtattggtgaagctaa

SEQ ID NO: 22068 - DNA, 111 bp, Piromyces finnis; identical to SEQ ID NO: 19389
  Dockerin_dom_fun

SEQ ID NO: 22069 - DNA, 132 bp, Piromyces finnis; identical to SEQ ID NO: 19390
  Dockerin_dom_fun

SEQ ID NO: 22070 - DNA, 120 bp, Piromyces finnis; identical to SEQ ID NO: 19392
  Dockerin_dom_fun

SEQ ID NO: 22071 - DNA, 108 bp, Piromyces finnis; identical to SEQ ID NO: 22067
  Dockerin_dom_fun

SEQ ID NO: 22072 - DNA, 106 bp, Piromyces finnis; identical to SEQ ID NO: 19397
  Dockerin_dom_fun

SEQ ID NO: 22073 - DNA, 114 bp, Piromyces finnis; identical to SEQ ID NO: 19398
  Dockerin_dom_fun

SEQ ID NO: 22074 - DNA, 106 bp, Piromyces finnis; identical to SEQ ID NO: 19397
  Dockerin_dom_fun

SEQ ID NO: 22075 - DNA, 114 bp, Piromyces finnis; identical to SEQ ID NO: 19398
  Dockerin_dom_fun

SEQ ID NO: 22076 - DNA, 129 bp, Piromyces finnis
  Dockerin_dom_fun
ttcccaaactattttagatcaaggttattcttgttgttcctataattgtaaagtcgtacatgaagaaaataagggtgaatctaaatattactggggtgttgaaaaagataattggtgtggatgcccatt

SEQ ID NO: 22077 - DNA, 120 bp, Piromyces finnis; identical to SEQ ID NO: 19402
  Dockerin_dom_fun

SEQ ID NO: 22078 - DNA, 88 bp, Piromyces finnis; identical to SEQ ID NO: 19403
  Dockerin_dom_fun

SEQ ID NO: 22079 - DNA, 88 bp, Piromyces finnis; identical to SEQ ID NO: 19404
  Dockerin_dom_fun

SEQ ID NO: 22080 - DNA, 105 bp, Piromyces finnis
  Dockerin_dom_fun
tggattagattatgaatgctgttctagcttaaatgttaaattacaatccattgatgctgatgctaaatggggttttgaaaatggtaaatggtgtattattgaatt

SEQ ID NO: 22081 - DNA, 123 bp, Piromyces finnis; identical to SEQ ID NO: 19406
  Dockerin_dom_fun

SEQ ID NO: 22082 - DNA, 99 bp, Piromyces finnis
  Dockerin_dom_fun
ttatccatgttgtgttaaaactgaaaaaggaacatacagtgatggagatggtgactgggctcaagaaaacggtgattggtgtactataagacattctaa

SEQ ID NO: 22083 - DNA, 91 bp, Piromyces finnis; identical to SEQ ID NO: 16885
  Dockerin_dom_fun

SEQ ID NO: 22084 - DNA, 55 bp, Piromyces finnis; identical to SEQ ID NO: 19409
  Dockerin_dom_fun

SEQ ID NO: 22085 - DNA, 102 bp, Piromyces finnis
  Dockerin_dom_fun
ttacccatgttgtaacggttgtgatgttacctacgttgataacgaaggtgaatggggtgttcaaaacaacaactggtgtttcatcgacagtggtaagtgtca

SEQ ID NO: 22086 - DNA, 88 bp, Piromyces finnis; identical to SEQ ID NO: 16887
  Dockerin_dom_fun

SEQ ID NO: 22087 - DNA, 91 bp, Piromyces finnis; identical to SEQ ID NO: 19412
  Dockerin_dom_fun

SEQ ID NO: 22088 - DNA, 117 bp, Piromyces finnis; identical to SEQ ID NO: 19413
  Dockerin_dom_fun

SEQ ID NO: 22089 - DNA, 123 bp, Piromyces finnis; identical to SEQ ID NO: 19415
  Dockerin_dom_fun

SEQ ID NO: 22090 - DNA, 126 bp, Piromyces finnis
  Dockerin_dom_fun
atgctggtctgaagactttggttacccatgttgtaagggttgcattgtttatgaagaagatgaacatggtcaatggggttatgactttactgaagctacctggtgtggtattcaatccttctgtaa

SEQ ID NO: 22091 - DNA, 93 bp, Piromyces finnis
  Dockerin_dom_fun
tgaatgttgtaatggatgtgatgtagtctatacagatgccgaaggtaaatggggtgttgaaaacaacaattggtgcataattaataaatgcaa

SEQ ID NO: 22092 - DNA, 96 bp, Piromyces finnis
  Dockerin_dom_fun
tccatggtgtaatggatgtaaggtctattatacagatgctgaaggtaattggggtgttgaaaacaatgattggtgtttaattaaaagttcatgcaa

SEQ ID NO: 22093 - DNA, 96 bp, Piromyces finnis; identical to SEQ ID NO: 22092
  Dockerin_dom_fun

SEQ ID NO: 22094 - DNA, 93 bp, Piromyces finnis; identical to SEQ ID NO: 22091
  Dockerin_dom_fun

SEQ ID NO: 22095 - DNA, 85 bp, Piromyces finnis; identical to SEQ ID NO: 16897
  Dockerin_dom_fun

SEQ ID NO: 22096 - DNA, 99 bp, Piromyces finnis
  Dockerin_dom_fun
acaatctggtttcccatgttgtttagatttaaatggtggtattatttccgttgatggtgctggtgaatggaatattgaaggtagtatttggtgtttata

SEQ ID NO: 22097 - DNA, 103 bp, Piromyces finnis; identical to SEQ ID NO: 16898
  Dockerin_dom_fun

SEQ ID NO: 22098 - DNA, 120 bp, Piromyces finnis
  Dockerin_dom_fun
atgcccaggtatcaagtacggttatgaatgctgtgaaaaatgtgatgtagttgaaactgatgaacttggacaatggggtgccattaatggtgaatggtgtagtattaagaagtcttgcaa

SEQ ID NO: 22099 - DNA, 117 bp, Piromyces finnis
  Dockerin_dom_fun
ctcttgctggagtcaaggattaggtttccaatgctgttctggatgtaatgttgaatatgtcgacagtgatggtgaatggggtttagaaaacggtgaatggtgtggtattccaacatg

SEQ ID NO: 22100 - DNA, 120 bp, Piromyces finnis; identical to SEQ ID NO: 19423
  Dockerin_dom_fun

SEQ ID NO: 22101 - DNA, 120 bp, Piromyces finnis; identical to SEQ ID NO: 19423
  Dockerin_dom_fun

SEQ ID NO: 22102 - DNA, 117 bp, Piromyces finnis; identical to SEQ ID NO: 22099
  Dockerin_dom_fun

SEQ ID NO: 22103 - DNA, 112 bp, Piromyces finnis; identical to SEQ ID NO: 16904
  Dockerin_dom_fun

SEQ ID NO: 22104 - DNA, 120 bp, Piromyces finnis; identical to SEQ ID NO: 19428
  Dockerin_dom_fun

SEQ ID NO: 22105 - DNA, 94 bp, Piromyces finnis
  Dockerin_dom_fun
tagttgttggtctgaaaaacttggttatagatgttgtaaatctagctatccagtttattatactgatgccgatggtcaatggggtattgaaaat

SEQ ID NO: 22106 - DNA, 123 bp, Piromyces finnis
  Dockerin_dom_fun
ttgctggtcaaccaatctcggttttccatgttgtcaattaaagacaactaaagttcaatatggtgataatactaatagtcaatttggtattgaaaatggtcaattatgtggtattaatgattt

SEQ ID NO: 22107 - DNA, 114 bp, Piromyces finnis; identical to SEQ ID NO: 19430
  Dockerin_dom_fun

SEQ ID NO: 22108 - DNA, 114 bp, Piromyces finnis; identical to SEQ ID NO: 19432
  Dockerin_dom_fun

SEQ ID NO: 22109 - DNA, 102 bp, Piromyces finnis
  Dockerin_dom_fun
tactggttatccatgttgtagtgatccaaaggcctctattattaccaatgatatttcaggtgattggggtattgaaggtaatacatggtgtttaattgaatg

SEQ ID NO: 22110 - DNA, 117 bp, Piromyces finnis
  Dockerin_dom_fun
ttggtctttagaaagaggttatccatgttgtgaaactaatactgaagtattctatacttcttctaatggtaaaacttggagtattgaaaataatgactggtgcggtattaatgaata

SEQ ID NO: 22111 - DNA, 61 bp, Piromyces finnis
  Dockerin_dom_fun
tccatgctgttctggttgtgatgctatttacgaagacgatgatggtaaatggggtgttgaa

SEQ ID NO: 22112 - DNA, 105 bp, Piromyces finnis
  Dockerin_dom_fun
ctacagtgactgtaaaaattgtagagtcgttactgttgaagatggtgtcagttggggtgtagaaaacaacgactggtgtgttatcaaatcttctatttgtaacaa

SEQ ID NO: 22113 - DNA, 126 bp, Piromyces finnis; identical to SEQ ID NO: 19437
  Dockerin_dom_fun

SEQ ID NO: 22114 - DNA, 42 bp, Piromyces finnis
  Dockerin_dom_fun
gtggggtattgaaaacggtcaatggtgtggtatagttaacga

SEQ ID NO: 22115 - DNA, 94 bp, Piromyces finnis; identical to SEQ ID NO: 16917
  Dockerin_dom_fun

SEQ ID NO: 22116 - DNA, 126 bp, Piromyces finnis; identical to SEQ ID NO: 19439
  Dockerin_dom_fun

SEQ ID NO: 22117 - DNA, 114 bp, Piromyces finnis; identical to SEQ ID NO: 19440
  Dockerin_dom_fun

SEQ ID NO: 22118 - DNA, 117 bp, Piromyces finnis; identical to SEQ ID NO: 19441
  Dockerin_dom_fun

SEQ ID NO: 22119 - DNA, 117 bp, Piromyces finnis
  Dockerin_dom_fun
ctgttggtctcttgcagaaggttataaatgttgtagtgaaggtactcctgttgtacttacagatagtaagggtaaatggggtattgaaaataatgattggtgcggtatagttactaa

SEQ ID NO: 22120 - DNA, 97 bp, Piromyces finnis; identical to SEQ ID NO: 16922
  Dockerin_dom_fun

SEQ ID NO: 22121 - DNA, 91 bp, Piromyces finnis; identical to SEQ ID NO: 16923
  Dockerin_dom_fun

SEQ ID NO: 22122 - DNA, 96 bp, Piromyces finnis; identical to SEQ ID NO: 19446
  Dockerin_dom_fun

SEQ ID NO: 22123 - DNA, 106 bp, Piromyces finnis; identical to SEQ ID NO: 19445
  Dockerin_dom_fun

SEQ ID NO: 22124 - DNA, 82 bp, Piromyces finnis; identical to SEQ ID NO: 16928
  Dockerin_dom_fun

SEQ ID NO: 22125 - DNA, 111 bp, Piromyces finnis
  Dockerin_dom_fun
tttcgccaagtctgatggttacgaatgttgtttcgataatgaagttgtttatgaagatgaaagtggtaaatggggtattaatgaaaagggagaatggtgtggtgttgaaca

SEQ ID NO: 22126 - DNA, 120 bp, Piromyces finnis
  Dockerin_dom_fun
ttgggccgaagctcttggttacaagtgttgttcagctggtaactacatggttcttcttacagatgaaagtggagcctggggtgccgaaaatggagaatggtgtggtattgttaaggatgc

SEQ ID NO: 22127 - DNA, 82 bp, Piromyces finnis; identical to SEQ ID NO: 16928
  Dockerin_dom_fun

SEQ ID NO: 22128 - DNA, 111 bp, Piromyces finnis; identical to SEQ ID NO: 22125
  Dockerin_dom_fun

SEQ ID NO: 22129 - DNA, 120 bp, Piromyces finnis; identical to SEQ ID NO: 22126
  Dockerin_dom_fun

SEQ ID NO: 22130 - DNA, 106 bp, Piromyces finnis
  Dockerin_dom_fun
aagttgttcatttgagagcataggttacagttgctgtaaattaaattgtgatgttatctacactgatgaatctggtgattggagtgttgaaaacgatgaatggtgt

SEQ ID NO: 22131 - DNA, 96 bp, Piromyces finnis
  Dockerin_dom_fun
ccaatgctgtgctgatggtactgaagtaatttatactgacgaatctggagattggggtgttattaatgatgaatggtgtggtattaagaaaactga

SEQ ID NO: 22132 - DNA, 126 bp, Piromyces finnis
  Dockerin_dom_fun
ttgcttttctacaagtatgggatacccatgttgttcaggatgtgaagatatctatgaagatgatgatggtaaatggggtgtagaaaatgatgattggtgtggtattgatgaagccaaatgtaatcc

SEQ ID NO: 22133 - DNA, 117 bp, Piromyces finnis
  Dockerin_dom_fun
ctgctggtcacttccagactacccatgctgtgaaggtgataccgtaatttacagtgatgaaagtggtgactggggtgttgaaaacgacgaatggtgtggtattgtaaaatcatctgc

SEQ ID NO: 22134 - DNA, 103 bp, Piromyces finnis; identical to SEQ ID NO: 16936
  Dockerin_dom_fun

SEQ ID NO: 22135 - DNA, 120 bp, Piromyces finnis; identical to SEQ ID NO: 19458
  Dockerin_dom_fun

SEQ ID NO: 22136 - DNA, 69 bp, Piromyces finnis
  Dockerin_dom_fun
agctatatttacagatggtgaaaagaaatggggtgttgaaaatggtcaatggtgtggtatgccaaatgg

SEQ ID NO: 22137 - DNA, 81 bp, Piromyces finnis
  Dockerin_dom_fun
agctatatttacagatggtgaaaagaaatggggtgttgaaaatggtcaatggtgtggtattattgaaagtcaatgtcaaat

SEQ ID NO: 22138 - DNA, 105 bp, Piromyces finnis
  Dockerin_dom_fun
tcttggttatccatgttgtcaatcaacttcttctgtagttttcactgataacactggaaaatggggtatagaaaataatgattggtgtgaaataaaagaaaaacc

SEQ ID NO: 22139 - DNA, 48 bp, Piromyces finnis
  Dockerin_dom_fun
tggtaagtggggtgttgaaaatggtcaatggtgtggtatgccaaatgg

SEQ ID NO: 22140 - DNA, 120 bp, Piromyces finnis; identical to SEQ ID NO: 19458
  Dockerin_dom_fun

SEQ ID NO: 22141 - DNA, 102 bp, Piromyces finnis
  Dockerin_dom_fun
tgattacccatgttgtgaacaatgtaatattgtatctgaagaagaaggtgacttctggggtgtcgaaaacaatgaatggtgtagtattaaattcaaatgtta

SEQ ID NO: 22142 - DNA, 117 bp, Piromyces finnis; identical to SEQ ID NO: 21949
  Dockerin_dom_fun

SEQ ID NO: 22143 - DNA, 102 bp, Piromyces finnis; identical to SEQ ID NO: 22141
  Dockerin_dom_fun

SEQ ID NO: 22144 - DNA, 117 bp, Piromyces finnis; identical to SEQ ID NO: 19466
  Dockerin_dom_fun

SEQ ID NO: 22145 - DNA, 117 bp, Piromyces finnis; identical to SEQ ID NO: 21949
  Dockerin_dom_fun

SEQ ID NO: 22146 - DNA, 126 bp, Piromyces finnis
  Dockerin_dom_fun
atgttggtctcttaagtatggttatgaatgctgttctccaaataacactagagttgttgtcaccgatgaaagtggaaagtggggtgttgaaaacagtgattggtgtggtattgtagacagcaagga

SEQ ID NO: 22147 - DNA, 117 bp, Piromyces finnis; identical to SEQ ID NO: 19466
  Dockerin_dom_fun

SEQ ID NO: 22148 - DNA, 124 bp, Piromyces finnis
  Dockerin_dom_fun
atgctggtctattccattcggttacaaatgctgtgatcactgtaaagtcctcttaactgatgaaagtggtaaatggggtgaattaaacggtgaatggtgtggtattgatactactaaatgtaaa

SEQ ID NO: 22149 - DNA, 124 bp, Piromyces finnis; identical to SEQ ID NO: 22148
  Dockerin_dom_fun

SEQ ID NO: 22150 - DNA, 126 bp, Piromyces finnis; identical to SEQ ID NO: 22146
  Dockerin_dom_fun

SEQ ID NO: 22151 - DNA, 117 bp, Piromyces finnis; identical to SEQ ID NO: 21949
  Dockerin_dom_fun

SEQ ID NO: 22152 - DNA, 102 bp, Piromyces finnis; identical to SEQ ID NO: 22141
  Dockerin_dom_fun

SEQ ID NO: 22153 - DNA, 100 bp, Piromyces finnis; identical to SEQ ID NO: 16954
  Dockerin_dom_fun

SEQ ID NO: 22154 - DNA, 100 bp, Piromyces finnis; identical to SEQ ID NO: 16954
  Dockerin_dom_fun

SEQ ID NO: 22155 - DNA, 123 bp, Piromyces finnis; identical to SEQ ID NO: 19477
  Dockerin_dom_fun

SEQ ID NO: 22156 - DNA, 118 bp, Piromyces finnis
  Dockerin_dom_fun
aattacctcccaaggatattcatgttgtgctggtaataattgttctgttgttctcacggatgaatctggaagatggggagttgaaaataatcaatggtgtggtatttctaatgactgt

SEQ ID NO: 22157 - DNA, 96 bp, Piromyces finnis
  Dockerin_dom_fun
cttatgttgtgatggttgtaatgttgttgaagaaactgctgaaggtaaatggggtattgaaaacaactattggtgtggtattaagaattcatgctt

SEQ ID NO: 22158 - DNA, 99 bp, Piromyces finnis
  Dockerin_dom_fun
ttatgactactgtaatgcttgtggtgttgttttagaagaagacggagttaaatggggtgttgaaaataacgattggtgtattatcccatctaaatgtag

SEQ ID NO: 22159 - DNA, 120 bp, Piromyces finnis; identical to SEQ ID NO: 19482
  Dockerin_dom_fun

SEQ ID NO: 22160 - DNA, 123 bp, Piromyces finnis; identical to SEQ ID NO: 19481
  Dockerin_dom_fun

SEQ ID NO: 22161 - DNA, 126 bp, Piromyces finnis
  Dockerin_dom_fun
atgctggtcagaagaacttggttatccatgttgtaaagattgtacagtttatgaaactgatgaaagtggagaatggggttatgattttaaaaacatgcaatggtgtggtattcaatcctactgccc

SEQ ID NO: 22162 - DNA, 123 bp, Piromyces finnis; identical to SEQ ID NO: 19483
  Dockerin_dom_fun

SEQ ID NO: 22163 - DNA, 106 bp, Piromyces finnis; identical to SEQ ID NO: 16965
  Dockerin_dom_fun

SEQ ID NO: 22164 - DNA, 106 bp, Piromyces finnis; identical to SEQ ID NO: 16965
  Dockerin_dom_fun

SEQ ID NO: 22165 - DNA, 61 bp, Piromyces finnis
  Dockerin_dom_fun
ttatccatgctgtaaaggaaacaccgtagtttatactgataacgaaggtagttggggtgta

SEQ ID NO: 22166 - DNA, 61 bp, Piromyces finnis; identical to SEQ ID NO: 22165
  Dockerin_dom_fun

SEQ ID NO: 22167 - DNA, 129 bp, Piromyces finnis; identical to SEQ ID NO: 19489
  Dockerin_dom_fun

SEQ ID NO: 22168 - DNA, 129 bp, Piromyces finnis; identical to SEQ ID NO: 19490
  Dockerin_dom_fun

SEQ ID NO: 22169 - DNA, 117 bp, Piromyces finnis; identical to SEQ ID NO: 19491
  Dockerin_dom_fun

SEQ ID NO: 22170 - DNA, 129 bp, Piromyces finnis; identical to SEQ ID NO: 19490
  Dockerin_dom_fun

SEQ ID NO: 22171 - DNA, 129 bp, Piromyces finnis; identical to SEQ ID NO: 19493
  Dockerin_dom_fun

SEQ ID NO: 22172 - DNA, 120 bp, Piromyces finnis
  Dockerin_dom_fun
atgttggtcaaaaccacttggttatgattgttgtgttgatccatacattcaaatagcatattctgatgatgatggtgattggggttatgaaaatgatgaatggtgtggtattatagaaaa

SEQ ID NO: 22173 - DNA, 105 bp, Piromyces finnis
  Dockerin_dom_fun
ttacccatgctgtaaaagatcctgtattgttgtcgaagaaaatgcatctggtaaatggagtcttgaaaagcatgattggtgtttaattgatcttgaagtttgtcg

SEQ ID NO: 22174 - DNA, 120 bp, Piromyces finnis; identical to SEQ ID NO: 19496
  Dockerin_dom_fun

SEQ ID NO: 22175 - DNA, 129 bp, Piromyces finnis; identical to SEQ ID NO: 19490
  Dockerin_dom_fun

SEQ ID NO: 22176 - DNA, 120 bp, Piromyces finnis
  Dockerin_dom_fun
atgctgggccgaaaaattaggttataaatgttgtccagacgatgtatgtacaacacttcatagtgacgctaacggagaatggagtattgtaaatgatgaatggtgtggtattatagaaaa

SEQ ID NO: 22177 - DNA, 88 bp, Piromyces finnis; identical to SEQ ID NO: 16979
  Dockerin_dom_fun

SEQ ID NO: 22178 - DNA, 138 bp, Piromyces finnis
  Dockerin_dom_fun
atgctggtccttagctttatcaattccatgttgtaacaaaaataaagaaatctactccaaggatcaagatggtaactggggtataacaacggatgaaaatggaaattcaatatggtgtggtataagaaaaagtaagcc

SEQ ID NO: 22179 - DNA, 120 bp, Piromyces finnis; identical to SEQ ID NO: 19500
  Dockerin_dom_fun

SEQ ID NO: 22180 - DNA, 120 bp, Piromyces finnis
  Dockerin_dom_fun
ttggtccagagctggtggatatccatgttgtgaaggtggtgaatctattgctttaattgatcaagatggtatatggggtcaaaatgctaatggcaattggtgtggatttagagaaaggaa

SEQ ID NO: 22181 - DNA, 126 bp, Piromyces finnis
  Dockerin_dom_fun
ttggtcagaaaaattaggttacccatgttgtccagaagaaataactcagcctaattataaagatagtgaaggcgattgggtttttaatagtaatggtgaatggtgtggcataagaaatggtagatg

SEQ ID NO: 22182 - DNA, 123 bp, Piromyces finnis
  Dockerin_dom_fun
atgttggtccagagctggtggatatccatgttgtgaaggtggtgaatctattgctttaattgatcaagatggtatatggggtcaaaatgctaatggcaattggtgtggatttagagaaaggaa

SEQ ID NO: 22183 - DNA, 91 bp, Piromyces finnis
  Dockerin_dom_fun
taagtgttgggctagtctattaggttacaaatgttgtgttggaactaatccagcagtagtttttgttgatgatgatggtaaatggggtgta

SEQ ID NO: 22184 - DNA, 120 bp, Piromyces finnis
  Dockerin_dom_fun
ttggtcagaaaaattaggttacccatgttgtccagaagaaataactcagcctaattataaagatagtgaaggcgattgggtttttaatagtaatggtgaatggtgtggcataagaaatgg

SEQ ID NO: 22185 - DNA, 111 bp, Piromyces finnis
  Dockerin_dom_fun
ctggtctcttccacattaccaatgttgtaagggtaatgttgttgttcaatctgatagcaatggtgattggggttacgaagacggtcaatggtgtggtatcatcaagaagac

SEQ ID NO: 22186 - DNA, 117 bp, Piromyces finnis
  Dockerin_dom_fun
ctgctggtcactcccagactatccatgttgtaagactaccagcctcgttgtctcatctgatgctgaaggtgactggggttatgaagacaaccaatggtgtggtatcgtaaaggatgc

SEQ ID NO: 22187 - DNA, 123 bp, Piromyces finnis; identical to SEQ ID NO: 19508
  Dockerin_dom_fun

SEQ ID NO: 22188 - DNA, 111 bp, Piromyces finnis; identical to SEQ ID NO: 22185
  Dockerin_dom_fun

SEQ ID NO: 22189 - DNA, 117 bp, Piromyces finnis; identical to SEQ ID NO: 22186
  Dockerin_dom_fun

SEQ ID NO: 22190 - DNA, 123 bp, Piromyces finnis; identical to SEQ ID NO: 19510
  Dockerin_dom_fun

SEQ ID NO: 22191 - DNA, 111 bp, Piromyces finnis
  Dockerin_dom_fun
ttggtctcttccacattaccaatgttgtaagggtaatgaagttgttttcactgatcataacggtgactggggtttcgaaaataaccaatggtgtggtattgttaaaaaagc

SEQ ID NO: 22192 - DNA, 96 bp, Piromyces finnis
  Dockerin_dom_fun
cccatgttgtaaaaatactagtcttgttgttgcttctgatgcacaaggtgactggggttatgaagataatcaatggtgtggtattgtaaaggatgc

SEQ ID NO: 22193 - DNA, 97 bp, Piromyces finnis
  Dockerin_dom_fun
tccatgttgcccaacttgcgacgttttcttaactgaagaagatggtaatcgttggggtgttctatatgataactggtgtagtattaagaattcctgt

SEQ ID NO: 22194 - DNA, 123 bp, Piromyces finnis; identical to SEQ ID NO: 19516
  Dockerin_dom_fun

SEQ ID NO: 22195 - DNA, 111 bp, Piromyces finnis
  Dockerin_dom_fun
aaaaaaacaaggatatccatgttgttcaagttgtattgtgtatttttctgataaagatggccaatggggtgtagaaaatggtaaatggtgtggtattcaagattattgtaa

SEQ ID NO: 22196 - DNA, 117 bp, Piromyces finnis
  Dockerin_dom_fun
ttgtttctctacaaagttaggttacccatgctgtacttcaactactcaagttgttttcaccgataatgatggtaactggggtgttgaaaacaacgactggtgtggtttaactaacaa

SEQ ID NO: 22197 - DNA, 117 bp, Piromyces finnis; identical to SEQ ID NO: 22196
  Dockerin_dom_fun

SEQ ID NO: 22198 - DNA, 124 bp, Piromyces finnis; identical to SEQ ID NO: 19520
  Dockerin_dom_fun

SEQ ID NO: 22199 - DNA, 69 bp, Piromyces finnis
  Dockerin_dom_fun
tccatgttgtgaagactgtgttgttgtttatgaagataatcaaaagtggggcattttaaataatgatcc

SEQ ID NO: 22200 - DNA, 70 bp, Piromyces finnis
  Dockerin_dom_fun
tccatgttgtgaagactgtgttgttgtttatgaagataatcaaaagtggggcattttaaataatgactgg

SEQ ID NO: 22201 - DNA, 124 bp, Piromyces finnis; identical to SEQ ID NO: 19521
  Dockerin_dom_fun

SEQ ID NO: 22202 - DNA, 123 bp, Piromyces finnis
  Dockerin_dom_fun
ctgtgctgccgcttctcaaggttatccatgctgcaaaaaccaaaatgctgaagtttactaccaagatgaaactggtgattggggtattgaaaatggtgaatggtgtggtatcactaaggctca

SEQ ID NO: 22203 - DNA, 93 bp, Piromyces finnis
  Dockerin_dom_fun
tccatgttgtgaagactgtgttgttgtttatgaagataatcaaaagtggggcattttaaataatgactggtgtagtactccatattcatgtga

SEQ ID NO: 22204 - DNA, 100 bp, Piromyces finnis; identical to SEQ ID NO: 17007
  Dockerin_dom_fun

SEQ ID NO: 22205 - DNA, 103 bp, Piromyces finnis; identical to SEQ ID NO: 17009
  Dockerin_dom_fun

SEQ ID NO: 22206 - DNA, 120 bp, Piromyces finnis; identical to SEQ ID NO: 19527
  Dockerin_dom_fun

SEQ ID NO: 22207 - DNA, 120 bp, Piromyces finnis; identical to SEQ ID NO: 19526
  Dockerin_dom_fun

SEQ ID NO: 22208 - DNA, 120 bp, Piromyces finnis; identical to SEQ ID NO: 19528
  Dockerin_dom_fun

SEQ ID NO: 22209 - DNA, 96 bp, Piromyces finnis
  Dockerin_dom_fun
tccatgttgtgacagttgtgatgtagtcttctctgatactcttggtgactggggtgttcaaaacgatcaatggtgtggtattaaagcatcatgtaa

SEQ ID NO: 22210 - DNA, 123 bp, Piromyces finnis; identical to SEQ ID NO: 19529
  Dockerin_dom_fun

SEQ ID NO: 22211 - DNA, 76 bp, Piromyces finnis
  Dockerin_dom_fun
ttacccatgttgtaaatccacatgcaatgttgttgataccgatgctaacggtaaatggggtgttgaaaatggtgaa

SEQ ID NO: 22212 - DNA, 102 bp, Piromyces finnis
  Dockerin_dom_fun
aaattatccttgttgtccggaaggaacgccaattcaatattcagatgatgaaggagattggggtgtttatatggataattggtgtggtatcgttaaaaatat

SEQ ID NO: 22213 - DNA, 123 bp, Piromyces finnis; identical to SEQ ID NO: 19531
  Dockerin_dom_fun

SEQ ID NO: 22214 - DNA, 123 bp, Piromyces finnis; identical to SEQ ID NO: 19531
  Dockerin_dom_fun

SEQ ID NO: 22215 - DNA, 102 bp, Piromyces finnis; identical to SEQ ID NO: 22212
  Dockerin_dom_fun

SEQ ID NO: 22216 - DNA, 114 bp, Piromyces finnis
  Dockerin_dom_fun
atgttggtctaaacgtttaggttatgaatgttgtaaacagaaatttgaagttgttgaaaccgatgaaaatggttcatggagtatagaaaataatgaatggtgtggtattccatt

SEQ ID NO: 22217 - DNA, 117 bp, Piromyces finnis; identical to SEQ ID NO: 19537
  Dockerin_dom_fun

SEQ ID NO: 22218 - DNA, 117 bp, Piromyces finnis
  Dockerin_dom_fun
ttgttggtcagaaccaaaatatccttgttgttcagaaggtgttaaagtttattcaaaaactagtagtggtgaatggggtattgaaaatggaaattggtgtggtatacctagagatga

SEQ ID NO: 22219 - DNA, 126 bp, Piromyces finnis
  Dockerin_dom_fun
ttgttggtccttagctatatcaaattatccatgttgttcttcttttaacactgttgtaacttatacggatcaagatggtaactggggttttgaaaatgatgattggtgtggtatgagagatagtga

SEQ ID NO: 22220 - DNA, 126 bp, Piromyces finnis; identical to SEQ ID NO: 22219
  Dockerin_dom_fun

SEQ ID NO: 22221 - DNA, 120 bp, Piromyces finnis
  Dockerin_dom_fun
cacatgctgggcttcttctttaggctacgattgctgtgaaggatgtgatattataactactgatgaatatggtgaatggggtattgaaaatggaaattggtgtggtatacctagagatga

SEQ ID NO: 22222 - DNA, 120 bp, Piromyces finnis
  Dockerin_dom_fun
ttgttgggctaaacctttagggtataactgttgtcacggagaaacccaagttatatacacagataatgatggtcaatggggtagtgaagatggtaaatggtgcggtattatatcaaacaa

SEQ ID NO: 22223 - DNA, 126 bp, Piromyces finnis; identical to SEQ ID NO: 22219
  Dockerin_dom_fun

SEQ ID NO: 22224 - DNA, 120 bp, Piromyces finnis; identical to SEQ ID NO: 22222
  Dockerin_dom_fun

SEQ ID NO: 22225 - DNA, 120 bp, Piromyces finnis; identical to SEQ ID NO: 22221
  Dockerin_dom_fun

SEQ ID NO: 22226 - DNA, 117 bp, Piromyces finnis
  Dockerin_dom_fun
tccagttgaaagtaagggatacaagtgctgtaatgatccaaacttacaatcaatgtttgaagatgaagatggtcaatggtactatgaaaatgatgaatggtgtttaattgtatcaag

SEQ ID NO: 22227 - DNA, 120 bp, Piromyces finnis; identical to SEQ ID NO: 22222
  Dockerin_dom_fun

SEQ ID NO: 22228 - DNA, 117 bp, Piromyces finnis; identical to SEQ ID NO: 22218
  Dockerin_dom_fun

SEQ ID NO: 22229 - DNA, 126 bp, Piromyces finnis; identical to SEQ ID NO: 22219
  Dockerin_dom_fun

SEQ ID NO: 22230 - DNA, 120 bp, Piromyces finnis; identical to SEQ ID NO: 22222
  Dockerin_dom_fun

SEQ ID NO: 22231 - DNA, 117 bp, Piromyces finnis; identical to SEQ ID NO: 22218
  Dockerin_dom_fun

SEQ ID NO: 22232 - DNA, 126 bp, Piromyces finnis; identical to SEQ ID NO: 22219
  Dockerin_dom_fun

SEQ ID NO: 22233 - DNA, 117 bp, Piromyces finnis; identical to SEQ ID NO: 22226
  Dockerin_dom_fun

SEQ ID NO: 22234 - DNA, 114 bp, Piromyces finnis; identical to SEQ ID NO: 19554
  Dockerin_dom_fun

SEQ ID NO: 22235 - DNA, 108 bp, Piromyces finnis
  Dockerin_dom_fun
cactggttattcatgctgttctaatccaaatgcctatgtttacactaccgatatcaccggtaattggagtattgaaggtaattattggtgtttaattgttaaggatgt

SEQ ID NO: 22236 - DNA, 73 bp, Piromyces finnis; identical to SEQ ID NO: 17040
  Dockerin_dom_fun

SEQ ID NO: 22237 - DNA, 123 bp, Piromyces finnis; identical to SEQ ID NO: 19556
  Dockerin_dom_fun

SEQ ID NO: 22238 - DNA, 93 bp, Piromyces finnis
  Dockerin_dom_fun
taagtgttgtaaaaaatgtaaagtagtttacactgataactatttatggggagcagaacataatgaatggtgttcaattccatattcatgtaa

SEQ ID NO: 22239 - DNA, 99 bp, Piromyces finnis; identical to SEQ ID NO: 19558
  Dockerin_dom_fun

SEQ ID NO: 22240 - DNA, 124 bp, Piromyces finnis
  Dockerin_dom_fun
taatgctgaattcatcaaacaaggttacaagtgctgttcaggatgtagaactgtctactacactgatgatcttggtgactggggtgttgaagatggtgattggtgtggtattccaaccaattgt

SEQ ID NO: 22241 - DNA, 99 bp, Piromyces finnis
  Dockerin_dom_fun
tgaatgttgtaataattgtcaagttatagaaactgatgatgaaggtagatggggtagccttaacggtgaatggtgtttcatcgatgaaagcaaatgtgg

SEQ ID NO: 22242 - DNA, 124 bp, Piromyces finnis; identical to SEQ ID NO: 22240
  Dockerin_dom_fun

SEQ ID NO: 22243 - DNA, 120 bp, Piromyces finnis; identical to SEQ ID NO: 19561
  Dockerin_dom_fun

SEQ ID NO: 22244 - DNA, 99 bp, Piromyces finnis; identical to SEQ ID NO: 22241
  Dockerin_dom_fun

SEQ ID NO: 22245 - DNA, 120 bp, Piromyces finnis; identical to SEQ ID NO: 19561
  Dockerin_dom_fun

SEQ ID NO: 22246 - DNA, 124 bp, Piromyces finnis; identical to SEQ ID NO: 22240
  Dockerin_dom_fun

SEQ ID NO: 22247 - DNA, 117 bp, Piromyces finnis
  Dockerin_dom_fun
ttggtctcttaaagaaggttatcaatgttgtcaagatgaaaaaactaccattattccaacaaaagatggaaaagaatggggtatagaaaataacgaatggtgtggtatcactgatct

SEQ ID NO: 22248 - DNA, 93 bp, Piromyces finnis
  Dockerin_dom_fun
taaatgttgtaagaatacctgtacaattacattcgaggataattatctatggggttttgaagatgattggtgtttaattccatattcttgtaa

SEQ ID NO: 22249 - DNA, 105 bp, Piromyces finnis
  Dockerin_dom_fun
ttctggttatccatgttgtgttttcaccactacagttataatgtcagatagatcaggtaattggggtatagaatatggtcaatggtgttacataaaagaggaatg

SEQ ID NO: 22250 - DNA, 96 bp, Piromyces finnis
  Dockerin_dom_fun
ttcaggttatccatgttgtgtaaaaactaaaactcttgtttccagtgatgctgttggtgactggggtattgaaaataatgactggtgtctctttga

SEQ ID NO: 22251 - DNA, 93 bp, Piromyces finnis
  Dockerin_dom_fun
caaatgttgtgaaaaatgtaaagtagtttacagtgatggtgaagattggggtgttgaacatggaaattggtgttcaattccatacagctgtgc

SEQ ID NO: 22252 - DNA, 120 bp, Piromyces finnis
  Dockerin_dom_fun
atgttggtcagaagttttgggctattcttgttgtaaagataagaaaacaaaggtttcctatgttgatgcatcaggtgaatggggtgctgaacatggtcaatggtgtggtattactgacct

SEQ ID NO: 22253 - DNA, 61 bp, Piromyces finnis
  Dockerin_dom_fun
taaatgttgtaaaaaatgtgaagttatcatgacagatgatgatggtgattggggtattgaa

SEQ ID NO: 22254 - DNA, 102 bp, Piromyces finnis
  Dockerin_dom_fun
tactggctataattgttgtctctctgataaaactccctctagtactaccgataatattggtaagtggggtattgaaggtggtgattggtgtcttattgaagc

SEQ ID NO: 22255 - DNA, 120 bp, Piromyces finnis; identical to SEQ ID NO: 19573
  Dockerin_dom_fun

SEQ ID NO: 22256 - DNA, 61 bp, Piromyces finnis; identical to SEQ ID NO: 22253
  Dockerin_dom_fun

SEQ ID NO: 22257 - DNA, 120 bp, Piromyces finnis; identical to SEQ ID NO: 19573
  Dockerin_dom_fun

SEQ ID NO: 22258 - DNA, 102 bp, Piromyces finnis; identical to SEQ ID NO: 22254
  Dockerin_dom_fun

SEQ ID NO: 22259 - DNA, 96 bp, Piromyces finnis; identical to SEQ ID NO: 22250
  Dockerin_dom_fun

SEQ ID NO: 22260 - DNA, 93 bp, Piromyces finnis; identical to SEQ ID NO: 22251
  Dockerin_dom_fun

SEQ ID NO: 22261 - DNA, 120 bp, Piromyces finnis; identical to SEQ ID NO: 22252
  Dockerin_dom_fun

SEQ ID NO: 22262 - DNA, 96 bp, Piromyces finnis; identical to SEQ ID NO: 22250
  Dockerin_dom_fun

SEQ ID NO: 22263 - DNA, 93 bp, Piromyces finnis; identical to SEQ ID NO: 22251
  Dockerin_dom_fun

SEQ ID NO: 22264 - DNA, 120 bp, Piromyces finnis; identical to SEQ ID NO: 22252
  Dockerin_dom_fun

SEQ ID NO: 22265 - DNA, 120 bp, Piromyces finnis; identical to SEQ ID NO: 19573
  Dockerin_dom_fun

SEQ ID NO: 22266 - DNA, 102 bp, Piromyces finnis; identical to SEQ ID NO: 22254
  Dockerin_dom_fun

SEQ ID NO: 22267 - DNA, 61 bp, Piromyces finnis; identical to SEQ ID NO: 22253
  Dockerin_dom_fun

SEQ ID NO: 22268 - DNA, 61 bp, Piromyces finnis; identical to SEQ ID NO: 22253
  Dockerin_dom_fun

SEQ ID NO: 22269 - DNA, 120 bp, Piromyces finnis; identical to SEQ ID NO: 19573
  Dockerin_dom_fun

SEQ ID NO: 22270 - DNA, 102 bp, Piromyces finnis; identical to SEQ ID NO: 22254
  Dockerin_dom_fun

SEQ ID NO: 22271 - DNA, 129 bp, Piromyces finnis; identical to SEQ ID NO: 19589
  Dockerin_dom_fun

SEQ ID NO: 22272 - DNA, 67 bp, Piromyces finnis
  Dockerin_dom_fun
taaatgttgtcaagaatgcaatatttcctatactgatactgaagattggggtattgaaaatggtaat

SEQ ID NO: 22273 - DNA, 108 bp, Piromyces finnis
  Dockerin_dom_fun
ttctggttatagttgttgttccctttcaaatactgaagttagaactaccgatgcggtaggtaaatggggtattgaaggtgaagaatggtgtcttattgatgaagaagt

SEQ ID NO: 22274 - DNA, 61 bp, Piromyces finnis; identical to SEQ ID NO: 22253
  Dockerin_dom_fun

SEQ ID NO: 22275 - DNA, 120 bp, Piromyces finnis; identical to SEQ ID NO: 19573
  Dockerin_dom_fun

SEQ ID NO: 22276 - DNA, 102 bp, Piromyces finnis; identical to SEQ ID NO: 22254
  Dockerin_dom_fun

SEQ ID NO: 22277 - DNA, 93 bp, Piromyces finnis; identical to SEQ ID NO: 22251
  Dockerin_dom_fun

SEQ ID NO: 22278 - DNA, 96 bp, Piromyces finnis; identical to SEQ ID NO: 22250
  Dockerin_dom_fun

SEQ ID NO: 22279 - DNA, 120 bp, Piromyces finnis; identical to SEQ ID NO: 22252
  Dockerin_dom_fun

SEQ ID NO: 22280 - DNA, 120 bp, Piromyces finnis; identical to SEQ ID NO: 22252
  Dockerin_dom_fun

SEQ ID NO: 22281 - DNA, 93 bp, Piromyces finnis; identical to SEQ ID NO: 22251
  Dockerin_dom_fun

SEQ ID NO: 22282 - DNA, 96 bp, Piromyces finnis; identical to SEQ ID NO: 22250
  Dockerin_dom_fun

SEQ ID NO: 22283 - DNA, 132 bp, Piromyces finnis
  Dockerin_dom_fun
atgttggtctcttgctgaaggttatccatgttgtaagaatcaaaatactccagttaaatatgaatctaaatcaagaggtgttaaatacggtattgaaaacggtgattggtgtggtcttattgaatcaaaaca

SEQ ID NO: 22284 - DNA, 105 bp, Piromyces finnis; identical to SEQ ID NO: 17088
  Dockerin_dom_fun

SEQ ID NO: 22285 - DNA, 117 bp, Piromyces finnis
  Dockerin_dom_fun
ttgttggtcctctaagattggttatccatgttgtaaggaaaacaacgttatttacgccattgactctcaaggtagttggggttatgaaaatgattcatggtgtggtatttcaaaggt

SEQ ID NO: 22286 - DNA, 120 bp, Piromyces finnis; identical to SEQ ID NO: 19602
  Dockerin_dom_fun

SEQ ID NO: 22287 - DNA, 124 bp, Piromyces finnis
  Dockerin_dom_fun
ctcatgttctggtgctttaggatacccatgctgtaaatctgcctgcactgtctatgatactgatagtaatggaaaatggagtatcgaaaataatgactggtgtttaattgataacagcaagtgc

SEQ ID NO: 22288 - DNA, 120 bp, Piromyces finnis; identical to SEQ ID NO: 19604
  Dockerin_dom_fun

SEQ ID NO: 22289 - DNA, 99 bp, Piromyces finnis
  Dockerin_dom_fun
ttatccatgttgtaatgaatgtgaagttatttacactgataacgatggtgactggggtgttgaaaataacgaatggtgtttaattaataagttagtttg

SEQ ID NO: 22290 - DNA, 111 bp, Piromyces finnis; identical to SEQ ID NO: 19608
  Dockerin_dom_fun

SEQ ID NO: 22291 - DNA, 97 bp, Piromyces finnis; identical to SEQ ID NO: 17092
  Dockerin_dom_fun

SEQ ID NO: 22292 - DNA, 115 bp, Piromyces finnis
  Dockerin_dom_fun
tactggtatgaactctggttatcaatgttgtgatacttgtaatgttgtctacactgataatgatggtaaatggggtattatgaatggtgaatggtgtggtattaagagtagctgt

SEQ ID NO: 22293 - DNA, 126 bp, Piromyces finnis; identical to SEQ ID NO: 19610
  Dockerin_dom_fun

SEQ ID NO: 22294 - DNA, 115 bp, Piromyces finnis; identical to SEQ ID NO: 22292
  Dockerin_dom_fun

SEQ ID NO: 22295 - DNA, 114 bp, Piromyces finnis; identical to SEQ ID NO: 19349
  Dockerin_dom_fun

SEQ ID NO: 22296 - DNA, 99 bp, Piromyces finnis
  Dockerin_dom_fun
cgcctgctgtagtggatgtgaatcagtctatgttgacaatgatggtaaatggggtgttgaaaatggtaattggtgtcttattaaggaatcaaaatgcgg

SEQ ID NO: 22297 - DNA, 99 bp, Piromyces finnis; identical to SEQ ID NO: 22289
  Dockerin_dom_fun

SEQ ID NO: 22298 - DNA, 111 bp, Piromyces finnis; identical to SEQ ID NO: 19608
  Dockerin_dom_fun

SEQ ID NO: 22299 - DNA, 97 bp, Piromyces finnis; identical to SEQ ID NO: 17092
  Dockerin_dom_fun

SEQ ID NO: 22300 - DNA, 115 bp, Piromyces finnis; identical to SEQ ID NO: 22292
  Dockerin_dom_fun

SEQ ID NO: 22301 - DNA, 114 bp, Piromyces finnis; identical to SEQ ID NO: 19349
  Dockerin_dom_fun

SEQ ID NO: 22302 - DNA, 99 bp, Piromyces finnis; identical to SEQ ID NO: 22296
  Dockerin_dom_fun

SEQ ID NO: 22303 - DNA, 111 bp, Piromyces finnis; identical to SEQ ID NO: 19608
  Dockerin_dom_fun

SEQ ID NO: 22304 - DNA, 99 bp, Piromyces finnis; identical to SEQ ID NO: 22289
  Dockerin_dom_fun

SEQ ID NO: 22305 - DNA, 97 bp, Piromyces finnis; identical to SEQ ID NO: 17092
  Dockerin_dom_fun

SEQ ID NO: 22306 - DNA, 115 bp, Piromyces finnis; identical to SEQ ID NO: 22292
  Dockerin_dom_fun

SEQ ID NO: 22307 - DNA, 114 bp, Piromyces finnis; identical to SEQ ID NO: 19349
  Dockerin_dom_fun

SEQ ID NO: 22308 - DNA, 99 bp, Piromyces finnis; identical to SEQ ID NO: 22296
  Dockerin_dom_fun

SEQ ID NO: 22309 - DNA, 124 bp, Piromyces finnis; identical to SEQ ID NO: 22287
  Dockerin_dom_fun

SEQ ID NO: 22310 - DNA, 117 bp, Piromyces finnis
  Dockerin_dom_fun
tttctctgaaaagttaggttacaaatgctgtaaggcatgtgatactatttacaccgatgaaagtggtgactggggtttcgaaaacaatgactggtgtggtattgcttctagctgcac

SEQ ID NO: 22311 - DNA, 120 bp, Piromyces finnis
  Dockerin_dom_fun
ctgggctagtaagcttggatttaaatgttgtacctcccaatgtccacaagaagtttacgttgatactgatggtagttggggtgttgaaaacaacaactggtgtggtatagtttctgaaac

SEQ ID NO: 22312 - DNA, 105 bp, Piromyces finnis
  Dockerin_dom_fun
aagtggatatccatactgtaagaccaccactgatgttgtttacactgacagtgtcaaatggggtattgaaaacaatgactggtgcggtatcgttgattcttcctg

SEQ ID NO: 22313 - DNA, 123 bp, Piromyces finnis; identical to SEQ ID NO: 19630
  Dockerin_dom_fun

SEQ ID NO: 22314 - DNA, 126 bp, Piromyces finnis
  Dockerin_dom_fun
ttgctgggctgaacttctcggttacagttgctgtagtactaaaacttgtagaaatgctgtctacactgatgatgatggccaatgggatgttgaaaatggtaattggtgtggtattggtggatctac

SEQ ID NO: 22315 - DNA, 120 bp, Piromyces finnis; identical to SEQ ID NO: 19632
  Dockerin_dom_fun

SEQ ID NO: 22316 - DNA, 120 bp, Piromyces finnis; identical to SEQ ID NO: 22311
  Dockerin_dom_fun

SEQ ID NO: 22317 - DNA, 60 bp, Piromyces finnis
  Dockerin_dom_fun
tgctagtggtcgttggggtattgaaaacaatgactggtgcggtatcgttgattcttcctg

SEQ ID NO: 22318 - DNA, 126 bp, Piromyces finnis; identical to SEQ ID NO: 22314
  Dockerin_dom_fun

SEQ ID NO: 22319 - DNA, 120 bp, Piromyces finnis; identical to SEQ ID NO: 22311
  Dockerin_dom_fun

SEQ ID NO: 22320 - DNA, 126 bp, Piromyces finnis; identical to SEQ ID NO: 22314
  Dockerin_dom_fun

SEQ ID NO: 22321 - DNA, 105 bp, Piromyces finnis; identical to SEQ ID NO: 22312
  Dockerin_dom_fun

SEQ ID NO: 22322 - DNA, 120 bp, Piromyces finnis; identical to SEQ ID NO: 22311
  Dockerin_dom_fun

SEQ ID NO: 22323 - DNA, 123 bp, Piromyces finnis; identical to SEQ ID NO: 19630
  Dockerin_dom_fun

SEQ ID NO: 22324 - DNA, 60 bp, Piromyces finnis; identical to SEQ ID NO: 22317
  Dockerin_dom_fun

SEQ ID NO: 22325 - DNA, 117 bp, Piromyces finnis
  Dockerin_dom_fun
ttgctggtctgaagaattaggttatccatgttgtacctctactactaaggttgtttacactgatgaaagtggttcctggggtattgaaaacggtgactggtgcggtattaagaagtg

SEQ ID NO: 22326 - DNA, 123 bp, Piromyces finnis; identical to SEQ ID NO: 19630
  Dockerin_dom_fun

SEQ ID NO: 22327 - DNA, 120 bp, Piromyces finnis; identical to SEQ ID NO: 19632
  Dockerin_dom_fun

SEQ ID NO: 22328 - DNA, 48 bp, Piromyces finnis
  Dockerin_dom_fun
atggggtgttgaaaacaacaaatggtgtggtattccaagtaactgtaa

SEQ ID NO: 22329 - DNA, 118 bp, Piromyces finnis; identical to SEQ ID NO: 19645
  Dockerin_dom_fun

SEQ ID NO: 22330 - DNA, 99 bp, Piromyces finnis
  Dockerin_dom_fun
gggttacccatgttgtaccaatccatcaactaccgttttctatgttgatgaagatggtaactggggtttagaaaatgataactggtgtattatgaaaaa

SEQ ID NO: 22331 - DNA, 102 bp, Piromyces finnis
  Dockerin_dom_fun
tccatattgtagtggatgtgaatccaattatcaagatgctgatggtgaatggtattttgttgataacaaatggtgtaaggtaaatgaaaagaaatgtaaagc

SEQ ID NO: 22332 - DNA, 120 bp, Piromyces finnis; identical to SEQ ID NO: 19646
  Dockerin_dom_fun

SEQ ID NO: 22333 - DNA, 94 bp, Piromyces finnis
  Dockerin_dom_fun
atgttggtcaaaagaacttggttttgaatgttgcaaatcctgtgtaactcaatatactgatgaagatggtcaatggggttatgaagatgattgg

SEQ ID NO: 22334 - DNA, 76 bp, Piromyces finnis
  Dockerin_dom_fun
tccatgttgttcctctggtactagtgtagtttacactgacgctagtggttcatggggtgttgaaaataatgaatgg

SEQ ID NO: 22335 - DNA, 117 bp, Piromyces finnis; identical to SEQ ID NO: 19651
  Dockerin_dom_fun

SEQ ID NO: 22336 - DNA, 120 bp, Piromyces finnis; identical to SEQ ID NO: 19650
  Dockerin_dom_fun

SEQ ID NO: 22337 - DNA, 117 bp, Piromyces finnis; identical to SEQ ID NO: 19655
  Dockerin_dom_fun

SEQ ID NO: 22338 - DNA, 76 bp, Piromyces finnis
  Dockerin_dom_fun
tccatgttgttcctctggtactagtgtagcctacactgatgctagtggttcatggggtgttgaaaataatgaatgg

SEQ ID NO: 22339 - DNA, 120 bp, Piromyces finnis; identical to SEQ ID NO: 19650
  Dockerin_dom_fun

SEQ ID NO: 22340 - DNA, 96 bp, Piromyces finnis
  Dockerin_dom_fun
tccatgttgctcaaaatgtaatattgtattcacagatgaagaaggagattggggttacgaaaaaggagattggtgtggtattagagataattgtaa

SEQ ID NO: 22341 - DNA, 123 bp, Piromyces finnis; identical to SEQ ID NO: 19657
  Dockerin_dom_fun

SEQ ID NO: 22342 - DNA, 120 bp, Piromyces finnis; identical to SEQ ID NO: 19658
  Dockerin_dom_fun

SEQ ID NO: 22343 - DNA, 97 bp, Piromyces finnis; identical to SEQ ID NO: 17145
  Dockerin_dom_fun

SEQ ID NO: 22344 - DNA, 97 bp, Piromyces finnis; identical to SEQ ID NO: 17146
  Dockerin_dom_fun

SEQ ID NO: 22345 - DNA, 114 bp, Piromyces finnis
  Dockerin_dom_fun
ttgctgggctaagccattaggttacaactgttgtacttcaactactcaagctgtctacactgatagcgatggtaagtggggtgttgaaaacggtgactggtgtggtattgttac

SEQ ID NO: 22346 - DNA, 120 bp, Piromyces finnis
  Dockerin_dom_fun
ctgctggtctcaaagtttaggttacccatgttgttcctctgctagtgctaaggttgaatacactgatgccgatggtaagtggggtattgaaaacggtaactggtgtggtattccagctgc

SEQ ID NO: 22347 - DNA, 117 bp, Piromyces finnis
  Dockerin_dom_fun
ttgctggtcccaaaaattaggttacccatgctgttcttccagctctgctcaagtttggttcaccgataatgatggtgaatggggtgttgaaaacggtgactggtgtggtattgttgc

SEQ ID NO: 22348 - DNA, 117 bp, Piromyces finnis
  Dockerin_dom_fun
ttgctggtcccaaaaattaggttacccatgctgttcttccagctctgctcaagtttggttcaccgataatgatggtgaatggggtgttgaaaacggtgactggtgtggtattgttac

SEQ ID NO: 22349 - DNA, 120 bp, Piromyces finnis; identical to SEQ ID NO: 19665
  Dockerin_dom_fun

SEQ ID NO: 22350 - DNA, 120 bp, Piromyces finnis; identical to SEQ ID NO: 22346
  Dockerin_dom_fun

SEQ ID NO: 22351 - DNA, 120 bp, Piromyces finnis
  Dockerin_dom_fun
ttgctgggctaagccattaggttacaactgttgtacttcaactactcaagctgtctacactgatagcgatggtaagtggggtgttgaaaacggtgactggtgtggtattccaaaggctga

SEQ ID NO: 22352 - DNA, 120 bp, Piromyces finnis; identical to SEQ ID NO: 19665
  Dockerin_dom_fun

SEQ ID NO: 22353 - DNA, 123 bp, Piromyces finnis
  Dockerin_dom_fun
ttgctggtcccaaaaattaggttacccatgctgttcttccagctctgctcaagtttggttcaccgataatgatggtgaatggggtgttgaaaacggtgactggtgtggtattccaaaggctga

SEQ ID NO: 22354 - DNA, 114 bp, Piromyces finnis; identical to SEQ ID NO: 22345
  Dockerin_dom_fun

SEQ ID NO: 22355 - DNA, 120 bp, Piromyces finnis; identical to SEQ ID NO: 22346
  Dockerin_dom_fun

SEQ ID NO: 22356 - DNA, 120 bp, Piromyces finnis; identical to SEQ ID NO: 19665
  Dockerin_dom_fun

SEQ ID NO: 22357 - DNA, 123 bp, Piromyces finnis; identical to SEQ ID NO: 22353
  Dockerin_dom_fun

SEQ ID NO: 22358 - DNA, 117 bp, Piromyces finnis; identical to SEQ ID NO: 22347
  Dockerin_dom_fun

SEQ ID NO: 22359 - DNA, 114 bp, Piromyces finnis
  Dockerin_dom_fun
ttgctgggctaagccattaggttacaactgttgtacttcaactactcaagctgtctacactgatagcgatggtaagtggggtgttgaaaacggtgactggtgtggtattgttgc

SEQ ID NO: 22360 - DNA, 120 bp, Piromyces finnis; identical to SEQ ID NO: 22346
  Dockerin_dom_fun

SEQ ID NO: 22361 - DNA, 117 bp, Piromyces finnis; identical to SEQ ID NO: 22347
  Dockerin_dom_fun

SEQ ID NO: 22362 - DNA, 114 bp, Piromyces finnis; identical to SEQ ID NO: 22345
  Dockerin_dom_fun

SEQ ID NO: 22363 - DNA, 120 bp, Piromyces finnis; identical to SEQ ID NO: 22346
  Dockerin_dom_fun

SEQ ID NO: 22364 - DNA, 114 bp, Piromyces finnis; identical to SEQ ID NO: 22359
  Dockerin_dom_fun

SEQ ID NO: 22365 - DNA, 120 bp, Piromyces finnis; identical to SEQ ID NO: 22346
  Dockerin_dom_fun

SEQ ID NO: 22366 - DNA, 120 bp, Piromyces finnis; identical to SEQ ID NO: 22346
  Dockerin_dom_fun

SEQ ID NO: 22367 - DNA, 120 bp, Piromyces finnis; identical to SEQ ID NO: 19665
  Dockerin_dom_fun

SEQ ID NO: 22368 - DNA, 120 bp, Piromyces finnis; identical to SEQ ID NO: 22351
  Dockerin_dom_fun

SEQ ID NO: 22369 - DNA, 117 bp, Piromyces finnis; identical to SEQ ID NO: 22348
  Dockerin_dom_fun

SEQ ID NO: 22370 - DNA, 120 bp, Piromyces finnis; identical to SEQ ID NO: 19665
  Dockerin_dom_fun

SEQ ID NO: 22371 - DNA, 120 bp, Piromyces finnis; identical to SEQ ID NO: 22346
  Dockerin_dom_fun

SEQ ID NO: 22372 - DNA, 120 bp, Piromyces finnis; identical to SEQ ID NO: 22351
  Dockerin_dom_fun

SEQ ID NO: 22373 - DNA, 114 bp, Piromyces finnis; identical to SEQ ID NO: 22359
  Dockerin_dom_fun

SEQ ID NO: 22374 - DNA, 120 bp, Piromyces finnis; identical to SEQ ID NO: 22346
  Dockerin_dom_fun

SEQ ID NO: 22375 - DNA, 117 bp, Piromyces finnis; identical to SEQ ID NO: 22348
  Dockerin_dom_fun

SEQ ID NO: 22376 - DNA, 120 bp, Piromyces finnis; identical to SEQ ID NO: 19665
  Dockerin_dom_fun

SEQ ID NO: 22377 - DNA, 123 bp, Piromyces finnis; identical to SEQ ID NO: 22353
  Dockerin_dom_fun

SEQ ID NO: 22378 - DNA, 120 bp, Piromyces finnis
  Dockerin_dom_fun
ttggtctactgctttcggttacagctgttgtaagtcatgtggtccagtttacttcactgacgaaagtggtaactggggtattgaaaatggtgactggtgtggtcttttaagttcatgttc

SEQ ID NO: 22379 - DNA, 120 bp, Piromyces finnis; identical to SEQ ID NO: 19309
  Dockerin_dom_fun

SEQ ID NO: 22380 - DNA, 120 bp, Piromyces finnis; identical to SEQ ID NO: 22378
  Dockerin_dom_fun

SEQ ID NO: 22381 - DNA, 85 bp, Piromyces finnis; identical to SEQ ID NO: 17183
  Dockerin_dom_fun

SEQ ID NO: 22382 - DNA, 120 bp, Piromyces finnis; identical to SEQ ID NO: 22378
  Dockerin_dom_fun

SEQ ID NO: 22383 - DNA, 85 bp, Piromyces finnis; identical to SEQ ID NO: 17183
  Dockerin_dom_fun

SEQ ID NO: 22384 - DNA, 85 bp, Piromyces finnis; identical to SEQ ID NO: 17183
  Dockerin_dom_fun

SEQ ID NO: 22385 - DNA, 120 bp, Piromyces finnis; identical to SEQ ID NO: 22378
  Dockerin_dom_fun

SEQ ID NO: 22386 - DNA, 108 bp, Piromyces finnis; identical to SEQ ID NO: 19703
  Dockerin_dom_fun

SEQ ID NO: 22387 - DNA, 123 bp, Piromyces finnis; identical to SEQ ID NO: 19702
  Dockerin_dom_fun

SEQ ID NO: 22388 - DNA, 85 bp, Piromyces finnis; identical to SEQ ID NO: 17183
  Dockerin_dom_fun

SEQ ID NO: 22389 - DNA, 120 bp, Piromyces finnis; identical to SEQ ID NO: 19309
  Dockerin_dom_fun

SEQ ID NO: 22390 - DNA, 120 bp, Piromyces finnis; identical to SEQ ID NO: 19309
  Dockerin_dom_fun

SEQ ID NO: 22391 - DNA, 108 bp, Piromyces finnis; identical to SEQ ID NO: 19703
  Dockerin_dom_fun

SEQ ID NO: 22392 - DNA, 123 bp, Piromyces finnis; identical to SEQ ID NO: 19702
  Dockerin_dom_fun

SEQ ID NO: 22393 - DNA, 85 bp, Piromyces finnis
  Dockerin_dom_fun
agctacctttacttctctaggttattcatgttgtaaaagtgaaaattgtatggtttattatcaagatgaatctggtgattggggt

SEQ ID NO: 22394 - DNA, 109 bp, Piromyces finnis; identical to SEQ ID NO: 17196
  Dockerin_dom_fun

SEQ ID NO: 22395 - DNA, 109 bp, Piromyces finnis; identical to SEQ ID NO: 17197
  Dockerin_dom_fun

SEQ ID NO: 22396 - DNA, 114 bp, Piromyces finnis; identical to SEQ ID NO: 19712
  Dockerin_dom_fun

SEQ ID NO: 22397 - DNA, 123 bp, Piromyces finnis
  Dockerin_dom_fun
ctcagctaagattactagccaaggttacaagtgctgttcttctagctgtgtcccatcttataccgatggtgatggtgattgggctattgaaaatggtgaatggtgtggtatcactaaggctca

SEQ ID NO: 22398 - DNA, 114 bp, Piromyces finnis; identical to SEQ ID NO: 19712
  Dockerin_dom_fun

SEQ ID NO: 22399 - DNA, 123 bp, Piromyces finnis
  Dockerin_dom_fun
ttcttctaagattactagccaaggttacaagtgctgttcttctagctgtgtcccatcttataccgatggtgatggtgattgggctattgaaaatggtgaatggtgtggtatcactaaggctca

SEQ ID NO: 22400 - DNA, 120 bp, Piromyces finnis; identical to SEQ ID NO: 19716
  Dockerin_dom_fun

SEQ ID NO: 22401 - DNA, 123 bp, Piromyces finnis; identical to SEQ ID NO: 19717
  Dockerin_dom_fun

SEQ ID NO: 22402 - DNA, 123 bp, Piromyces finnis; identical to SEQ ID NO: 22202
  Dockerin_dom_fun

SEQ ID NO: 22403 - DNA, 114 bp, Piromyces finnis; identical to SEQ ID NO: 19712
  Dockerin_dom_fun

SEQ ID NO: 22404 - DNA, 120 bp, Piromyces finnis; identical to SEQ ID NO: 19721
  Dockerin_dom_fun

SEQ ID NO: 22405 - DNA, 123 bp, Piromyces finnis; identical to SEQ ID NO: 19717
  Dockerin_dom_fun

SEQ ID NO: 22406 - DNA, 126 bp, Piromyces finnis; identical to SEQ ID NO: 19722
  Dockerin_dom_fun

SEQ ID NO: 22407 - DNA, 120 bp, Piromyces finnis; identical to SEQ ID NO: 19723
  Dockerin_dom_fun

SEQ ID NO: 22408 - DNA, 123 bp, Piromyces finnis; identical to SEQ ID NO: 19717
  Dockerin_dom_fun

SEQ ID NO: 22409 - DNA, 108 bp, Piromyces finnis
  Dockerin_dom_fun
agctttaggatatccatgttgttctaaaactaattgtgttgctgtttacactgatgaaactggtgattgggatgttgaaaacaatgattggtgttggtgtagaggcaa

SEQ ID NO: 22410 - DNA, 117 bp, Piromyces finnis
  Dockerin_dom_fun
ttcaattactaatcaaggttataagtgttgttctgctgaaaagtgtgaagttgtatacactgatgaatccggtgattggggtgttgaagatggtgactggtgtggttgtactgtcga

SEQ ID NO: 22411 - DNA, 117 bp, Piromyces finnis; identical to SEQ ID NO: 22410
  Dockerin_dom_fun

SEQ ID NO: 22412 - DNA, 108 bp, Piromyces finnis; identical to SEQ ID NO: 22409
  Dockerin_dom_fun

SEQ ID NO: 22413 - DNA, 91 bp, Piromyces finnis; identical to SEQ ID NO: 21986
  Dockerin_dom_fun

SEQ ID NO: 22414 - DNA, 91 bp, Piromyces finnis; identical to SEQ ID NO: 21986
  Dockerin_dom_fun

SEQ ID NO: 22415 - DNA, 91 bp, Piromyces finnis; identical to SEQ ID NO: 21986
  Dockerin_dom_fun

SEQ ID NO: 22416 - DNA, 91 bp, Piromyces finnis; identical to SEQ ID NO: 21986
  Dockerin_dom_fun

SEQ ID NO: 22417 - DNA, 99 bp, Piromyces finnis
  Dockerin_dom_fun
caattgctgtaataattgtgatgtttattacactgataacgaaggtaagtggggtgttcaaaacaacgactggtgtttcattgataacaaccgttgtgg

SEQ ID NO: 22418 - DNA, 117 bp, Piromyces finnis
  Dockerin_dom_fun
caagttcgaaagtttaggttaccgttgctgtaacggttgtgacgttgtttacaccgatagtgatggtaactggggtgttgaaaatggtaactggtgtggtattagagacaactgtaa

SEQ ID NO: 22419 - DNA, 67 bp, Piromyces finnis
  Dockerin_dom_fun
cgctaatgtcattgcccaaggttacaagtgctgttcatcctgcagtgatgtctggtacactgatgcc

SEQ ID NO: 22420 - DNA, 117 bp, Piromyces finnis; identical to SEQ ID NO: 19735
  Dockerin_dom_fun

SEQ ID NO: 22421 - DNA, 99 bp, Piromyces finnis; identical to SEQ ID NO: 22417
  Dockerin_dom_fun

SEQ ID NO: 22422 - DNA, 111 bp, Piromyces finnis
  Dockerin_dom_fun
caagttcgaaagtttaggttaccgttgctgtaacggttgtgacgttgtttacaccgatagtgatggtaactggggtgttgaaaatggtaactggtgtggtattcaaaaggg

SEQ ID NO: 22423 - DNA, 117 bp, Piromyces finnis; identical to SEQ ID NO: 19735
  Dockerin_dom_fun

SEQ ID NO: 22424 - DNA, 115 bp, Piromyces finnis
  Dockerin_dom_fun
tattactaaccaaggatatccatgctgtaagtcctgcggtaccgtctattacaccgatgctgatggtgaatggggtgtcgaaaacggtgactggtgtggtatgccaaccaaatgt

SEQ ID NO: 22425 - DNA, 117 bp, Piromyces finnis; identical to SEQ ID NO: 19740
  Dockerin_dom_fun

SEQ ID NO: 22426 - DNA, 115 bp, Piromyces finnis; identical to SEQ ID NO: 22424
  Dockerin_dom_fun

SEQ ID NO: 22427 - DNA, 117 bp, Piromyces finnis; identical to SEQ ID NO: 19740
  Dockerin_dom_fun

SEQ ID NO: 22428 - DNA, 120 bp, Piromyces finnis; identical to SEQ ID NO: 19743
  Dockerin_dom_fun

SEQ ID NO: 22429 - DNA, 67 bp, Piromyces finnis; identical to SEQ ID NO: 22419
  Dockerin_dom_fun

SEQ ID NO: 22430 - DNA, 117 bp, Piromyces finnis; identical to SEQ ID NO: 19744
  Dockerin_dom_fun

SEQ ID NO: 22431 - DNA, 117 bp, Piromyces finnis; identical to SEQ ID NO: 19744
  Dockerin_dom_fun

SEQ ID NO: 22432 - DNA, 117 bp, Piromyces finnis; identical to SEQ ID NO: 19746
  Dockerin_dom_fun

SEQ ID NO: 22433 - DNA, 67 bp, Piromyces finnis; identical to SEQ ID NO: 22419
  Dockerin_dom_fun

SEQ ID NO: 22434 - DNA, 123 bp, Piromyces finnis; identical to SEQ ID NO: 19748
  Dockerin_dom_fun

SEQ ID NO: 22435 - DNA, 102 bp, Piromyces finnis; identical to SEQ ID NO: 19747
  Dockerin_dom_fun

SEQ ID NO: 22436 - DNA, 117 bp, Piromyces finnis
  Dockerin_dom_fun
caagttcgaaagtttaggttaccgttgctgtaacggttgtgacgttgtttacaccgatagtgatggtaactggggtgttgaaaatggtaactggtgtggtattaaaccatcctgtag

SEQ ID NO: 22437 - DNA, 99 bp, Piromyces finnis; identical to SEQ ID NO: 22417
  Dockerin_dom_fun

SEQ ID NO: 22438 - DNA, 115 bp, Piromyces finnis; identical to SEQ ID NO: 22424
  Dockerin_dom_fun

SEQ ID NO: 22439 - DNA, 117 bp, Piromyces finnis; identical to SEQ ID NO: 19740
  Dockerin_dom_fun

SEQ ID NO: 22440 - DNA, 115 bp, Piromyces finnis; identical to SEQ ID NO: 22424
  Dockerin_dom_fun

SEQ ID NO: 22441 - DNA, 117 bp, Piromyces finnis; identical to SEQ ID NO: 19740
  Dockerin_dom_fun

SEQ ID NO: 22442 - DNA, 102 bp, Piromyces finnis; identical to SEQ ID NO: 19755
  Dockerin_dom_fun

SEQ ID NO: 22443 - DNA, 123 bp, Piromyces finnis
  Dockerin_dom_fun
ttctgcaaagattactagtcaaggttacaagtgttgtagtgctggatgtgtaatttactacactgatgctgatggtgattggggtgttgaaaacaatgaatggtgtggttgtggtaacagaac

SEQ ID NO: 22444 - DNA, 123 bp, Piromyces finnis
  Dockerin_dom_fun
ttgtttctccactaagttaggttacccatgctgtaaagctggtacccaagctgtttacaccgatgctgacggtgattggggtgttgaaaatggtgattggtgtggtattaaggattccaagaa

SEQ ID NO: 22445 - DNA, 106 bp, Piromyces finnis; identical to SEQ ID NO: 17243
  Dockerin_dom_fun

SEQ ID NO: 22446 - DNA, 97 bp, Piromyces finnis; identical to SEQ ID NO: 17246
  Dockerin_dom_fun

SEQ ID NO: 22447 - DNA, 120 bp, Piromyces finnis
  Dockerin_dom_fun
ttgttggtccaagtcattaggtttcgaatgttgtaccggttcagcttacgttctctacaccgatgaaaatggtcaatggggtgttgaaaatggtgattggtgtggtattggcggatcttc

SEQ ID NO: 22448 - DNA, 99 bp, Piromyces finnis
  Dockerin_dom_fun
aggttatcctttatgtaaggaaaagcatgaagatgatttagttagagatgaagatggctactgggccattgaagatggtaattggtgtggtgttcaagt

SEQ ID NO: 22449 - DNA, 114 bp, Piromyces finnis; identical to SEQ ID NO: 19761
  Dockerin_dom_fun

SEQ ID NO: 22450 - DNA, 97 bp, Piromyces finnis; identical to SEQ ID NO: 17248
  Dockerin_dom_fun

SEQ ID NO: 22451 - DNA, 120 bp, Piromyces finnis
  Dockerin_dom_fun
ttgtttctccactaagttaggttacccatgctgtaaagctggtacccaagctgtttacaccgatgctgacggtgattggggtgttgaaaatggtgattggtgtggtattggcggatcttc

SEQ ID NO: 22452 - DNA, 97 bp, Piromyces finnis; identical to SEQ ID NO: 17246
  Dockerin_dom_fun

SEQ ID NO: 22453 - DNA, 106 bp, Piromyces finnis; identical to SEQ ID NO: 17243
  Dockerin_dom_fun

SEQ ID NO: 22454 - DNA, 123 bp, Piromyces finnis
  Dockerin_dom_fun
ttgttggtccaagtcattaggtttcgaatgttgtaccggttcagcttacgttctctacaccgatgaaaatggtcaatggggtgttgaaaatggtgattggtgtggtattaaggattccaagaa

SEQ ID NO: 22455 - DNA, 114 bp, Piromyces finnis; identical to SEQ ID NO: 22345
  Dockerin_dom_fun

SEQ ID NO: 22456 - DNA, 114 bp, Piromyces finnis
  Dockerin_dom_fun
ttgctgggctaaggctttaggttacaactgttgtacttccactactcaagctatttacactgatagtgatggtaagtggggtgttgaaaacggtgactggtgtggtattgttac

SEQ ID NO: 22457 - DNA, 114 bp, Piromyces finnis; identical to SEQ ID NO: 22456
  Dockerin_dom_fun

SEQ ID NO: 22458 - DNA, 114 bp, Piromyces finnis
  Dockerin_dom_fun
ttgctgggctaaggctttaggttacaactgttgtacttccactactcaagctatttacactgatagtgatggtaagtggggtgttgaaaacggtgactggtgtggtattgttgc

SEQ ID NO: 22459 - DNA, 114 bp, Piromyces finnis; identical to SEQ ID NO: 22458
  Dockerin_dom_fun

SEQ ID NO: 22460 - DNA, 114 bp, Piromyces finnis; identical to SEQ ID NO: 22456
  Dockerin_dom_fun

SEQ ID NO: 22461 - DNA, 123 bp, Piromyces finnis
  Dockerin_dom_fun
ctgctttgccgaaaagttaggttacagttgctgtccagatggtactactgtctcttacactgatggtgatggtaaatggggtgttgtcaatggtgactggtgtggtattgctgaagaacaaaa

SEQ ID NO: 22462 - DNA, 117 bp, Piromyces finnis; identical to SEQ ID NO: 19775
  Dockerin_dom_fun

SEQ ID NO: 22463 - DNA, 114 bp, Piromyces finnis; identical to SEQ ID NO: 22359
  Dockerin_dom_fun

SEQ ID NO: 22464 - DNA, 126 bp, Piromyces finnis
  Dockerin_dom_fun
atgctgggctcaagctttaggttacccatgctgtaagaatactaaggatgttgttaccactgattctgatggtgactggggtattgaaaatggtgactggtgtggtattgttgataacagatgcat

SEQ ID NO: 22465 - DNA, 114 bp, Piromyces finnis; identical to SEQ ID NO: 22345
  Dockerin_dom_fun

SEQ ID NO: 22466 - DNA, 114 bp, Piromyces finnis; identical to SEQ ID NO: 22456
  Dockerin_dom_fun

SEQ ID NO: 22467 - DNA, 114 bp, Piromyces finnis; identical to SEQ ID NO: 22359
  Dockerin_dom_fun

SEQ ID NO: 22468 - DNA, 114 bp, Piromyces finnis; identical to SEQ ID NO: 22359
  Dockerin_dom_fun

SEQ ID NO: 22469 - DNA, 120 bp, Piromyces finnis; identical to SEQ ID NO: 19665
  Dockerin_dom_fun

SEQ ID NO: 22470 - DNA, 114 bp, Piromyces finnis; identical to SEQ ID NO: 22359
  Dockerin_dom_fun

SEQ ID NO: 22471 - DNA, 114 bp, Piromyces finnis; identical to SEQ ID NO: 22345
  Dockerin_dom_fun

SEQ ID NO: 22472 - DNA, 114 bp, Piromyces finnis; identical to SEQ ID NO: 22345
  Dockerin_dom_fun

SEQ ID NO: 22473 - DNA, 114 bp, Piromyces finnis; identical to SEQ ID NO: 22458
  Dockerin_dom_fun

SEQ ID NO: 22474 - DNA, 114 bp, Piromyces finnis; identical to SEQ ID NO: 22458
  Dockerin_dom_fun

SEQ ID NO: 22475 - DNA, 94 bp, Piromyces finnis; identical to SEQ ID NO: 17274
  Dockerin_dom_fun

SEQ ID NO: 22476 - DNA, 97 bp, Piromyces finnis
  Dockerin_dom_fun
gggttacaaatgctgtaagactacctcccaagtttatgaagttgattctgacggtaaatggggtattgaaaacaatgattggtgtttcattaaaaat

SEQ ID NO: 22477 - DNA, 123 bp, Piromyces finnis
  Dockerin_dom_fun
ttcttctaagattactagccaaggttacaagtgctgtgctagcaattgtgacgtggtttacgttgataatgatggtaactggggtgttgaaaacgatgaatggtgtggatgtggaactgaagc

SEQ ID NO: 22478 - DNA, 96 bp, Piromyces finnis
  Dockerin_dom_fun
tggttacaactgttgtagaaacacttgtgatattcaatacaaggatgacgatggtaactggggtgttgaaaacaacgactggtgtggattaaacag

SEQ ID NO: 22479 - DNA, 55 bp, Piromyces finnis
  Dockerin_dom_fun
ttgctgggctaacgctttaggttacccatgttgtacttcaactactcaagttgtt

SEQ ID NO: 22480 - DNA, 55 bp, Piromyces finnis; identical to SEQ ID NO: 22479
  Dockerin_dom_fun

SEQ ID NO: 22481 - DNA, 117 bp, Piromyces finnis; identical to SEQ ID NO: 19792
  Dockerin_dom_fun

SEQ ID NO: 22482 - DNA, 120 bp, Piromyces finnis
  Dockerin_dom_fun
ttcttctaagattactagccaaggttacaagtgctgtgctagcaattgtgacgtggtttacgttgataatgatggtaactggggtgttgaaaacaacgactggtgtggtttaactaacaa

SEQ ID NO: 22483 - DNA, 99 bp, Piromyces finnis
  Dockerin_dom_fun
tggttacaactgttgtagaaacacttgtgatattcaatacaaggatgacgatggtaactggggtgttgaaaacaacgactggtgtggtttaactaacaa

SEQ ID NO: 22484 - DNA, 42 bp, Piromyces finnis
  Dockerin_dom_fun
ttggggtgttgaaaacaataattggtgtggtattaatagtgg

SEQ ID NO: 22485 - DNA, 123 bp, Piromyces finnis; identical to SEQ ID NO: 22443
  Dockerin_dom_fun

SEQ ID NO: 22486 - DNA, 70 bp, Piromyces finnis
  Dockerin_dom_fun
ttctgcaaagattactagtcaaggttacaagtgttgtagtgctggatgtgtaatttactacactgatgct

SEQ ID NO: 22487 - DNA, 117 bp, Piromyces finnis
  Dockerin_dom_fun
atgctggtctgaagctttaggttacccatgttgtgaaggcaatgttgttataacatccgatgaaaatggtgattggggtgttgaaaacaatgaatggtgtggttgtggtaacagaac

SEQ ID NO: 22488 - DNA, 63 bp, Piromyces finnis; identical to SEQ ID NO: 19797
  Dockerin_dom_fun

SEQ ID NO: 22489 - DNA, 126 bp, Piromyces finnis; identical to SEQ ID NO: 19798
  Dockerin_dom_fun

SEQ ID NO: 22490 - DNA, 126 bp, Piromyces finnis; identical to SEQ ID NO: 19798
  Dockerin_dom_fun

SEQ ID NO: 22491 - DNA, 126 bp, Piromyces finnis; identical to SEQ ID NO: 19800
  Dockerin_dom_fun

SEQ ID NO: 22492 - DNA, 126 bp, Piromyces finnis; identical to SEQ ID NO: 19800
  Dockerin_dom_fun

SEQ ID NO: 22493 - DNA, 108 bp, Piromyces finnis; identical to SEQ ID NO: 19802
  Dockerin_dom_fun

SEQ ID NO: 22494 - DNA, 96 bp, Piromyces finnis; identical to SEQ ID NO: 19803
  Dockerin_dom_fun

SEQ ID NO: 22495 - DNA, 120 bp, Piromyces finnis; identical to SEQ ID NO: 19804
  Dockerin_dom_fun

SEQ ID NO: 22496 - DNA, 88 bp, Piromyces finnis; identical to SEQ ID NO: 17293
  Dockerin_dom_fun

SEQ ID NO: 22497 - DNA, 123 bp, Piromyces finnis; identical to SEQ ID NO: 22461
  Dockerin_dom_fun

SEQ ID NO: 22498 - DNA, 82 bp, Piromyces finnis; identical to SEQ ID NO: 17294
  Dockerin_dom_fun

SEQ ID NO: 22499 - DNA, 94 bp, Piromyces finnis; identical to SEQ ID NO: 17295
  Dockerin_dom_fun

SEQ ID NO: 22500 - DNA, 108 bp, Piromyces finnis; identical to SEQ ID NO: 19811
  Dockerin_dom_fun

SEQ ID NO: 22501 - DNA, 94 bp, Piromyces finnis
  Dockerin_dom_fun
cgaatgctgtaatggatgtaatgttgttgaccaatctgatggtcttaagtggggtgttgaaaataataattggtgcatcatcaagagttcttgc

SEQ ID NO: 22502 - DNA, 117 bp, Piromyces finnis; identical to SEQ ID NO: 19809
  Dockerin_dom_fun

SEQ ID NO: 22503 - DNA, 103 bp, Piromyces finnis; identical to SEQ ID NO: 19812
  Dockerin_dom_fun

SEQ ID NO: 22504 - DNA, 99 bp, Piromyces finnis; identical to SEQ ID NO: 22330
  Dockerin_dom_fun

SEQ ID NO: 22505 - DNA, 120 bp, Piromyces finnis; identical to SEQ ID NO: 19646
  Dockerin_dom_fun

SEQ ID NO: 22506 - DNA, 102 bp, Piromyces finnis; identical to SEQ ID NO: 22331
  Dockerin_dom_fun

SEQ ID NO: 22507 - DNA, 102 bp, Piromyces finnis
  Dockerin_dom_fun
tccatgttgttcttctgaaaatgctgaaatcgtttatactgattctgaaggtgattggggtttagaaaaaggagattggtgtcttattaaaaaaaatgaaaa

SEQ ID NO: 22508 - DNA, 97 bp, Piromyces finnis; identical to SEQ ID NO: 17303
  Dockerin_dom_fun

SEQ ID NO: 22509 - DNA, 94 bp, Piromyces finnis; identical to SEQ ID NO: 19818
  Dockerin_dom_fun

SEQ ID NO: 22510 - DNA, 79 bp, Piromyces finnis; identical to SEQ ID NO: 16824
  Dockerin_dom_fun

SEQ ID NO: 22511 - DNA, 102 bp, Piromyces finnis; identical to SEQ ID NO: 21988
  Dockerin_dom_fun

SEQ ID NO: 22512 - DNA, 102 bp, Piromyces finnis; identical to SEQ ID NO: 21989
  Dockerin_dom_fun

SEQ ID NO: 22513 - DNA, 102 bp, Piromyces finnis; identical to SEQ ID NO: 21988
  Dockerin_dom_fun

SEQ ID NO: 22514 - DNA, 102 bp, Piromyces finnis; identical to SEQ ID NO: 21989
  Dockerin_dom_fun

SEQ ID NO: 22515 - DNA, 123 bp, Piromyces finnis; identical to SEQ ID NO: 19825
  Dockerin_dom_fun

SEQ ID NO: 22516 - DNA, 94 bp, Piromyces finnis; identical to SEQ ID NO: 19824
  Dockerin_dom_fun

SEQ ID NO: 22517 - DNA, 88 bp, Piromyces finnis; identical to SEQ ID NO: 19826
  Dockerin_dom_fun

SEQ ID NO: 22518 - DNA, 123 bp, Piromyces finnis; identical to SEQ ID NO: 19827
  Dockerin_dom_fun

SEQ ID NO: 22519 - DNA, 123 bp, Piromyces finnis
  Dockerin_dom_fun
tgctagtgtattcaatcaaatgggttataaatgttgtagatcttgtaatgttgttttaactgactccactggtaaatggggtgttgaagataatgaatggtgtggtattcgtaaagattgtaa

SEQ ID NO: 22520 - DNA, 114 bp, Piromyces finnis
  Dockerin_dom_fun
aattagaataggttatgtgtgttgcgatcattgtcaatctaattatgaagatgaatttggtaaatggtaccacacaaataaccatgattggtgtgctcttaaaccatcttgtaa

SEQ ID NO: 22521 - DNA, 108 bp, Piromyces finnis; identical to SEQ ID NO: 19830
  Dockerin_dom_fun

SEQ ID NO: 22522 - DNA, 123 bp, Piromyces finnis; identical to SEQ ID NO: 19832
  Dockerin_dom_fun

SEQ ID NO: 22523 - DNA, 121 bp, Piromyces finnis
  Dockerin_dom_fun
atgctggtccgaagaattcggttacaagtgttgtaagaagtcttgtactgttttcgaaattgataatgatggtaaatggggttacgaagatggtaattggtgtggtattccatctagttgt

SEQ ID NO: 22524 - DNA, 103 bp, Piromyces finnis
  Dockerin_dom_fun
tcaatgtacatttgaatctattggatataactgttgtacaacaacatgcaatgtaatttatactgatgaaaatggagattggggtattgaaaataatgaatgg

SEQ ID NO: 22525 - DNA, 103 bp, Piromyces finnis; identical to SEQ ID NO: 17321
  Dockerin_dom_fun

SEQ ID NO: 22526 - DNA, 123 bp, Piromyces finnis
  Dockerin_dom_fun
ttggtctcataagtatggttatccatgctgtagtgaaggtacatgtcatatttttacttcagatgaaaatggtgattggggttatgaaaatggtcgttggtgtggtattttaccttcttgcag

SEQ ID NO: 22527 - DNA, 94 bp, Piromyces finnis; identical to SEQ ID NO: 17324
  Dockerin_dom_fun

SEQ ID NO: 22528 - DNA, 120 bp, Piromyces finnis; identical to SEQ ID NO: 19837
  Dockerin_dom_fun

SEQ ID NO: 22529 - DNA, 105 bp, Piromyces finnis
  Dockerin_dom_fun
ttggtcagaacctctcggttatccatgttgtagtattgaagctaaaccatcagatgaagctagtatttggggttgggaaaatgaagaatggtgtggtatgaccag

SEQ ID NO: 22530 - DNA, 117 bp, Piromyces finnis
  Dockerin_dom_fun
atgttttgctgaaaaattgggtaaaccatgttgtacggaaactttagatgttgtacgtgttgatgaaaatggccaatggggtatggaaaatggacaattctgtggtttacaatcatt

SEQ ID NO: 22531 - DNA, 63 bp, Piromyces finnis; identical to SEQ ID NO: 19840
  Dockerin_dom_fun

SEQ ID NO: 22532 - DNA, 121 bp, Piromyces finnis
  Dockerin_dom_fun
ctgttggtctgaagagttaggttacgcgtgttgtaagaagacttgtactatctttgaaatcgatgaaaatggtgaatggggtttcgaagatgataaatggtgtggtattccatctagttgt

SEQ ID NO: 22533 - DNA, 108 bp, Piromyces finnis
  Dockerin_dom_fun
aaccattggatacaattgttgtcctttagaagtaagcacagtattctatactgattcctatggtaattggagttataattacaagttaaaggaatggtgtggtcttac

SEQ ID NO: 22534 - DNA, 126 bp, Piromyces finnis; identical to SEQ ID NO: 21970
  Dockerin_dom_fun

SEQ ID NO: 22535 - DNA, 126 bp, Piromyces finnis
  Dockerin_dom_fun
taaatgcttttctgaaaatttaggatattcttgttgtgaagaatgtaatgtggtttataccgataatgatggtaagtggggatatgaaaataatgaatggtgtggtataattaaatcaatttgctc

SEQ ID NO: 22536 - DNA, 57 bp, Piromyces finnis
  Dockerin_dom_fun
cgactggggatatgaaaatggaatgtggtgtggaattaatacttcacaatgtaatag

SEQ ID NO: 22537 - DNA, 126 bp, Piromyces finnis; identical to SEQ ID NO: 22535
  Dockerin_dom_fun

SEQ ID NO: 22538 - DNA, 64 bp, Piromyces finnis; identical to SEQ ID NO: 17330
  Dockerin_dom_fun

SEQ ID NO: 22539 - DNA, 111 bp, Piromyces finnis
  Dockerin_dom_fun
atgctggtcagaagtttatggatattcatgttgtagagaaactactacagtcattacttctgattcaaaaggtaattggggtgctgaaaatggtgaatggtgtggtcttac

SEQ ID NO: 22540 - DNA, 111 bp, Piromyces finnis; identical to SEQ ID NO: 19848
  Dockerin_dom_fun

SEQ ID NO: 22541 - DNA, 117 bp, Piromyces finnis
  Dockerin_dom_fun
cttttcgagaaatcttggatttaattgttgtgaaaatgaaagcacttctgtattttttgttgatgataatggttcttggggtgttgaaaatgatgaatggtgtggtctttcttcaac

SEQ ID NO: 22542 - DNA, 105 bp, Piromyces finnis; identical to SEQ ID NO: 22529
  Dockerin_dom_fun

SEQ ID NO: 22543 - DNA, 120 bp, Piromyces finnis; identical to SEQ ID NO: 22027
  Dockerin_dom_fun

SEQ ID NO: 22544 - DNA, 120 bp, Piromyces finnis; identical to SEQ ID NO: 19376
  Dockerin_dom_fun

SEQ ID NO: 22545 - DNA, 72 bp, Piromyces finnis; identical to SEQ ID NO: 19853
  Dockerin_dom_fun

SEQ ID NO: 22546 - DNA, 96 bp, Piromyces finnis; identical to SEQ ID NO: 19803
  Dockerin_dom_fun

SEQ ID NO: 22547 - DNA, 120 bp, Piromyces finnis; identical to SEQ ID NO: 19804
  Dockerin_dom_fun

SEQ ID NO: 22548 - DNA, 123 bp, Piromyces finnis; identical to SEQ ID NO: 19856
  Dockerin_dom_fun

SEQ ID NO: 22549 - DNA, 123 bp, Piromyces finnis
  Dockerin_dom_fun
ctgctggtcttctagtttaggtttcccatgctgttccggtaaggtcgttgttgaatacactgatgctagtggtcgttggggtatccaaaacaacaactggtgtggtattgttaactctaacac

SEQ ID NO: 22550 - DNA, 88 bp, Piromyces finnis; identical to SEQ ID NO: 19404
  Dockerin_dom_fun

SEQ ID NO: 22551 - DNA, 111 bp, Piromyces finnis
  Dockerin_dom_fun
ttgggcattagcctatggttacccatgttgtaaagaaactactactgtattaagtactgatgaatctggtacttggggttatgaaaacaatacctggtgtggtattgaaga

SEQ ID NO: 22552 - DNA, 117 bp, Piromyces finnis; identical to SEQ ID NO: 19859
  Dockerin_dom_fun

SEQ ID NO: 22553 - DNA, 111 bp, Piromyces finnis
  Dockerin_dom_fun
ctgttggtctgttgaatatggttttccatgctgttttggtagtaaggttattgcaactgattataatggtgattggggttatgaaaataatcaatggtgtggtatgccaag

SEQ ID NO: 22554 - DNA, 79 bp, Piromyces finnis; identical to SEQ ID NO: 17348
  Dockerin_dom_fun

SEQ ID NO: 22555 - DNA, 117 bp, Piromyces finnis; identical to SEQ ID NO: 22133
  Dockerin_dom_fun

SEQ ID NO: 22556 - DNA, 94 bp, Piromyces finnis; identical to SEQ ID NO: 22105
  Dockerin_dom_fun

SEQ ID NO: 22557 - DNA, 91 bp, Piromyces finnis; identical to SEQ ID NO: 17352
  Dockerin_dom_fun

SEQ ID NO: 22558 - DNA, 112 bp, Piromyces finnis; identical to SEQ ID NO: 17354
  Dockerin_dom_fun

SEQ ID NO: 22559 - DNA, 96 bp, Piromyces finnis; identical to SEQ ID NO: 22250
  Dockerin_dom_fun

SEQ ID NO: 22560 - DNA, 117 bp, Piromyces finnis; identical to SEQ ID NO: 19859
  Dockerin_dom_fun

SEQ ID NO: 22561 - DNA, 111 bp, Piromyces finnis; identical to SEQ ID NO: 22551
  Dockerin_dom_fun

SEQ ID NO: 22562 - DNA, 117 bp, Piromyces finnis; identical to SEQ ID NO: 17358
  Dockerin_dom_fun

SEQ ID NO: 22563 - DNA, 99 bp, Piromyces finnis
  Dockerin_dom_fun
cccttgttgttctgataatactgaaatcatatatactgatgaagaaggtaattggggacttgaaaatgatgagtggtgttttataaataaatcaactac

SEQ ID NO: 22564 - DNA, 99 bp, Piromyces finnis; identical to SEQ ID NO: 22563
  Dockerin_dom_fun

SEQ ID NO: 22565 - DNA, 126 bp, Piromyces finnis; identical to SEQ ID NO: 19871
  Dockerin_dom_fun

SEQ ID NO: 22566 - DNA, 123 bp, Piromyces finnis; identical to SEQ ID NO: 19873
  Dockerin_dom_fun

SEQ ID NO: 22567 - DNA, 72 bp, Piromyces finnis; identical to SEQ ID NO: 17363
  Dockerin_dom_fun

SEQ ID NO: 22568 - DNA, 111 bp, Piromyces finnis; identical to SEQ ID NO: 19608
  Dockerin_dom_fun

SEQ ID NO: 22569 - DNA, 51 bp, Piromyces finnis
  Dockerin_dom_fun
aaagtggggtgttgaaaacagtgattggtgtggtattgtagacagcaagga

SEQ ID NO: 22570 - DNA, 124 bp, Piromyces finnis; identical to SEQ ID NO: 22148
  Dockerin_dom_fun

SEQ ID NO: 22571 - DNA, 123 bp, Piromyces finnis; identical to SEQ ID NO: 19878
  Dockerin_dom_fun

SEQ ID NO: 22572 - DNA, 96 bp, Piromyces finnis; identical to SEQ ID NO: 21985
  Dockerin_dom_fun

SEQ ID NO: 22573 - DNA, 312 bp, Neocallimastix californiae
  DPBB_1
tgataactatctttcttgtggtgaatgttatgaattagaaattactcaagaagatggttctctttatccagaagataatagacgttctgaaaacattattgctcaaattgttgattcctgtccatgttccgctaatgctaagtggtgttgtggttcaggtattgatcactgtaatgaaattgactttaagtatggttgtccaattccagaaggtagtgtacactttgatttatctgatattgctatggctcgtttacaaactaatgatccaaatggtggtatggttgaaggtgttattccaattcgttacaa

SEQ ID NO: 22574 - DNA, 168 bp, Neocallimastix californiae
  DPBB_1
tgctatgaatttaccacaatataatatttctgctggatgcggaagttgtcttattttagctcaagctgataaaccagaaagagttatcagagttcgtgttgtagatcgttgtggtgaatgtccaaagggtgatattgatcttagtaataccgcttggaaagctttaac

SEQ ID NO: 22575 - DNA, 204 bp, Neocallimastix californiae
  DPBB_1
tgctctcaacaataaacaatacaatacagatatgggttgtggtctctgtgcagtagtagtttcaactagtaacccatacaaaccaattagagtacgtattattgatcaatgtccagaatgtgctcacggaagtttagatttcagtgataaggcttttaaggccctttcaaacaaaactccggatcgtattaagattacttgggc

SEQ ID NO: 22576 - DNA, 312 bp, Neocallimastix californiae
  DPBB_1
tgataattatctttcttgtggtgaatgttatgaattagaaattacccaagaagatggttctctttatccagaaaaacaaagacgttctgaaaacattattgcccaaattgtagattcctgtccatgttctgccaatgctaaatggtgttgtggatcaggtattgaccattgtaatgaaattgactttaaatatggttgtccaatcccagaagatagtgtacactttgatttatctgatattgctatggctcgtttacaaaccaatgatccaaacggaggaatggttgaaggtgttattccaattcgttacaa

SEQ ID NO: 22577 - DNA, 312 bp, Anaeromyces robustus; identical to SEQ ID NO: 22576
  DPBB_1

SEQ ID NO: 22578 - DNA, 168 bp, Anaeromyces robustus
  DPBB_1
tgctatgaatttaccacaatataacatttctgctggttgtggttcttgtcttattttagctcaagctgataaaccagacagagtcatcagagttcgtgttgttgatcgttgtggtgaatgtccaaagggtgatattgatcttagtaatactgcttggaaagctttaac

SEQ ID NO: 22579 - DNA, 204 bp, Anaeromyces robustus
  DPBB_1
tgctcttaataacaaacaatataatcttgatatgggttgtggtctttgtgctgttgtagtttcaactagtaacccatacaaagctattagagtacgtattattgatcaatgtccagaatgtgaacacggaagtttagattttagtgataaagctttcaaagctctttccaatatggatccagctcgtattaagattacatgggc

SEQ ID NO: 22580 - DNA, 168 bp, Piromyces finnis
  DPBB_1
tgccatgaatttaccacaatataatatttctgctggttgtggttcttgtcttattttagctcaagctgataaaccagaaagagttattagagttcgtgttgttgatcgttgtggtgaatgcccaaagggtgatattgatcttagtaacacagcttggaaagctttaac

SEQ ID NO: 22581 - DNA, 204 bp, Piromyces finnis
  DPBB_1
cgctcttaataataagcaatacaatgatgatatgggttgtggtctttgtgcagttgttgtttcaacaagcaatccatacaaagctattagagttcgtattattgaccaatgtccagaatgtgaacacggaagtttagatttcagtgataaagcattcaaagctctttcaaacaaaactccagatcgtataaagattacatgggc

SEQ ID NO: 22582 - DNA, 171 bp, Neocallimastix californiae
  DUF1729
ctgtgttctcgatgaagaattccacgtttggttaaagcgtgatagtttatggcaagctgaagatttagatgccgttgtcgaccaagacccacaacgtgttgccattttacaaggtccagtcgccattcgtcactctaagattgctaatcaacctgttaaggaaatcttgga

SEQ ID NO: 22583 - DNA, 171 bp, Neocallimastix californiae
  DUF1729
tccaaatatggataagcaattcaagtactggttcaagaaggatagtttatggcaatcagaacacttagaagctgttgttggtcaagatccaggtcgtgtttgtgttcttcaaggtccagttgctgttagacattctactaaggctaatgaaccaattagctcaattcttga

SEQ ID NO: 22584 - DNA, 171 bp, Neocallimastix californiae; identical to SEQ ID NO: 22583
  DUF1729

SEQ ID NO: 22585 - DNA, 171 bp, Neocallimastix californiae
  DUF1729
tccaaacatggacaaacaattcaaatactggtttaagaaggatagtttatggcaatctgaacacttggaagctgttgttggtcaagacccaggtcgtgtctgtgttcttcaaggtccagttgctgttagacactctactaaggctaatgaaccaataagctcaattcttga

SEQ ID NO: 22586 - DNA, 171 bp, Neocallimastix californiae
  DUF1729
ctgtgttctcgatgatgaattccacgtttggttaaagcgtgatagtttatggcaagctgaagatttagatgccgttgtcgatcaagacccacaacgtgttgctattttacaaggtccagtcgccattcgtcactctaagattgccaaccaaccagtcaaggaaatcttaga

SEQ ID NO: 22587 - DNA, 171 bp, Anaeromyces robustus
  DUF1729
ttgtgttcttgatgaagaattccacgtttggttaaagcgtgatagtttatggcaagctgaagatttagatgctgttgttgatcaagatccacaacgtgttgctattttacaaggtccagtagctattcgtcattctaagattgctaatcaaccagttaaagatattttaga

SEQ ID NO: 22588 - DNA, 171 bp, Anaeromyces robustus
  DUF1729
tccaaatatggacaagtctttcaaatattggtttaagaaggatagtttatggcaatctgaacatttagaagctgttgttggtcaagatccaggtcgtgtttgtgttcttcaaggtccagttgctgttagacattctactaaagctaacgaaccaattagctcaattcttga

SEQ ID NO: 22589 - DNA, 171 bp, Piromyces finnis
  DUF1729
tccaattatggacaagtcattcaaatattggtttaagaaggatagtttatggcaatctgaacacttggatgctgttgttggtcaagatccaggtcgtgtttgtattcttcaaggtccagttgctgttagacattctactaaggccaatgaaccaattggttctattcttga

SEQ ID NO: 22590 - DNA, 171 bp, Piromyces finnis; identical to SEQ ID NO: 22589
  DUF1729

SEQ ID NO: 22591 - DNA, 171 bp, Piromyces finnis; identical to SEQ ID NO: 22589
  DUF1729

SEQ ID NO: 22592 - DNA, 171 bp, Piromyces finnis; identical to SEQ ID NO: 22589
  DUF1729

SEQ ID NO: 22593 - DNA, 729 bp, Neocallimastix californiae
  DUF303
tatttatttagcctttggtcaatctaatatggaaggtcaaggtccaattggaagtcaagatagaactgttgataagcgtttccaaatgatttcaactgttagtggatgtaatggtcgtcaaatgggtaattggtatgatgctatcccaccacttgctaattgtgatggtaagttaggtccagtcgattactttggacgtactttagttaagaatttaccacaagaaattaaggttggtgttgctgttgttgctgttgctggttgtgatattcaacttttcgaaaagaataactacagaaactacagattagaaagttacatgcaaggtagagttaatgcctatggtggtaacccatatggtcgtttaattgaagttgctaagaaagctcaacaagttggtgtcatcaagggaattcttcttcaccaaggtgaaactaacactggtcaacaaaactggccaaaccgtgttaaggctatctatgaagatatgcttaaggacttaggtttaaatgctaaggatgttccacttcttgctggtgaagttgttcaaagtaaccaaggtggtcaatgtggtagtatgaattctattattcaaagacttccatctgttattccaaccgctcatgttatttcttctcaaggtttaggtcaacaaggtgatggtcttcacttctcttctcaagcttaccgtactttcggtgaacgttatgctaatgaaatgttaaagat

SEQ ID NO: 22594 - DNA, 729 bp, Neocallimastix californiae
  DUF303
tatatatttggcttttggtcaatctaacatggaaggacaaggtcctattgagcctcaagatagaataccagaaaaacgttatcaagtactttcaacttttggtaattgtgacggtcgtgaagtcggtaaatggtatgatgcagttcctcctcttgctagatgttttgctagagttggaccaatggattattttggtcgtacattagctaaaaaattaccagaagaaattaaaattggtgcagtcattgttgctgttggtggatgtagtattcaactttttgaaaaagataactatatgaattataaattagaaaattatatggttgatgtagttaaaaactatggtggtaatccttataagcgtttaattgatgtagctaaattagctcaaaaagatggtgtcattaaaggaattcttcttcatcaaggtgaatctaacaatggtcaaactaactggccctatcgagttaaagcagtctatgaaaatattcttaatgatttaggattgaaagcagaagaagttccgcttcttgctggtgaagtcgttcaaacaagtgaaggtggtcaatgtggtggtatgaataaaattattaatactcttcccaatgttattccaacagctcatgtcgtttcatcagtaggtttaaaacaacaaggagatggttatcatttttcaacggaggcttaccgtgaatttggtgaacgttatgctgaagaaatgttaaaaat

SEQ ID NO: 22595 - DNA, 729 bp, Neocallimastix californiae
  DUF303
tatttatttggcatttggtcaatctaatatgcaaggggatggtaaaattgaaaaccaagatagagttgttgataaacgtttcaaaatgttagctactgcaggaggatgtaataatagaagagttggtgaatggtatgatgctattcctccacttgctaattgtgctggtggtttaggtccagttgattattttggacgtacattacttaaaaaattaccagaacaaattaaggtaggtgttgctgttgttgccgttgctggttgtgatattcaactttttgaaaaagataactacagaagttataatatgccagattggatggttggtattgttaatggttacaatggtaatccatatggacgtttaattgaaatgggtaagaaggccaaggaagctggtgtcattaaaggtattcttcttcatcaaggtgaaactaacactggtcaacaagactggccagatcgtgttaagaaaatttatcaaaatattattaatgatttaagtttaaatgctgatgaagttccacttcttgttggtgaagtagttaatgctgattctggaggtgcctgtgcttatcataacgaagttattaaaagagttccacaacttattaaaaattcatacgtcatatcttctaaaggtttaccacaaaagggtgatggacttcactttacttcagccggttatcgtacatttggtgaacgttttgctgatactatgttaaaaat

SEQ ID NO: 22596 - DNA, 729 bp, Neocallimastix californiae
  DUF303
tatttatttggcctttggtcaatctaatatgcaaggagcaggtcaaattgcaaatcaagataaaactgtagataaacgttttcaaatgttagccacagctggaggttgtaataatcgtcaagttggtaattggtatgatgctattcctccacttgctcattgtggtggaggtttaggtccagttgattactttggtcgtaatttaattaaaaacttaccttctcaaattaaagttggtgttgttgttgtcgctgtagctggatgtgatattcaactttttgaaaaggataattacagaagttataatatggctgactggatgaaaagtattgttaactcctatggaggtaatccatatggaagattagttgaaatgggtaaaaaggctcaacaagctggtgttattaaaggtattctcttccatcaaggtgaaactaacagtggtcaacaaaattggccaaatcgtgttaaaggtatctatgataatcttatcaaggatttaggcttaaaggcttcagaggttcctcttcttgctggtgaacttgtttctagtgctaaagggggtgtttgtggaggtcataatagtattattcaacgtcttccacaagttattccaaatgctcatgttatttcttctagtggattagatcaacaaggtgatggtctccacttcacatcagctgcttatcgtacttttggtcaacgtttcgctgagactatgttaaaact

SEQ ID NO: 22597 - DNA, 726 bp, Neocallimastix californiae
  DUF303
tatttatttagcttttggtcaatctaatatggaaggtgctggtccaattgaaaatcaagatcgtcaagtcgataaacgttttaagatgctttccactgttagtggttgtggtcgtcaactcggtaattggtatgatgccaccccaccacttgctcactgtggtggtaaattaggtccagtagattactttggtcgtaatttagtaaagaatttaccagaacaaattaaggttggtgttgtcgttgttgctgttgcaggttgtgatatccaacttttcgaaaagaataattacaaaagttacaatatgccagattggatgagaaataccgttcaaaattatggtggtaatccatatggacgtttagttgatatggctaagaaagctcaacaagaaggtgttatcaagggtattcttcttcaccaaggtgaaactaatagtggacaacaaaattggccaaaccgtgttaaggatatttacaataaccttattaaggatttaggattaaatgctaatgatgttccacttcttgctggtgaagtcgtttccagtgaacaaggtggttcctgtggtggtcataactctatcattcaaaagcttccatcagtcattcctactgcacatgttatttcctctaaaggtttaggtcaacaaggtgatggtcttcactttacttctgcttcataccgtaccttcggtcaacgttacgctgatgaaatgttaaagat

SEQ ID NO: 22598 - DNA, 735 bp, Neocallimastix californiae
  DUF303
tatttatttagcttttggtcaatctaatatggaaggtcaaggtccaattgaagctcaagataaaaccgttgatagtcgtttcaaaatgctctcaactgttgatggatgtaataaccgtagtttaggtgaatggtatgaagctattccaccacttgccaattgtgatggtagacttggtccagtcgattactttggtcgtactttagttaaaaaattaccagaacaaattaaggttggtgccgttgttgttgctgttgctggttgtgatattcaacttttcgaaaaggataattacattgaatactcaaaggaacaaccagattggatggttggtagaattaatgcttatggtggtaatccatatggtcgtttagttgatatggctaagaaggctcaagaagttggtgtcatcaagggaattcttttccaccaaggtgaaactaacaacggacaagttacctggccttctcgtgttaaagccgtatacaacgaccttctttctgatttaggtttaaaggctgaaaatgttcctcttcttgctggtgaagttgttccagaaagtgttaatggtttatgtgctgctatgaatgatatcattaaaactcttccagaaaccattccaacagctcatgttatttcttctgaaggtttagaaccacaagatgataatcttcacttctcttctgctgcttaccgtacttttggtgagcgttatgctgaaaccatgttagaatt

SEQ ID NO: 22599 - DNA, 729 bp, Neocallimastix californiae
  DUF303
tatttatttagcttttggtcaatctaatatgcaaggtgcaggtcaaattgaaaatcaagataaaaccgttgataaacgttttcaaatgattgctacagctgctggatgtaataatcgtagagttggtgaatggtatgatgctattccaccacttgctcattgtggtggtggtttaggtccagttgattattttggtcgtactttagttaaaaaattaccagaacaaattaaagttggtgtagctgttgtagctgttgctggttgtgatattcaactttttgaaaagaataattatagaagttataatatggcagattggatgaaaggtattgttgattcttatggtggtaatccatatggtcgtttaattgatatgggtaaaaaagctcaacaagttggtgttattaaaggtatacttcttcatcaaggtgaaactaataatggacaaagtgattggccaaatcgtgttaaagctatttatgaagatattcttaaagatttaagtttaaaagctgaagaagtcccacttcttgttggtgaaacagttgattctgattctggtggtgtttgtggttatcataatagtgttattgctagaattccacaagttattaagaatggtcatgttatttcttctaaaggtttaggacaacaaggagatggtcttcactttacctctgctgcttatcgtacttttggtgaacgttatgctgatactatgttaaaact

SEQ ID NO: 22600 - DNA, 729 bp, Neocallimastix californiae
  DUF303
tatttatttagcttttggtcaatcaaatatggaaggtaatggtccaattgaaagtcaagatagaactgttgacaagcgttttaagatgcttgctactgtaagtggatgtaacaatcgtcaagctggtaattggtatgatgctactccaccacttgccaactgtaatggtaaattaggtccagtcgattactttggtcgtactttagttaagaaattaccacaagaaattagaattggtgccgttgttgttgctgttgccggttgtgatattcaacttttcgaaaaggataagtaccgtagctaccaacaaccagattggatgcgtggtattgttcaacaatacggtggtaatccatatggtcgtttaattgaaatggctaagaaggcccaacaagaaggtatcatcaagggtattcttcttcaccaaggtgaaactaacactggtcaacaagactggccaaaccgtgttaaaggtatttacgaaaatattcttaatgatttaggtttaaaagctgaagatgttccacttttagctggtgaagttgtttctagtgctgttggtggtcaatgtggttctcataatgctgtcattcaaagacttccaagtgttatcaagactgctcatgttatttcttctcaaggtttacaacatcaaggtgatggtcttcactttacttcagctgcttaccgtactttcggtgaacgttatgctgaagaaatgttaaagat

SEQ ID NO: 22601 - DNA, 729 bp, Anaeromyces robustus; identical to SEQ ID NO: 22599
  DUF303

SEQ ID NO: 22602 - DNA, 729 bp, Anaeromyces robustus; identical to SEQ ID NO: 22600
  DUF303

SEQ ID NO: 22603 - DNA, 729 bp, Anaeromyces robustus
  DUF303
tatttatttagcatttggacaatctaatatgtatggaagtggtgatattgaagaacaagataagactgttgacagtcgtttccaaatggtttccactgtaaatgattgtggatctcgtaaattaggtacttggtatgatgccattccaccacttgctacttgtgatgctggtttaggtccagctgattactttggtcgtactttagttgaaactttaccaaaggaaattaaagttggtattgctgttgttgcagttccaggttgtgatattcaacttttcgaaaaagataattaccaaaattatttcccagatgattggatgtatccatttattgatgaatatggaggtaatccatatggtcgtttagttgaaatgggtaagcaagctaaagaattaggtgttattaagggtattcttcttcaccaaggtgaaactaacaatgaacaaactgactggccattacgtgttaaggctatttatgaaaatcttcttacagatttagaattaaaggctgaagaagttccaattcttattggtgaacttgttcaattaagtgaaaacggtacttgtggtgctatgaatgctattattcaaactgttccaagtgtcattccaactgctcatgttatttcttctgaaggtttaaaacaacgtggtgatggtttccactttacttctccatcctatcgtgtctttggtcaacgttatgctgaagttatgttagacct

SEQ ID NO: 22604 - DNA, 726 bp, Anaeromyces robustus
  DUF303
tatatatttagctttcggtcaatctaatatggaaggtgctggtccaattgaaggacaagataaaactgttgataaacgtttccaaatgctttcaactacttcatgtaatggacgtcaaatgggtaattggtatgatgccactccaccacttgctcactgtggtggtaaattaggtccagttgattatttcggtcgtactttagttaaaaaattaccagaacaaattaaagttggtgttgtagttgttgccgttgctggttgtgatattcaacttttcgaaaaagataattataagagttataatatgccagattggatgagaaataccgttcaaaattatggtggtaatccatatggtcgtttagttgaaatggctaaaaaagctcaacaatctggtgttattaaaggtattcttcttcaccaaggtgaaactaactctggacaacaaaattggccaggtcgtgttaaggctatttataataatcttcttactgatttaggtttaaatgctaatgatgtaccacttcttgctggtgaagttgtttctagtggtcaaggtggttcttgtggtggtatgaattctattattcaaagtcttccacaaactattccaactgctcatgttgtttcttctgatggtttaggtcaacaaggtgatggtcttcactttacttctgcttcttaccgtacttttggtgaacgttatgctaatgaaatgttaaaact

SEQ ID NO: 22605 - DNA, 729 bp, Anaeromyces robustus
  DUF303
tatttacttagccttcggtcaatctaatatggaaggtcaaggtccaattggacaacaagatagatccgttgataaacgtttccaaatgatttcaactgtcaatggttgtaatggtcgtagacttggtgaatggtatgatgctgttccaccactttcaagttgtagtggtaaattaggtccagtcgattatttcggtcgtactttagtaaagaaattaccacaagaaattaaagtaggtgttgctgttgttgctattgctggttgtgatattcaacttttcgaaaagaataattacagaaattatcaattacaatcttacatggttaacactgttaatgcttatggtggtaatccatatggacgtttaattgaaatgggtaagaaggctcaacaagttggtgttattaagggtattcttcttcaccaaggtgaaaccaacactggtcaacaaaactggccaaaccgtgttaaggctatttatgaagatattcttaaagatttaggattaaatgctaaggatgttccacttcttgctggtgaagttgtttcaagtcaacaaggtggtcaatgtggtagtatgaattctattattcaaagtcttccaagaactattccaactgctcacgttatttcatctcaaggtttaggtcaacaaggtgatggtcttcacttctcatctgatgcttaccgtacttttggtcaacgttacgctgaagaaatgttaaagat

SEQ ID NO: 22606 - DNA, 726 bp, Anaeromyces robustus
  DUF303
tatttatttagcttttggtcaatccaatatgttaagtggtgatattgaaagtcaagataaaaatgttgatagtcgttttaaaatgatttcaacggttaatgattgtggtaatcgtcgtcaaggtgaatggtatacggctgtaccaccattagctagttgtaatgctggtttaggtccagttccatattttggtaatactttagtagaaaaattaccaaaagaaattacagttggtgttgctgttgttggtattgctggttgtgatattcaactttttgaaaaagatagatatcaaagttatgaacatgcggattggatgacgggttatattaatgaatatggtggtaatccttatggacgtttagtagaaagtggtaaaattgctcaaaaatctggggtaattaaaggtattcttgttcatcaaggtgaaactaataatggtaatcaagattggccaaaacgtcttaaaggagtttatgaaaatcttcttaaagatttaagcttaaaagctgaagaagttccacttttagttggtgaacttgttcaatctaataaaggtggtatttgtggtgatatgaatagtattattcaaagagttccagaagttattccaacagctcatgttgtttcatctgaaggtttagaacaacaaggggatggttttcattttacttctgcttctcatcgtatacttggtaaacgttatgctgaagttatgttaagtat

SEQ ID NO: 22607 - DNA, 732 bp, Anaeromyces robustus
  DUF303
catttatttagcatttggtcaatctaatatggaaggtcgtggtaaaatttatcaagaagataaaactgttgatagtcgtttccaaatgattgctactgtcgatggttgtaaaggtcgtaaatttggtgaatggaatgatgctattccaccactttcaaattgtaatatgggtcaattaggaccggctgattatttcggtcgtaccttagttaaaaaattaccacatgaaattaaaattggtattgctgttgttgctattggtgattgtgatattcaactttttgaaaaaacaaaaaatagaaattatcgaatcccaaatgagataaaaaatacttatgaagcctatggtcgtaattcatatagtcgtttaattgaaatgggtaaaaaagctcaagaagttggtgttattagaggtatacttcttcaccatggtgaaaataatataggtcaaactgactggccaaatcgtgttaaagctatttatgataacatacttaatgatttagatttaaattctgatgatgttccacttcttgctggtgaagttgtttcatctgaaaaaggtggaaaatatggtgaaatgaacccaatcattcataatcttgctaaaatttgttcaacttgtcacattatttcttctcaaaatttagattcagaagatgatggtttccatttcactacaaatgcttatcgtaccttaggtgaacgttatgctgaagaaatgttaaagat

SEQ ID NO: 22608 - DNA, 405 bp, Piromyces finnis
  DUF303
ttattatattgatgaatatggtggtaatccatatggtcgtttagttgacatgggtaagattgctcaaaaatcaggtgttatcaagggtattcttgttcatcaaggtgaaactaataatggtaatcaagactggccaaaacgtcttaagggtgtttatgaaaatcttcttacagatttaggtttaaaagcagaaaatgttccacttattgtaggtgaacttgttcaatccgataaaggtggtatttgtggtggtatgaataatatcattcaaactgtcccagaagttattccaacagctcatattgtttcatctgaaggattagaacaacaaggtgatggtttccactttacttctgcttctcatcgtattttaggtaaacgttatgccgaagttatgttaagtat

SEQ ID NO: 22609 - DNA, 729 bp, Neocallimastix californiae
  DUF4353
ggctactgcttctaatggtgttgtaactatttctgctgctggtacttatattgttgctggttctttaaatggtcaactccgtattgaagcaactgaaaatgattacattcatattatcttaaatagtgctactattagtagtagtagtggtcctgctatttatggtattgctgccgataaggttaccattacccttgttggtgacagtaaactttctgatactactaattatactgtggttgatgaagagcctgatgcttgtctttttattgatgctgatcttgctattaatggttcaggtagtgtaagtgttactggtaattatagtgatgctatcagatgtaaaaaagatttaagattgattagtggtaaaattacggttcctaaagccactcaaagaggtattaaggctaaaaattcaatttgtattaaagatgcaaccattgatgttacttcaagtaatagtggtattaaagttaccagagatgatgatgccgaaaaaggatacattgtcattgatggtggaagtactagtgtttcaactgaaaatgatggtattcatgccgaaactcatcttaccattaatggaggttatgtcgatgttaagaaaagtggagaaggtcttgaaggtcaaatgattgatattattggaggagaagttcatgtcttgtccaaagatgatggtatcaatgcttcaaaaattaaagatagtacacaaacttcaagtaa

SEQ ID NO: 22610 - DNA, 822 bp, Anaeromyces robustus
  DUF4353
atctgcttctgatggtcttgttactataaaagctgctggtacatatattgtacaaggttctttaaatggtcaacttcgtattgaagccacaaaagatgattatatacatcttattttaagtgatgctactataactagtagtgatggtcctgctatttatggcgtttctgcaagtagagtaactttaactcttgttggttcaaatgaacttattgattcttcaaattatactgttgttgaagatgaaccagatgcatgcctttttattggtagtgatctttccattaatggttctggtagtttaaatgttacaggaaattatagtgatgcaattagatgtaaaaaagatctaaaatttgttagtggaaatgttattataccaaatgctattcagagaggtattaaaactaaaaattatttatgtgtaaaagaagctaatattgatgttaattctaaaaacactggtattaaagttaccagagatgatgatccagaaaagggttttgtctctattgaaggtggtaaagttactgtagaaactgataatgatggtattcatgctgaaactcaccttactataagtggtggttatgttgatgttaaaagatgtggtgaaggtcttgaaggtcaaatgattgatatcattggtggtgaagttcatattgtatctacagatgatggtattaatgcttcaaaaatccgtgattcaactcaaacaggtaattggggttggggtggtccaactggtactgatggtagtgtttatattaatatagttggtggtaaaacttatattactgttcaaggtcgagatgttgatgg

SEQ ID NO: 22611 - DNA, 699 bp, Piromyces finnis
  DUF4353
tgctactgcttcaagtggtaaggttaccattacttctgctggtacctacattgttcaaggttcactcaatggacaagttcttattgaagctactaaagaagattttattcatcttgtattaaacagtgtaactattaagagtaccaatggtccagctatttatggtactgctgctagtaaggttgtcattactcttgttggtgacaatactctttctgactctaataattattctgctgtaaatggggaaccagatgcttgtatattcattgattctgatgtttctattaatggttcaggtagtattaatgttactggtaattacaatgatgccatcagatgtaaaaaggatttaaaattaattagtggtaaaattactattccaaaagctactcaaagaggtattaaagctaaaaactccatttgtattttagatgctgatatcgatattacttcccaaaatagtgctatcaaggttactaaagatgatgatccagaaaagggatttgtcgttattgatggtggaaaaattaatatttctactggaaaggatgctattcatgccgaaactcatcttactattcgtgatggttatattaacgtaaaaaaatgtgaagaaggtattgaaggtcaaatggttgatattcttggaggtgaaatccatgttttcgcttacaatgatgctattaatgctggtaa

SEQ ID NO: 22612 - DNA, 594 bp, Neocallimastix californiae
  ECH
agatcgtttagttcatgttatctttaatcgaccagaagctaataatagttttactgaagatatgctaattcgattaatggaagcatatgatccaaataaaatactattcattgaaagtaaaggtaaaaacttttcaactggatgggatttgaatggtggtgatttcggtagtgaagcttttgaacaatctattgaaaaatatagtcaatttgttaagcaattagaaggtgccattcaacctattgtagtagtttgtcaaggtagttgtagaggaggtagtatgcttttcccattgatggcagattatgttattgcctatgaagatgccaattttggattcccagaagttagacgtggaggtattcctgctttagtttctgtagccgccttaaagaaattttcaagaacaatagcaaaacgtatgatgcttctcggtgaacctattcaagtggaagaagctaaaaaatgtaatttagtagattatatttgtcatactaaagaacaatgtaatgaattaataaagaaattattccaacaatttataacggatcgtactaatcttattaatcttcgtgaatttgaatttgatgctag

SEQ ID NO: 22613 - DNA, 606 bp, Neocallimastix californiae
  ECH
tgatcttgaggaaggtattgccgtaattgaaatgtgttctccccaaaactttaatggtatgaatctagatatatcacgtcaacttcatgctcatgtcaatacccttaagatgagaaaggacgtaaaatgtgttatcgtacgtggctatcgacgtcatttctgtactggtgctgatccatcttgggtagcaaatattgagggtaaaacccatttacgtatggctttagaagtttatgagatttatagagattacgcttccattttagaattaaatgtacccgtaattggtatgttaaatggacgtattgttggtggtggtttagcgctttccttgaattgtgattggagagtcgccttaaaaacatctacgattgattttggtaatttaccaagaggagtatgtccaggaatgatgctttcagtgaatatggaatcatatgtcaaacgtggccgtagttttaatatgtatttacaaccaggatcttatggtatgacgatggaagaagctctttcgataggtatcattcaagaaattgcagactcttttgaagatttacaagagaaagcaattagaaaagctagagaaattgttcaagcttcaaaaca

SEQ ID NO: 22614 - DNA, 594 bp, Neocallimastix californiae
  ECH
tgataaaattgttatccttactttaaatagaccagaaagtatgaatgacttacatactggtatgatcaaaaagatcattcaagccattgatgttcaaaaatcccttattattgaaaatgctggagataatttctgcatgggttggagtagtcttaatgcagaaactgaaactattgaaagtgtttatcattactacagtgagttaattaataaaatgaatagtgtcacacagccaatcatttctatttgtaagggtattgttttcggtggtggtatgattttcccatgtatgtctgatattgttattgctgataataatactacctttagtttctatgaaagtactttcaaacaaatgccatttattcttactaaagctgctcaaaatagaatcaaaagtagtcatataaaaaagatgttcttaattgaaaaggaagctaatattgaagaagctattaacatggaattggttgatattgctgtagcttcaaataagttggaaatggagaaaaaaagtgtcataagacgtataaatactctcgacccatctgttttaaagatcactaaagaaaatattaatgataccgaattatc

SEQ ID NO: 22615 - DNA, 612 bp, Neocallimastix californiae
  ECH
aactaatattataaaccttgaagtagcaagtcaaattggtaattcatttgaacaaatgaaggaaaaaaatgatgctcatgtcttaataataaagaatgcttcaaatgatttctgtcaaggatttgatgctgaattccttaatagtatttctggtaagagtaagagtcaattagccaatgaaatatatcatatttataaaaattacagtaaaacttatgaattaacaattccagttctttgttgtctgagtggttcagtaatgaatgctggtttgaatttagctttaacttcggattggagagttgcctccagagaaagttgcttatctttcattaataagagtaacactgttgactcatcagtaatgatgagtcactctttacaagattttgttggccgtggaaagagttttaatatacttttcaattatgataacaaaactagtaatgcagttgaagcttacaagcaaggcattgttcaagaattagtcgctaacccaaaccagttaatggatattgctttaactaaagcaagagttattgcctctgccccattaaagggtattaatcattctctaaacttaatgagaataccatatgaaaactcgttgtt

SEQ ID NO: 22616 - DNA, 606 bp, Anaeromyces robustus
  ECH
tgatcttgaagaaggtatagccgtattagaaatgtgttccttaaaaaattttaatggtatgaatttagatatttcacgtcaacttcatgcacatgtaaatacattgaaaacaagaaaagatattaaatgtgttatattacgtggttataaacgtcatttctgtacaggtgcagatccatcttgggttgctaatattgaaggtaaaagtcatttacgtatggcattagaagtttatgaaatatatagagattatgcctccatacttgaattaaatgtacctgtaattggtatgttaaatggacgtattgttggtggaggattagctctttcacttaattgtgattggagagtagctttaaaaacttctacaatagattttggtaatttaccaagaggtgtatgtccaggtatgatgctttcagctaatatggaatcttttgttaaacgtggttatagttttaatatgtatttacaaccaggttcttatggtatgagtatggaagaagcattagaacttggtattatacaagaaattgctgaatcttttgaagatttacaagaaaaagctttattaaaagcaagagaaatcgtaaaagcttcaaaaca

SEQ ID NO: 22617 - DNA, 597 bp, Anaeromyces robustus
  ECH
tcgtttagttcatgtagtttttaatcgtccagaagctaataatagttttaatggtgatatgttaattaaattaatggatgcctacgatccaaataaaatacttttaatagaaagtcaaggtaaaaatttctctacgggatgggatttaaataatggtggctttaatagtcaagcatttgaagattctataaataaatatagtgaatttgttgaacgtttagagaatgcagttcaacctattgtagttatttgtcaaggtagttgtagaggtggcagtatgttattcccattaatggcagattatgttattgcttataaggatgcaagttttggattcccagaagttagacgtggtggtataccagcattagtttcagttgctgctatgaaaaaactttctagaactatggctaaacgtatgatgcttttaggtgaaccaattcaagtagaagaagctaaaaatacaaatttagttgattatatttgtaatacaaaagaagaatgtaatcaaatagttaaaaatctttttaatcaatttattacaaatcatattcatcttttaaatttacgtgaaactgaatcttcttttaatcaatc

SEQ ID NO: 22618 - DNA, 606 bp, Anaeromyces robustus
  ECH
tactaatattattaatcttgaagttgcagctcaaattggtcatgctattgatattatgaaacaaaaaaatgatgctcatgttttaattattaagagtgctgcaccagatttctgtcaaggatttgatgctgaataccttaatagtatttctggaaagagtaaaagtcaactcgctaatgaaatttataatatatataagaattataataaaaattctgaattaaccattccagttctttgttgtcttagtggttctgttatgaatgctggtttgaatttagctttatcttctgattggagagtagcttccagagaaagttgtttatcttttattaataagaataatactgttgattcatctgttatgatgagtcatagtttacaagaatttattggtcgaggtaaaagttttaacatgatctttaattatgataataaaaaaagtaatgttttagaagcttataaacaaggtattgttcaagaattagtagctaatcctggacaattaatggatattgctttagctaaagcaagaataattgcatcggctccattaaagggtattaatcattctcttaatttaatgagaattccatatgataattc

SEQ ID NO: 22619 - DNA, 615 bp, Anaeromyces robustus
  ECH
tgataaaattgtttttattaccttaaatagatcagaaagtatgaatgatttaaataataaaatgattgaaaaaattattgaagctattgatccacaaaagtcacttattattgatagtacaggtgatcatttaagtatgggttggacttctaatgaatctaaatcagatacaatagaaaatgtttaccatatttatggtaaattaatggataaaatgagtgaggtaactcaaccaatagttactatttgtaaaggtgctgtttttggtggaggtatgattttcccatgtatgtctgatattgttattgctgataataatgctacttttagtttttatgaaactaattttaaacaaattccatttattcttactaaagctgctcaaaatagaataaagaatagtcaaattatgaaaatgttcttaattgaaaaggaagctgaagttaatgaagcacgtaatatggagttagtagatattattgttaatagtgataaattagataatgaaaagaagagtgttattagacgtattaatactcttgattcatctgttttaaaaataactaaagaaaatattaaagataatggattaactttagaaagtgctttaattcg

SEQ ID NO: 22620 - DNA, 606 bp, Piromyces finnis
  ECH
aactaacatcattaatccagaaatcgcagctcaaattggaaatgctttcgaacaaatgaaagaaaaggatgatgctcatgtcttaattgttaagtgcaatggtgatgacttctgtcaaggttttgatgctgaattccttaatagcatatccaataaaacaaagggtcaattagccaatgaaatttataatatttacaagaactacagtaagagttctgaattaaccattccagttctttgctgtcttaatggatctgttatgaatgctggtttgaactttgccttaacctctgattggagagtcgccaccagagaaacttgtctttccttcattaataaaaccaaaactgttgactcttcagtcatgatgagtcacagtttacaagattttataggtcgtggtaagagttttaatatgatcttcaactatgataatactaccaacaatgctattgaagcccataaacaaggtatcattcaagaattagttgctaaccaaagccaattattagatgctgctttagttaaggctagaattattgcttctgctccattaaagggtattaatcattctctcaatttaatgagaattccatatgataattc

SEQ ID NO: 22621 - DNA, 603 bp, Piromyces finnis
  ECH
aaaagttgttttccttacattaaacagaccaggtagtatgaatgatttacatgctaatatgatgagaaaaatcatttctgctattgatacccaaaaagctcttgttattgaaggatctggtgataacttctgtatgggatggacttcttccagtatgaataaacacgaaacaaccgaaaacatatatcaactttatggtgaattaataaagaagatgaataaggttacccaaccaattgttactatctgtaagggtgttgtctttggtggtggtatgatcttcccatgtatgtcagatattgtcattgctgaaaacaacgctgtctttagtttctatgaaaaccgcttaaagcaaataccattcattctttctaaagctgctcaaaacagaataaagcacagtcaaataaagaagatgttcttaattgaaaaagaagctgatattgaagaggctattaatatggaattagtagatatttcagttccagctgataaattagaaatggaaaagaagagtgttcttagacgtattaatacacttgatccaactgttttaaagattaccaaggaaaatattaaggatgcagaattatctttggaagg

SEQ ID NO: 22622 - DNA, 48 bp, Anaeromyces robustus
  EGGSHELL
cggtggaggcggttttgacatgggaggcttcggtggaggcttcggcgg

SEQ ID NO: 22623 - DNA, 33 bp, Anaeromyces robustus
  EGGSHELL
cgacatgggaggctttggtggaggcttcggcgg

SEQ ID NO: 22624 - DNA, 30 bp, Anaeromyces robustus
  EGGSHELL
gaaagcattatctgttttaactttagtaac

SEQ ID NO: 22625 - DNA, 34 bp, Anaeromyces robustus
  EGGSHELL
aggctttggtggaggcttcggcggcgacatgggc

SEQ ID NO: 22626 - DNA, 228 bp, Neocallimastix californiae
  Endo-1-4-beta-glucanase_dom2
gcactggattattgatggtgataactggtacggttatggtcaacaagctgatggtaaatctaagccatctttcattaacactttccaacgtggttcttctgaatctacttggaagactgttccacacccatgttgggaagaattcaagtggggtggtagaaatggtttcttagatcttttcactggtgataacaactacgctaagcaatggagatacactgctgctcc

SEQ ID NO: 22627 - DNA, 1437 bp, Neocallimastix californiae
  ENDO-1,4-BETA-GLUCANASE
ttcttctgttattgctactattgcagccctggtggctccaatgactgctgtcgctaaatctcaagattatgctagacacattgaattatctcttcttttctacgaagctcaacgttctggtaaacttccagaagacaacagaatttactggagacatgatagtgaacttgaagctggtgctgatcatggtgttgatcttactggtggatattacgatgctggtgataatgctaagtttaatttcccagctgcttctactatgactcttttagcttggagtggtattgattatgctgaaggttacaaaaatgctggtcaatggaaatatattttagatgctgttcgttggggtgctgactactttattaaatgtcacactggtaaaactgaactttatgctcaagttggtgatggtaacactgatcattctttctggtatccaccagaatatgttcaatatgattacccatcattcaaagttactgctcaagaaccaggttctgaagtagctggtgaaacagctgctttcttagctgctgcatctattcttttcaaagatgaagatccatcatattctgctactttattaaagcactcaaaggaaatttatgacttcgctgataaatatcgtggtgattacactgttgctgttccagctgtcagtttttataacacttacagtggttatatggatgaattagcttggggtgccgcttggcttcttagagctactggtgatgaatcatatcttgataagtacaatgtcattgccaataaaaagtatgaatcttatgatccaaagaaattcactggtgctactggaccaatctcttgggatgataaaagacctggttgttatattttaatggctatgattactggtgatgaaaagcgtattaatgaagcttacagttactgtgatgccgttttaactcaaccacgtaccaaaggtggtttatggtatgatgatggtttatctatttggggttctaaccgttacgcttctaatgctgcatcaatgcttggtatgtttgcaaattatcttccaaagtctgacccaaagcgtgcaaaatatgttgaattcgttaaacaacaaactgattatattcttggtgataacccagctaagattaattatgttgttggtgctgaagccaattcaccaaaagctgttcaccaccgtggtgcttctggtgtatttgattctcaagataaggctgctaagccagatgaaaacatatatactttatggggtgctttagctggtggtccagataagaatgataagttcgttgatagccgtaaggactatcaaatgagtgaagttgctcttgattacaatgccgctttccaaatgaatcttgcattccttactaaggaaggtttaagtaaaccagatccagacagtgttaaaatccatgaaagatcatacccaaa

SEQ ID NO: 22628 - DNA, 1440 bp, Neocallimastix californiae
  ENDO-1,4-BETA-GLUCANASE
aagtataatttctgccattgcagccctggtggctccaatgtctgttgtcgctaaatctcaagattatgctagacacattgaattatcacttcttttctatgaagctcaacgttctggtaaacttccagaaaataatagaatttactggagacatgatagtttactcgatgctggtgctgataacaaggtcgatcttactggtggttattatgatgctggtgataatgtaaagtttaacttcccagctgctgctgccttaactcttcttgcatggagtggtattgactatgccgatggttataagaaagctggtcaatgggattaccttttagatgctgttaaatggggtgctgactatttccttaaatgtcacactggtaagaacgaactttatgttcaagttggtaagggtgcaactgatcatggtttttggtatccaccagaatatgttcaatacgaatatccatcctacaaaattacttcttctgcaccaggtagtgaagttgctggtgatactgcttcattcttagcagcatcttctattcttttcaaagatgttgattcatcttactcagccactttattaaagcacgctaaagaaatttatgattttgctgatacctatcgtggtgaatacattaaagctgttccagatgcccaaggattttactctaactggagtggttgtgatgatgaattagcttttggtgctttatggttatatagagctactaaagatgaaagttacatgaataagtttaagaaaattgctgatgcctcttatggtgaacaagatactaaagcttatggtacttgttctggaccaatttcatgggatgataagagaccaggtgcttatattttagctgctatgcttactggtgatgaaaagcgtaagagtaaagcttacagttactgtgatgctattttaactcaaccaaagactccaggaggtttatggtatgatgctaacctttctaagtggggttctaaccgttatgcttctaacgctgcagctatggttgctatgtttgccaattctcttccagcttctgattctaaacgttctaagtacgttgacttcgttcaaaagcaaactgattatattcttggtaataatccagcaaaggtaaactatgttgttggtgctgaagctaactctccaaaggctgttcaccatcgtgctgcttctggtacttatgattctcaagataaaaatgctaaaccaactgactacaatgtcttcactttatggggtgctttagctggtggtccaggttcaaaggatgaatacactgataccagaaagaactatgaaatgaatgaagttgctcttgattacaatgctgctttccaaatgaatcttgctttccttactaaggaaggtttaagtaagccagatccagatagtgttaagaaccatgatagatcattcccaaa

SEQ ID NO: 22629 - DNA, 1434 bp, Neocallimastix californiae
  ENDO-1,4-BETA-GLUCANASE
tattgctgctattgctgctttagcttcaccaattgctgttgttgccaagtcacaagattatgctagacatattgaactttctttacttttctatgaagctcaacgttccggtaaacttccagaaaataaccgtatttactggagacatgatagtatgcttgatgccggtgctgataatggtgttgatcttactggtggttattatgatgctggtgataacgtaaagtttaatttcccagctgctgctgccttaactcttttagcttggagtggtgttgactatgctgatggttacaagaaagctggtcaatgggattatcttcttgatgctgttcgttggggtgctgactatttcataaaatgtcacactggcaaaaatgaactttatgctcaagttggtaggggtactaccgatcatggttactggtaccctccagaatatattcaatatgatcatccttcctacaaggttacagcttcatctccaggttctgaagtcgctggtgataccgcttcattcttagctgctacttcaattttattcaaggatgaagatccatcttattctaagaaatgtttacaacatgccactgaaatctatgatttcgctgatacctatcgtggtgattacactggttctattccagatgtttctggtttctactctacttggagtggttacaatgatgaattagcttttggtgccttatggctttacagagctactggtgatgaatcttactatgaaaaatttaagaaaattgctgatgccgaatatggtgcccaagattccaaggcttatggtacctgtactggtccaatttcttgggatgataaaagaccaggtgcttacgttcttgctgccatcattactggtgatgaagatcgtttaaagcaagcctactggtattgtgataatgttttaactcaaccaagaactaaaggtggtttatggtatgattctaatctttcaaagtgggcttctaaccgttacgcttctaatgctgctgctatgttagctatgatggctaattaccttccaaagggcgatgccagacgtgctaaatacgttgattttgtaaagagtcaaaccgattatattcttggtgataatccagctggtgttaactttgttgttggtgctgaagccaattcaccaaaggcagttcaccaccgtggtgcttccggtacctatgattcacaagatgtccatgccagaccaaccgattacaatatcttcactttatggggtgctttagctggtggtccaagtaaggatgatacctactctgataccagaaaggattatgaaatgaacgaagttgctcttgattacaatgctgccttccaaactaatcttgctttccttgttaaggaaggattaaacgttccagattcagatgaagttaagaaccacgacagagccttcccaaa

SEQ ID NO: 22630 - DNA, 552 bp, Neocallimastix californiae
  ENDO-1,4-BETA-GLUCANASE
ggttactggtgaagacaaatacaaggaacaagctttcaatcacagtgatcttatggtcaactacaaaactactccaggtggtttatggttcgatactaatctttctgcttggggttctaaccgttatgctagtaacgctgcttataccgttgctatggttgcttctactatggatgccagtgacgctaagcgtaagcaatacgttaaatttattcagaagcaaatcgattatattcaaggagataatccagctaaggttgattatgttgttggtgctgatccaagttcaccaaaatctgttcaccaccgtggttcttctggtactatgaatgctatggctgaaccacctttcaatgttttcccactttatggtgctcttgctggtggtccagatggtaatgataagtacactgatgatcgtactaactataactctaatgaagttgctttagattataatgccgcttatactggtcttcttgctttcttaattcaagaaggattaaacgttccagatccagaacaaacctgggaaggagcctggccaccaaa

SEQ ID NO: 22631 - DNA, 1353 bp, Neocallimastix californiae
  ENDO-1,4-BETA-GLUCANASE
ttacgctagaattttgaacttaaatttacgtttttatgaatgtaattggtctggtaaagctccagaacataaacaagtctattggagatatgattctgctttagaagatggagctgatgttggtttagatcttactggaggttattatgatgccggtgaccatgttaaatttaatttaccaatgtcttatgcaatgactatgttagcatggggtggtattgatttatatgataattatgttgcagctggtcaaattgattatttagttcaaattgtcaaccatggtgcagattattttgtaaagtgccatccagaaaaagaagtcatttatgcacaagttggtcttggtgatgttgaccattgtttctgggtaccaccagaattaatgactatggaaagaccagctgtttgtaaacttactccagaaaatggtgcttctgatgttactgctcaaatggcagctgctttagctagtgcctcaattttaaataagatggtaggaaatactgaaaagtctgaactttatttaaagcatgccattgaaatttatgactttgctgataaatatagagatgtttatggtaatccatgtccagaaggtgcttccttttatccatctgcatcttataaggatgaattagtttggggtgctgcatgggtttatcgtgcttctggagatgaaaaatactatgaaaaggctgattcttattacgattcacttggattatctggtcgtgttttaattggtccaatttcatgggatgatgcttcatcaggtattattttcttaatgtcaaagcctggttttggttctaattggaagagatatttaggtgaagctcaaacatacgttgatcaatatttaaatgataagagtgctcgtacagatgctggtatgttatggtatagtgctgtttctggttggggatctgctcgtcatgctatggctggtgtattcctttattgtattttcaatacttaccataaaccaactgatccaaaatactttaatttcattcaacaacaagccgattatattcttggtaataatccatttaatcgttcacttgttgttggttcaattccaggacatgatccattaaatgttcatcatcgtggttcccatggtggttattctccaatttcattaccagaacataatatgtacacattatatggtgcacttgctggtggtccacttcaagatgattcatgggatgatgatagaaataattatattactaatgaagtttcatgtgattataatgctggtgttactggtgttatggcataccttaccccatggactgttccagataactttgaaatcgatgaaagtgaacctgaagctga

SEQ ID NO: 22632 - DNA, 1431 bp, Neocallimastix californiae
  ENDO-1,4-BETA-GLUCANASE
tattattgctactattgcagccctggtggctccaatgaccgttgtcgctaaatcacaagattatgcaagacacattgaattatctcttcttttttacgaagcccaacgttccggtaagcttccagaaaacaacagaatttactggagacatgatagtgaacttgaagctggtgctgataatggtgtcgatcttactggaggatattatgatgctggtgataatgcaaagttcaacttcccaggtgcagctactatgactcttttagcctggagtggtgttgattatgctgaaggttataaaaacgctggtcaatgggagtatttattagatgctgtccgttggggtgctgactactttatgaaatgtcacactggtaaaactgaactttatgctcaagttggtgatggtaacactgaccactctttctggtatcctcctgaatatgttcaatacgaatacccatcatttaaggttactgctgatgctccaggttccgaagttgcaggtgaaacagctgctttcttagctgctgcttctattcttttcaaggatgaagacccaacatactctgctactttattaaagcattcaaaggaaatatatgactttgctgataaatatcgtggtgattacactgttgctgttcctgcagtcagtttctataatacttacagtggttacatggatgaattagcttggggtgctgcttggcttcttagagccacaggtgatgaatcttatcttgaaaagtacaatgttattgccaataaaaaatatgaatcttatgatccaaagaaatttacaggttctactggaccaatctcttgggatgataagagaccaggttgttatattttaatagcaatgattacaggtgatgaaaaacgtattaatgaagcctacaattactgtgatgctgtattaactcaaccacgtactgctggtggtttatggtatgatgatggtttatctatttggggttctaaccgttacgcttcaaatgctgcttctatggttgctatgtttgctaactaccttccagaatcagatccaaagcgtgcaaagtatgttgaatttgttaagcaacaaactgattatattctcggtgataatccagctaaaattaactatgttgttggtgctgaagctaattcaccaaaatcggttcaccaccgtggtgcctctggtgtattcgattctcaagataaggctgctaaaccagatgaaaatatctatactttatggggtgctttagctggtggtccagataagaatgacaagttcgttgatagtcgtaaggattatcaaatgagtgaagttgctcttgattataatgcagctttccaaatgaatcttgctttccttactaaagaaggtttaagtattcctgatccagatagtgttaaggttcatgaaagatcatatccaaa

SEQ ID NO: 22633 - DNA, 1446 bp, Neocallimastix californiae
  ENDO-1,4-BETA-GLUCANASE
ttatgcaagaattttaaatttaaatttacgtttctatgaatgtcagtggtcaggaaaagcaccagaacataaacaagtatattggagatatgattcagctttagaagatggcgcagatgttggtttagatcttactggaggtttctatgatgcaggtgatcatgtaaaattcaatttaccaatgtcttatgccatgacaatgttagcttggggtggaattgatttatatgataattatgtagctgctggtcaaattgattatttacttcaaatggttaaccatggagctgattattttgttagatgtcaccctgaaaaagaagttatctatgcccaggttggtgtaggcgatgttgatcattgcttttgggttcctccagaattaatgactatggaaagaccaactgtatgtaaacttactccagaaaatggtgcttctgatgttactggtcaaatggcagctgcattagctagtgcttctatattaaacaaaaagtatggtaacactgaaaaagctgaattatatttaaaacatgctattgaaatctttgactttgctgataagtacagagatgtttataataatccatgtcctgaaggtgcttccttctatccttctgcttcatataaggatgaattggtatggggtgctgcatgggtatatcgtgcctctggtgatgaaaagtattatcaaaaggcagatgaatattatgattctcttgctttatctggtcgtaatttaattggtccaattacatgggatgatgcttcatctggtattgtattcttgatgtctaaaccaggattcggttcaaattgggaaagatatttaggtgaagctcaacactatgttgaccagtatttaaatgataagggtgctcgtactgatggaggtatgttatggtatagttccgtttcaggttggggatctgctcgtcatgcaatggctggtactttcctttactgtatctttaatacctaccataagccaactgatccaaaatactttaatttcattcaagaacaagctgattatattcttggtaataatccatttaatcgttctcttgttgttggttctattccaggctatgaaccattgaatgttcaccatcgtggttctcatggaggttattcaccactttctccaccagaacacaatatgtatcctttatatggtgctcttgctggtggtccacttcaaaacgatttttgggatgatgatcgtaacaattatgttactaatgaagttgcttgtgattataatgctggtattactggtgttatggcctatcttactccatggactgtttcagataactttgatattgatgatagtgaaccagaagctgatgctcatttaataattgctattgaaaaaacttgggaagatgtctacagacttgttgctaatatttcaactaatttaccaactccagcttggga

SEQ ID NO: 22634 - DNA, 1413 bp, Neocallimastix californiae
  ENDO-1,4-BETA-GLUCANASE
tttaacaatttttgttagtgtaccagctttaataaaagctgcttcacaagattatgcccgtcaccttgaactttctatcctcttttatgaagctcaaagatctggaaaattaccagataacaatagaatttactggcgtggtgacagtatgttagaagctggttctgataataaagttgatttaactggtggttattatgatgctggtgataatataaaatttaactttcctcaggctagttctcttactcttttatcatggagtgctgtagagtggaaggatggttataaacaggctggtcaatgggaatatatgaaagatttaattaaatggggtatggattacttcattaagtgtcatactgataaatatgtcttatatggtcaagttggaaatgctaaattagatcataattcttgggtatcgccagaaaatatttcttatgattatccatcttacaagattactgactcttccccaggttccgatcttgcagctgaaacctctgctgctttagttgcagcttcaatggtttttagagatgaggatccaaattatgctgatcttttattaaaacatggtaaagaactttatgaatttgctgataaatatagaggttcatatgatgaatctataccagaagcaaatgactattatcattcaaatagttacaatgatgaacttgtttggggtgcagcttggttattcagagctacaggtgaagaatattataagtctaaggtagatgctatttgggattatccttatgacgaaaatgattctaataagttccttgattctaaaaatccaatttcatgggatgataaaaaggcttcatcatatactttaatggctatgattactggcgatcaaaaatatcttaaggaagctactactcacagtgatttaatggtaaatcatacaactacccctggaggattatggtataatgaaaatttatctgtatggggatcaaatagatatgcttctaatgctgcttttactgtagctatgatgacttctataatgaatgatgatgattctaaacgtcaagaatacattgatttcgttaagaaacaaacagattacattcttggtgacaatccagcaaaaatcgattatgtggttggtgctgcaccaaattcaccaaaggcagttcaccatcgtggtgcatcaggtactaaagatgtttatgaaaatccagatgagaatacatacgtcttatatggtgctcttgctggtggaccaggtccaaaggatgaatacaaagatattcgtgaggattatcaaaaaaatgaagtcgctttagattataatgctgccttccagggtcttttagccttccttattcaagaaggatataatcttccagacccaaaacaaacttgggaaggtgcatggcctccaaagga

SEQ ID NO: 22635 - DNA, 1395 bp, Neocallimastix californiae
  ENDO-1,4-BETA-GLUCANASE
tctttcaattgctgctgctgctggttctgcttttgctgcttctcaagattatgctagacatcttgaattaaacttcttattctatgaagctcaacgttctggtcctcttccaagtaccaaccgtattccatggagaggtgactctggtcttgaccatggttctgatgttggtgttgatcttactggtggttactatgatgccggtgataatgtaaagtttaacttcccacaagcattctctatgaccgctatctcttggatgggtattgaatttgctaagggtgttgaaatggctaatcaaactgaatacttaaaggataccgttaaatggggttgtgattacttattaaagtgtcatgaaaagggtaccgatgttttctacatgcaagttggtgatggtgatattgatcatcaatactggaaagcttatgaaaatattgactatccaactccaacttttttcgttgattctaaaaacccaggtactgaagttactggtgaaactgcagctgcctttgctgctgcttctattcttttcaaggatagtgatccagaatactctgctactcttttagatcaagcaaaggaatggtatgaatttgctgacaagtatcaattcgattattctcaatctgttccagcagctggatcatactacaagagttataatggttacaatgatgaactcgcttgggccgctatctggctttatcgtgcacttggtgatgaagcttacttagaaaaggctaagagtctagttgctaattacaaactcagtgaagttggtattgattgggatagtaagtaccagggtgtcattgttatccttgcccaacttggtgttaaagaatacgttgaaaaggttgaagcttgggttaaggatatctgtactaatggaaagttttctccaggtggtctttacattaacaaagatagtgaatggggttccaaccgccgtgctactgctatggctgccagtttaatttactatactcataaccttccagaaggtaatgaattacgtgaaatggctaagaaattcgctaaatcccaagctgattatattcaaggtgctaatccactcggtattgattatgttgttggtgctgatgaaacctctccacgttctgttcaccaccgtactgcttctggtgctgcttgtattgaatgtgatccagttcaaaatgttcacattatttacggtgccttagctggtggtccagatgttgaagataattaccttgatgacagagctgactataagaagaatgaagttgctcttgattacaatgtctgttatgctgctgttcttgcttatcttgttgaagaaggtcttaatgttgaagatccaattccagcttgggaatacgattaccgtattactaagggtgctga

SEQ ID NO: 22636 - DNA, 1425 bp, Neocallimastix californiae
  ENDO-1,4-BETA-GLUCANASE
ctcaaaaattttaaccacaattcttacttgtgctccagctttaattaaagctgcttcacaagattatgctcgtcaccttgagctttccattcttttttatgaagctcaaagatctggtaaattaccagctaataacagaattttctggcgtcatgacagtatggttgatgctggtaaagataacaatgttgatttaactggtggttactatgatgctggtgataatgtaaagtttaactttccacaagcaagtgcattaactcttctcgcttggagtgctgttgattggaaagatggttacaaggaagctggtcaatggggatatatgaaagatttattaaagtggggtatggattatttcattaaatgccacaccagtaaatatgaattatacggtcaagttggtaatggtagtttagatcatggagcttgggttccaccagaggaaattgattatgaatatccatcatacaagattactgcttctgctccaggttcagatcttgctgctgaaacatctgcttctatggttgctgcttctatggctttcagagatgatgatccagaatatgcggatattttattaaagcatggtaaggaactttacgattttgctgaaaaataccaaggtacttacgataaatctattactgatgctaagggttattatcgttcctacagtggattcaatgatgaacttgtttggggtgccgcctggttatacagagctacaggtgataagacctataaggataaagttgataagatttgggatactccatatggtgatcttgatccagataagttcctcggttctggtggtccaatttcttgggatgataaaaaggctgctgcttatgccttaatggctcttactactggtgagagcaagtatgttgatgaatctactaagcacagtgaattaatggttaactacaaaactactccaggaggtttatggtatgatactaatttatctatgtggggttctaacagatatgcttccaatgctgcttttactgttgctatgttagctacatctatggatgctaatgacgctaagcgtaaggaatacgttaaattcattaagaagcaaattgattatattattggtgataatccagccaaggttgattacgttgttggtgccgacccaagttctccaaaggctgttcaccaccgtggtgcttccggttcaaagggtgctgataagggtccaagtgaaaatgtctttgttttatatggtgctctcgctggtggcccaggagctaatgataatttcaaggatgctcgtgataactatgaaatgaacgaagttgctttagattacaatgctgccttccaaggtcttttagccttccttattcaagaaggatacaatgttccagatccaaaacaaacttgggatggtgcatggccaccaaa

SEQ ID NO: 22637 - DNA, 1425 bp, Neocallimastix californiae; identical to SEQ ID NO: 22636
  ENDO-1,4-BETA-GLUCANASE

SEQ ID NO: 22638 - DNA, 1434 bp, Neocallimastix californiae
  ENDO-1,4-BETA-GLUCANASE
tattagtgctgttgcagccctggtggctccaatggctgttgttgcaaaatctcaagattatgctagacacattgaattatctcttcttttctacgaagctcaacgttctggtaaacttccagaaaataacagaatttattggagacatgatagtatgctcgatgccggttctgaccatggtgtcgatcttactggtggttattatgatgctggtgataatgtcaagttcaatttcccaggtgcagcttctttaactcttcttgcttggagtgctattgattatgctgatggttacaaaaaggctgaccaatggaaatacattttagatgctgtccgttggggagctgattactttgttaaatgtcacactggtaaaaatgaactttacgttcaagttggtgacggtcaaatcgatcatggttattggtacccaccagaatatattcaatacaagcattcatcttacaagattactgcttctgctccaggttctgaagttgctggtgataccgcttccttcttagcagcttcttctattcttttcaaggaggaaaatccaacttattctgctactttattaaagcatgctatagaaatttacgattttgctgataaatatcgtggtgaatatactaaggctgttccagatgctcaaggtttctatgctaattggagtggtttcttggatgaattagcatttggtgctttatggttatacagagctactggtgatgaaagttatatgcaaaaattctctactattgctgatgctaaatatggtgaacaagatagtaaggcttatggtatttcaactggtccaatctcatgggatgataagagaccaggagcttatattcttgctgctatggttactggtgaagaaaaacgtttacaacaagcctactggtattgtgatagtattttaactcaaccaaaaactagaggtggtttatggtatgatgctagtctttctcaatggggttctaaccgttatgcctctaatgctgctgctatgcttgctatgtttgccaattatcttccaaaatctgatccaaaacgttctaaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgctttccttactaaggaaggtttaagtaaacctgattccgatagtgttaaaaatcatgacagagctttcccaaa

SEQ ID NO: 22639 - DNA, 585 bp, Neocallimastix californiae
  ENDO-1,4-BETA-GLUCANASE
tgattatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataa

SEQ ID NO: 22640 - DNA, 372 bp, Anaeromyces robustus
  ENDO-1,4-BETA-GLUCANASE
taaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgctttccttactaaggaaggtttaagtaaacctgattccgatagtgttaaaaatcatgacagagctttcccaaa

SEQ ID NO: 22641 - DNA, 168 bp, Anaeromyces robustus
  ENDO-1,4-BETA-GLUCANASE
tggtccaggtgctagagatgattacaaggatgatcgtaccaattataattctaatgaagttgctttagattataatgctgcttacactggtcttcttgctttcttaattcaagaaggattaaatgttccagatccagaacaaacttgggatggagcttggccaccaaa

SEQ ID NO: 22642 - DNA, 1425 bp, Anaeromyces robustus
  ENDO-1,4-BETA-GLUCANASE
ctcaaaaattattgctactattgctgcttgtgctccagcattaattaaagctgcttcacaagattacgcccgtcaccttgaactttctattcttttctatgaagctcaaagatctggtaaattaccagctaataacagaatcttctggcgtcatgacagtatggttgatgccggtaaagacaacaatgttgatttaactggtggttactatgatgctggtgataatgtaaaattcaatttcccacaagccagtgctcttactcttcttgcttggagtgctgttgaatggaaagatggttataaagaagctggtcaatgggaatacatgaaagatttacttaagtggggtatggattattttgttaaatgtcacactggtaaaactgaattatatggtcaagttggtaatggtagtcttgatcatggtgcttgggttccaccagaggatattgattataagtatccatcttataagattactgcttctgctccaggttctgatcttgctggtgaaactgctgctgcattagttgcttcttctttagcattcagagaagatgatccagaatatgctgatctcttattaaaacatggtaaggaaatttatgattttgccgataaatatagaggttcatatgataaatctattgaagatgctaagggttactaccgttcatatagtggttatatggatgaacttgtttggggtgctgcttggttatataaggctactggtgacgaaacatataagaaaaaggttgatgccatttgggattatccatacggtgatcttgatccagataagttccttggatcaactggcccaatttcttgggatgataagaaggcttcctcctatgctttaatggctatgattactggtgaagataaatatgtcaaagaatctactactcacagtgatttaatggttaattataaaactactccaggtggtttatggtatgatactaatttatctatgtggggttctaacagatatgcttctaatgctgctttcactgttgctatgttagcttcttctatggatcctaatgattcaaaacgtaagcaatatgttaagtttgttcaaaagcaaattgattatattattggtaacaatccagcaaaggttgattacgttgttggtgctgatccaagctcaccaaaggctgttcatcatcgtggtgcttcaggttctaagggagctgataaaggtccagatgaaaacgtattcgtcttatatggtgctcttgctggtggtccaggtgcaagagatgattataaggatactcgtaataattatgaaatgaatgaagtagctttagattacaatgctgccttccaaggtcttttagctttccttgttaaagaaggattaaatgttccagatccaaaacaaacttgggatggtgcttggccaccaaa

SEQ ID NO: 22643 - DNA, 1434 bp, Anaeromyces robustus
  ENDO-1,4-BETA-GLUCANASE
aattactttactttcagctttagctgctccaatggcagttgttgctaaatctcaagattacgcaagacatattgaactttctttacttttctatgaagctcaacgttcaggtaaacttccagaaaacaaccgtatttactggagacacgacagtttacttgatgctggtgctgataatggtgttgatcttactggtggttattatgatgctggtgataatgtcaagtttaacttcccagctgctgccactttaactcttttagcttggagtggtattgattatgctcaaggttataaagaagctggtcaatgggattatcttcttgatgctgttcgttggggtgctgattatttcatgaaatgtcacactggtaaaaacgaactttatgttcaagttggttctggtagagttgatcacgcttactggtatccacctgaatatgttaactatgatcatccatcattcaagattactgcttcagctccaggttctgaagttgctggtgacactgcttctttcttagctgctgcttctattttattcaaggatgttgattcatcatattctcaaaaatgtttaaaacatgctaaagaaatttacgatttcgctgatacttaccgtggtgaatacactaaagctgttgaagatgctcaacaattctatgctaattggagtggtttccttgatgaattagcttttggtgctttatggctttacagagctactggtgatgaatcttaccataataaatttaagaaaattgctgatgattcttacggtgaacaagatactaaagcttatggtatttgtactggtccaatttcatgggatgataagagaccaggttcttacattcttgctgccatgattactggtgaagaaaaacgtttacaacaagcttattggtattgtgatgaagttttaactcaaccaaaaactccaggtggtttatggtataatgataacctttctaaatggggttctaaccgttatgcttctaatgccgctgctatgttaggtatgttcgctaattaccttccaaagagtgatccaaaacgttctaaatatattgattttgttaagagtcaaaccaattatattcttggtgataatccagctaaggttaactatgttgttggtgccgaagctaattcaccaaaggctgttcatcaccgtggttcttctggtacttacgattctcaagataataatgctaaaccaaccgattacaatatttacactttatggggtgctttagctggtggtccaggaaaatctgatgattattctgatactagaaagaattatgaaatgaatgaagttgctcttgattacaatgctgcattccaaatgaatcttgctcttcttgttaaagaaggtctcagtgttccagatccagatagtgttaaaaatcatgatagatcattcccaaa

SEQ ID NO: 22644 - DNA, 952 bp, Anaeromyces robustus
  ENDO-1,4-BETA-GLUCANASE
tgattatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataataatccatgcccagaaggtgcttccttctacccatctgcttcttataaggatgaattagtctggggtgctgcttgggtttaccgtgcatcaggtgatgaaaaatactataaaaaagctgatgaatattatgattctcttgctttatctggacgtaatttaattggaccaattacatgggatgatgcttcatctggtattgttttcttaatgtcaaaaccaggttttggttctaactgggaaagatacttaggcgaagctcaacattatgttgatcaatacttaaatgatatgggtgctcgtactgatggaggtatgttatggtacagttccgtttctggttggggatctgctcgtcatgctatggct

SEQ ID NO: 22645 - DNA, 1440 bp, Anaeromyces robustus
  ENDO-1,4-BETA-GLUCANASE
tatattagcaactatcgcagttttagcctcaccaatggctgtaattgcaaaatcacaagattatgctagacatattgaactttctttacttttctacgaagctcaacgttctggtaaacttccagaaaataatcgtatttattggagattcgatagtcaacttgatgctggtgctgatcatggtgttgatcttactggtggttattatgatgctggtgataatgtaaagttcaatttcccagctgcagcagcattaactttattagcttggagtggtgttgattatgctgatggttataaaaaagctggtcaatgggattatttccttgatgctattcgttggggtgctgactattttatgaaatgtcacactggtaaaaatgaattatatttccaagtcggtgacggtaaaattgaccacacttattggtatccaccagaatatactgtctatgaacatccatcattaaaacttactacttccaaaccaggttctgaagtagctagtgatacagcttcatttttagctgctacctatatgatatttaaagatattgatccaacttacgctaaaaaatgtttacaacattcaaaagaaatttatgaatttgctgacaagtatcgtggtgattattcaaaatcatttggtaattatgtcaatgatttctataaaaattggggtacaattaatgatgaattagctttcggtgctttatggctttatagagctactggtgatgaatcttatttagctaaatataaggttattgctgatgcttcatatgatagtcgtgatgaaagtgcctatccaaattgtagtggtccaatttcatgggatgataaaagaccaggtgcctatgttcttggtgctattgttactggtgaagataaatatttagataaagctatcagctattgtgatgctgtattaactcaaccaaaaactcgtggtggtctttggtataataataacctttctaaatggggttcaaatcgttatgcttctaatgctgcttctatgttaggtatgttagctaattatcttccaaaggatcatccaaaacgttcaaaatatattgattttgttaaaagtcaaactaattatattcttggtgataatccagctaaagttaattttgttgttggtgctgaaaagaattcaccaaaggctgtacatcaccgtggtgcttctggtacttatgattctcaagatactaatgctaaaccaactgatcataatgtttacactatttggggtgctttagctggaggtccaggtaaggatgattcttataccgacacaagaaagaattatgaaatgaatgaagttgcccttgattataatgctgctttccaaatgaatcttgctttacttgttaaagaaggtttaagtgttccagatccagatagtgttaaaattcatgatagatccttccctaa

SEQ ID NO: 22646 - DNA, 168 bp, Anaeromyces robustus
  ENDO-1,4-BETA-GLUCANASE
aggtgctagagatgattacaaggatgatcgtaccaattataattctaatgaagttgctttagattataatgctgcttacactggtcttcttgctttcttaattcaagaaggattaaatgttccagatccaaaacaaacttgggatggagcctggccaccaaaagaatc

SEQ ID NO: 22647 - DNA, 1353 bp, Anaeromyces robustus
  ENDO-1,4-BETA-GLUCANASE
ttatgctagaattttaaatttgaatttacgtttttatgaatgtaattggtctggtaaagctccagaacataaacaagtctattggagatatgactctgccttagaagatggtgctgatgttggcttagatcttactggaggtttttatgatgctggtgatcatgtcaaatttaatcttccaatgtcttatgctatgactatgttagcatggggtggtattgatttatatgaaaattatgtcgctgctggacaaatcgactatttagttcaaattgttaaccatggtgcagattactttgttaagtgtcatccagaaaaggaagttatttacgctcaagttggtcttggtgatgttgatcactgtttctgggttccaccagaattaatggaaatggaaagaccagctgtatgtaaacttactccagaaaatggtgcttctgatgttactgcacaaatggctgcagctttagcttcagcttctatcttaaataaaaaagttggaaatactgaaaaagctgaactttacttaaaacacgctattgaaatttatgactttgctgataaatacagagatgtttatggtaatccatgtccagaaggtgcttcattctatccatctgcttcatacaaggatgaattagtttggggtgctgcttgggtttaccgtgcttctggtgatgaaaaatattatgataaggctgatgaatattatgattctcttggtttatctggtcgtgttttaattggaccaatttcatgggatgatgcttcttcaggtattatcttcttaatgtcaaaaccaggttttggtaagaactgggaaagatatttaaatgaagctcaaatttatgttgatcaatacttaaatgataaaggatctcgtactgatgctggtatgttatggtacagttccgtatctggttggggatctgctcgtcatgctatggccggtgttttcctttattgtatatttaatacttaccacaaaccagaagatccaaaatactttaactttattcaacaacaagctgattacattcttggtaataatccatttaatcgttctcttgttgttggttctattccaggtcatgatccattaaatgttcaccatcgtggttctcatggtggttattcaccaatttcaccaccagaacataacatgtacactttatatggtgcccttgctggtggtccacttcaagatgattcatgggatgatgatagaaacaactatattactaatgaagtttcttgtgattataatgctggtattactggtgttatggcctatcttactccatggactgttccagataactttgaaattgatgaaagtgaaccagaagctga

SEQ ID NO: 22648 - DNA, 1350 bp, Anaeromyces robustus
  ENDO-1,4-BETA-GLUCANASE
ttcccaagattatgctagacatcttgaattaaatttcttattctatgaagcccaacgttctggtcatcttccagccaataatcgtattccatggagaagtgactctggtcttgaccatggtgctgataatggtgtagatcttactggtggttattatgatgctggtgataatgttaaattcaatttcccacaagcattctctatgactgctattgcttggtatggtcttgaattcgctaaaggtgttgaaatggctggtcaaactgaatatttaaaggataccgttaaatggggttgtgattatttattaaaatgtcataaaaagggtacagatgttttctatatgcaagttggtgatggtgatattgatcatctttattggaaggctgttgaagatattgattatccaactccatccttctatgttgattctaaaaacccaggtactgaagttactggtgaaactgctgctgcttttgctgctgcttctcttcttttcaaagaaagtgacccagaatattctgctactcttttagatcaagctgttgaatggtttaattttgctaatacttatagatttgattattctgtttctgttccaaaggttgctagttactataagagttggggtggttacaaggatgaacttgcctgggctgctatatggctttacaaagctcttggtgaagaaaaatacttagaattagctaaggatcttgttaaagattataaacttggtgaactcggttttgattgggatagtaaataccaaagtactattgttatccttgctcaacttggtgttaaggaatatgttgaaaaagttgaaaattgggttagagaaatttgtactaagggtaaattatctccaggtggtctttacattaataaagatagtgaatggggatcctgtcgtcgtgctacttctatggctgctagtttaattttctatactcatactcttccagaaggtaatgaattacgtgaaatggctaagaagtttgctcaatctcaagctgattatgttcaaggtaataatccacttggtattgatttcgttgttggtgctgatgcttcttcaccacgttctgttcatcatcgtactgcttctggtgctgattgtattgaatgtgatccagttgaaaatgctcatattatttatggtgctttagctggtggtccagatgaaaatgatcaatatgaagatattagagctgattaccaaaagaatgaagttgctcttgattataatgtttgttatgctgctgtttgtgcctatcttattgaagaaggattaaatgttgaagatccaattccagcttgggaatatgattaccgtcttattaaaaa

SEQ ID NO: 22649 - DNA, 1443 bp, Piromyces finnis
  ENDO-1,4-BETA-GLUCANASE
ctcaactataattactgccattgcagccctggtggctccaatgactgctgttgctaaatctcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttacaaggaagctggtcaatggaaatatcttcttgatgcagttcgttggggagctgattacttcatgaagtgtcacactggtaagaacgaactttatgctcaagttggtaagggtactactgatcactcatactggtacccaccagaatatgcttcctacgatcacccatcattcaagctcacagcttcagctccaggtaccgaagtttcagccgatactgcctcattcttagctgcttcatacctcttattcaaggatgaagatccatcctatgcctccaagtgtttacaacactccaaggaaatctatgactttgccgatacttaccgtggtgattacattggatcaattccagatgtttcaggtttctactccacctggagtggttacaatgatgaattagcctttggtgccttatggctttacagagccactggtagcgaaagttacatgaagaaattcgaagccattgctgatgcagtttatggagctcaagatactaaggcttacggtacttgtactggaccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttccttacacaagaaggattaagtaaaccagatccagacagtgttaaaattcatgaaagatcttggccaaa

SEQ ID NO: 22650 - DNA, 1440 bp, Piromyces finnis
  ENDO-1,4-BETA-GLUCANASE
ctcaactataattactgccattgcagccctggtggctccaatgactgctgttgctaaatctcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttataagagtgctggacaatgggaatatattttagatgctgttcgttggggtgctgattatttcatgaaatgtcacactggtaaaaatgaactttatgctcaagttggtgatggtaatactgaccatgctttttggtatccaccagaatatgtaaaatatgattacccatcatttaaagttactgctgaaaaaccaggttctgaagttgctggtgaaactgctgcatttttagctgctgcttccattctttttaaggatgaagattcttcttattctgccaaattattaaagcatgctaaggaaatttatgaatttgctgatacttatcgtggagattatactggtgctattccaggagttgttagtttctacagtacctatagtggttataatgatgaattagcttggggtgctgcttggcttcttagagctacaggtgatgaatcttatcttaataaatacaatgttatcgcaaataaaaagtatgaatcttatgatccaaagaaattttcaggtgctactggaccaatctcttgggatgataagagaccaggttgctatattttaattgctatggttactggtgatgaaaatcgtatcaaggaagcttacaattattgtgatgctgtattaacacaaccaaaaactccaggtggtttatggtatgatgatggtttatctatgtggggttctaatcgttatgcatcaaatgctgcctccatgttagctatgtttgcaaactatcttccaaaatctgatccaaaacgtgctaagtatgttgaatttgttcaacaacaaactaattatattcttggtgacaacccagctaaaattaattacgttgttggtgctgaagccaactcaccaaaagctgttcaccatcgtggttcttctggtgtcttcgattcacaagataaagctgcaaaaccagatgaaaacatttacacattatggggtgctttagccggtggtccagatgaaactgattcttacattgatactcgtagtaactttagaaccaatgaagtagctcttgattacaatgctgctttccaaatgaatcttgctttcctcgtaaaggaaggtttcaataaaccagatccagatagtgttaagattcatgacagatctttcccaaa

SEQ ID NO: 22651 - DNA, 1434 bp, Piromyces finnis
  ENDO-1,4-BETA-GLUCANASE
tgtttctgctattgcagccctggtggctccaatggccgttgtcgctaaatctcaagattatgctagacacattgaattatctcttcttttctatgaagctcaacgttctggtaaacttccagaaaataacagagtttactggagacatgatagtttacttgatgctggtgccgataatggtgttgatcttaccggtggttattatgatgctggtgataatgttaagttcaacttcccaggtgctgctgccttaactcttcttgcttggagtggtattgattatgctgatggttacaaagaagctggtcaatgggattatatattagatgcagttcgttggggtgctgattactttgtcaagtgtcacactggaaagaatgaactctacgttcaagtaggtaagggtgctactgatcatggtttctggtatccaccagaatatgttcaatatgatcatccatcttacaaaattactgctgctgctccaggttccgaagttgctggtgatactgcttctttcttagctgctgcctctattcttttcaaggatattgattcttcatattcttctaatttattaaaacatgctattgaaatatatgattttgctgattcttaccgtggtgaatacattaaggctgttccagatgctcaaggtttctactctaactggagtggttacaatgatgaattagcctttggtgctttatggttatacagagctactggtgaaagtaagtatatggataaattcagtaaaattgctgatgcttcttacggtgaacaagatactaaggcttatggtacatgtactggtccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttccttacacaagaaggattaagtaaaccagatccagacagtgttaaaattcatgaaagatcttggccaaa

SEQ ID NO: 22652 - DNA, 1443 bp, Piromyces finnis
  ENDO-1,4-BETA-GLUCANASE
ctcaactataattactgccattgcagccctggtggctccaatgactgctgttgctaaatctcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttacaaggaagctggtcaatggaaatatcttcttgatgcagttcgttggggagctgattacttcatgaagtgtcacactggtaagaacgaactttatgctcaagttggtaagggtactactgatcactcatactggtacccaccagaatatgcttcctacgatcacccatcattcaagctcacagcttcagctccaggtaccgaagtttcagccgatactgcctcattcttagctgcttcatacctcttattcaaggatgaagatccatcctatgcctccaagtgtttacaacactccaaggaaatctatgactttgccgatacttaccgtggtgattacattggatcaattccagatgtttcaggtttctactccacctggagtggttacaatgatgaattagcctttggtgccttatggctttacagagccactggtagcgaaagttacatgaagaaattcgaagccattgctgatgcagtttatggagctcaagatactaaggcttacggtacttgtactggaccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttcctcgtaaaggaaggtttcaataaaccagatccagatagtgttaagattcatgacagatctttcccaaa

SEQ ID NO: 22653 - DNA, 1440 bp, Piromyces finnis
  ENDO-1,4-BETA-GLUCANASE
ctcaactataattactgccattgcagccctggtggctccaatgactgctgttgctaaatctcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttataagagtgctggacaatgggaatatattttagatgctgttcgttggggtgctgattatttcatgaaatgtcacactggtaaaaatgaactttatgctcaagttggtgatggtaatactgaccatgctttttggtatccaccagaatatgtaaaatatgattacccatcatttaaagttactgctgaaaaaccaggttctgaagttgctggtgaaactgctgcatttttagctgctgcttccattctttttaaggatgaagattcttcttattctgccaaattattaaagcatgctaaggaaatttatgaatttgctgatacttatcgtggagattatactggtgctattccaggagttgttagtttctacagtacctatagtggttataatgatgaattagcttggggtgctgcttggcttcttagagctacaggtgatgaatcttatcttaataaatacaatgttatcgcaaataaaaagtatgaatcttatgatccaaagaaattttcaggtgctactggaccaatctcttgggatgataagagaccaggttgctatattttaattgctatggttactggtgatgaaaatcgtatcaaggaagcttacaattattgtgatgctgtattaacacaaccaaaaactccaggtggtttatggtatgatgatggtttatctatgtggggttctaatcgttatgcatcaaatgctgcctccatgttagctatgtttgcaaactatcttccaaaatctgatccaaaacgtgctaagtatgttgaatttgttcaacaacaaactaattatattcttggtgacaacccagctaaaattaattacgttgttggtgctgaagccaactcaccaaaagctgttcaccatcgtggttcttctggtgtcttcgattcacaagataaagctgcaaaaccagatgaaaacatttacacattatggggtgctttagccggtggtccagatgaaactgattcttacattgatactcgtagtaactttagaaccaatgaagtagctcttgattacaatgctgctttccaaatgaatcttgctttccttacacaagaaggattaagtaaaccagatccagacagtgttaaaattcatgaaagatcttggccaaa

SEQ ID NO: 22654 - DNA, 1434 bp, Piromyces finnis
  ENDO-1,4-BETA-GLUCANASE
tgtttctgctattgcagccctggtggctccaatggccgttgtcgctaaatctcaagattatgctagacacattgaattatctcttcttttctatgaagctcaacgttctggtaaacttccagaaaataacagagtttactggagacatgatagtttacttgatgctggtgccgataatggtgttgatcttaccggtggttattatgatgctggtgataatgttaagttcaacttcccaggtgctgctgccttaactcttcttgcttggagtggtattgattatgctgatggttacaaagaagctggtcaatgggattatatattagatgcagttcgttggggtgctgattactttgtcaagtgtcacactggaaagaatgaactctacgttcaagtaggtaagggtgctactgatcatggtttctggtatccaccagaatatgttcaatatgatcatccatcttacaaaattactgctgctgctccaggttccgaagttgctggtgatactgcttctttcttagctgctgcctctattcttttcaaggatattgattcttcatattcttctaatttattaaaacatgctattgaaatatatgattttgctgattcttaccgtggtgaatacattaaggctgttccagatgctcaaggtttctactctaactggagtggttacaatgatgaattagcctttggtgctttatggttatacagagctactggtgaaagtaagtatatggataaattcagtaaaattgctgatgcttcttacggtgaacaagatactaaggcttatggtacatgtactggtccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttcctcgtaaaggaaggtttcaataaaccagatccagatagtgttaagattcatgacagatctttcccaaa

SEQ ID NO: 22655 - DNA, 1425 bp, Piromyces finnis
  ENDO-1,4-BETA-GLUCANASE
ctctaaaattttaactgctcttcttacttgcggtccagctttaattaaggctgcttcccaagattacgctcgtcaccttgaactttctattcttttctatgaagctcaaagatctggtaaattaccagctaacaacagaattttctggcgtcatgacagtatggttgatgctggtaaagataacaaggttgatttaactggtggttactacgatgctggtgataacgttaaattcaatttcccacaagctagtgctcttactcttcttgcttggggtgcctacaaatggaaggatggttacaaggaagctggtcaatgggattacatgaaggatttacttaagtggggtatggattacttcattagatgccacactgacaagtacgtcttatacggtcaagttggtaatggtagtttagatcacggtgcttgggttgctccagaagatattgactacgaatacccatcttacaagattactgcttccgctccaggttctgatcttgctgctgaaacttctgcctctatggttgctgcttctttagctttcagagatgaagacccaacctatgctgatactttattaaagcatggtagagaactttatgaatttgctgaaaagtaccaaggtacttacgataaatctattactgatgccaagggttactaccgttcttacagtggttttaatgatgaacttgtttggggtgctgctatgttatacgctgccactggtgaacaaacttacaaggacaaggtcgataagatttggaacactccatacggtgaacttgatccagatagattccttggttctactggtccaatttcttgggatgataagaaggctgctgcttacgctttaatggccatcactactggtgaaagcaaatatattgaagaatccactagacacagtgatttaatggttaattacccaactactccaggtggtttatggtacgatactaacttatctatgtgggcttctaacagatatgctgctaatgctgctttcactgttgctatgttagctacctctatggatgctaatgactctaagcgtaaggaatatgttgcttttgttaagaagcaaattgattacattcttggtgataacccagctaaggttgattacgttgttggtgctgacccaagttctccaaaggctgttcaccaccgtggtgcttctggttcaaagggtgctgacaagggtccagatgaaaacgttttcattttatatggtgctcttgctggtggtccaggtgccaaggataattacaaggatgctcgtaacaactatgaaatgaacgaagtcgccttagattacaatgctgccttccaaggtcttttagccttccttatcactgaaggattaaacgttccagatccaaagcaaacttgggatggtgcttggccaccaag

SEQ ID NO: 22656 - DNA, 978 bp, Piromyces finnis
  ENDO-1,4-BETA-GLUCANASE
atctttaaaacttactacaggtgctccaggttctgaagttgctggtgatactgcttcatttttagctgctacttacattattttcaaggatatagatccttcttatgccaaaaaatgtttacaacattctaaggaaatttatgaatttgctgatacctatcgtggtgattattcaaaatcttttggtgattatgtcaatagtttctataagaattggggtactatttatgatgaattagcttttggtgctttatggctttacagagctacaaatgatgaatcttacttaaaaaagtataaagcaattgctgatgcttcctacgatactagagatgaaaatgcctatggtaattgtaagggtccaatttcatgggatgataagagaccaggtggttatgtacttggtgctatcgttactggtgaagaaaaatatattgaaaaagctttaagttattgtgatatggtattaactcaaccaagaactccaggtggtttatggtatgatagtaacctttccaaatggggttctaaccgttatgcttctaatgctgcatccatggtagctatgatggcagatttccttccaaaggatgatgctagacgtgcaaagtatgttgatttcgttaaaagtcaaacagattatattcttggtgataatccagctggtgttaactatgttgttggagctgaagaaaattcaccaaaggctgttcaccaccgtgctgcctcaggtacttatgattctcaagatcgtaatgccaaaccaaatgatcataatgtttacactatttggggtgctttagctggtggtccagcaaaggatgattcctacgaagataccagaaagaattatgaaatgaatgaagttgctcttgattataatgctgctttccaaatgaatcttgctttccttgttaaggaaggtttaagtattccagatccagatagtgttaaaaaccatgaaagatccttcccaaa

SEQ ID NO: 22657 - DNA, 183 bp, Piromyces finnis
  ENDO-1,4-BETA-GLUCANASE
tgctcttgctggtggtccagatgctaatgataaatatactgatgatcgtaccaactataattccaatgaagttgctttagattataatgctgcttatactggtcttcttgcctttttaattcaagaaggattaaatgtttcagatccagctcaaacttgggaaggagcttggccaccaaagga

SEQ ID NO: 22658 - DNA, 186 bp, Piromyces finnis
  ENDO-1,4-BETA-GLUCANASE
tgctcttgctggtggtccagatggtaatgataagtacactgatgaccgtaccaattacaactccaatgaagtcgctttagattataacgctgcttacactggtcttcttgccttcttaattcaagaaggattaaacgttccagatccagcccaaacctgggaaggtgcctggccaccaaaggaaca

SEQ ID NO: 22659 - DNA, 1195 bp, Piromyces finnis; identical to SEQ ID NO: 13948
  ENDO-1,4-BETA-GLUCANASE

SEQ ID NO: 22660 - DNA, 1192 bp, Piromyces finnis
  ENDO-1,4-BETA-GLUCANASE
ttatgctagaatcttaaatttgaatttacgtttttatgaatgtaattggtctggtaaagctccagaacataaacaggtttattggagatatgattcagcattagaagatggtgcagatgttggattagatttaactggaggttactatgatgctggtgatcatgttaaatttaatttaccaatgtcatatgcaatgactatgttagcttggggtggtattgatttatatgataattatgttgctgctggtcaaattgattatttagttcaaatcgttaatcatggagcagattactttgttaaatgccatccagaaaaagaagttatttatgctcaagttggtcttggtgatgtagatcattgtttctgggttccacctgaattaatggaaatggaaagaccagctgtttgtaagcttactccagagaatggtgcttctgatgtaactgcacaaatggctgctgcattagctagtgcatcaattttaaataagaaatatggtaatgaggaaaaagctgaactttatttaaagcatgctattgaaatttacgattttgctgataaatacagagatgtatatggtaatccttgtccagaaggtgcatctttctatccatctgcttcttataaagatgaattagtttggggtgctgcttgggtttaccgtgcatctggagatgagaaatactatgaaaaggctgattcatattatgattctcttggtttatctggtcgtgtattaattggtccaatttcttgggatgatgcttcatcaggtattattttcttaatgtcaaagccaggatttggttcaaactggaaaagatatttaggtgaagctcagacttatgttgatcaatacttaaatgataaatcagctcgtaccgatgctggtatgttatggtatagtgctgtttctggttggggatctgctcgtcatgctatggctggtacattcctttactgtattttcaatacttatcataacccaactgatccaaaatactttaatttcattcaacaacaagctgattatattcttggtaataatccatttgatcgttcacttgtagttggttctattccaggtcatgatccacttaatgttcatcaccgtggttctcatggaggttattcaccaatttctccaccagaacacaacatgtatactttatatggtgctcttgctggt

SEQ ID NO: 22661 - DNA, 1437 bp, Neocallimastix californiae; identical to SEQ ID NO: 22627
  ENDOGLUCANASE

SEQ ID NO: 22662 - DNA, 1440 bp, Neocallimastix californiae; identical to SEQ ID NO: 22628
  ENDOGLUCANASE

SEQ ID NO: 22663 - DNA, 1434 bp, Neocallimastix californiae; identical to SEQ ID NO: 22629
  ENDOGLUCANASE

SEQ ID NO: 22664 - DNA, 552 bp, Neocallimastix californiae; identical to SEQ ID NO: 22630
  ENDOGLUCANASE

SEQ ID NO: 22665 - DNA, 1431 bp, Neocallimastix californiae; identical to SEQ ID NO: 22632
  ENDOGLUCANASE

SEQ ID NO: 22666 - DNA, 1413 bp, Neocallimastix californiae; identical to SEQ ID NO: 22634
  ENDOGLUCANASE

SEQ ID NO: 22667 - DNA, 1425 bp, Neocallimastix californiae; identical to SEQ ID NO: 22636
  ENDOGLUCANASE

SEQ ID NO: 22668 - DNA, 1425 bp, Neocallimastix californiae; identical to SEQ ID NO: 22636
  ENDOGLUCANASE

SEQ ID NO: 22669 - DNA, 1434 bp, Neocallimastix californiae; identical to SEQ ID NO: 22638
  ENDOGLUCANASE

SEQ ID NO: 22670 - DNA, 585 bp, Neocallimastix californiae; identical to SEQ ID NO: 22639
  ENDOGLUCANASE

SEQ ID NO: 22671 - DNA, 1425 bp, Anaeromyces robustus; identical to SEQ ID NO: 22642
  ENDOGLUCANASE

SEQ ID NO: 22672 - DNA, 1434 bp, Anaeromyces robustus; identical to SEQ ID NO: 22643
  ENDOGLUCANASE

SEQ ID NO: 22673 - DNA, 952 bp, Anaeromyces robustus; identical to SEQ ID NO: 22644
  ENDOGLUCANASE

SEQ ID NO: 22674 - DNA, 1440 bp, Anaeromyces robustus; identical to SEQ ID NO: 22645
  ENDOGLUCANASE

SEQ ID NO: 22675 - DNA, 1350 bp, Anaeromyces robustus; identical to SEQ ID NO: 22648
  ENDOGLUCANASE

SEQ ID NO: 22676 - DNA, 1443 bp, Piromyces finnis; identical to SEQ ID NO: 22649
  ENDOGLUCANASE

SEQ ID NO: 22677 - DNA, 1440 bp, Piromyces finnis; identical to SEQ ID NO: 22650
  ENDOGLUCANASE

SEQ ID NO: 22678 - DNA, 1434 bp, Piromyces finnis; identical to SEQ ID NO: 22651
  ENDOGLUCANASE

SEQ ID NO: 22679 - DNA, 1443 bp, Piromyces finnis; identical to SEQ ID NO: 22652
  ENDOGLUCANASE

SEQ ID NO: 22680 - DNA, 1440 bp, Piromyces finnis; identical to SEQ ID NO: 22653
  ENDOGLUCANASE

SEQ ID NO: 22681 - DNA, 1434 bp, Piromyces finnis; identical to SEQ ID NO: 22654
  ENDOGLUCANASE

SEQ ID NO: 22682 - DNA, 1425 bp, Piromyces finnis; identical to SEQ ID NO: 22655
  ENDOGLUCANASE

SEQ ID NO: 22683 - DNA, 978 bp, Piromyces finnis; identical to SEQ ID NO: 22656
  ENDOGLUCANASE

SEQ ID NO: 22684 - DNA, 1195 bp, Piromyces finnis; identical to SEQ ID NO: 13948
  ENDOGLUCANASE

SEQ ID NO: 22685 - DNA, 192 bp, Neocallimastix californiae
  Endoglucanase_F_dom3
agaagctcgtgaagattacatcaaattcaacgaagatgtttacattccatctggttggactggtaagaatgctcaaggtgctaacatcagaagtggtgttaagttcattgatattcgtccaaagtacaaggaagatccagattgggctcaagtcgaagacttcctcaacggtggttctgctccaagattcac

SEQ ID NO: 22686 - DNA, 192 bp, Neocallimastix californiae
  Endoglucanase_F_dom3
agaagctcgtgaagattacatcaaattcaacgaagaagtttacattccatctggttggtctggtaagaacgctcaaggtgctcaacttaagagtggtatcaaattcattgatattcgtccaaagtacaaggaagatccagattgggctcaagttgaagacttccttaacggtggttctgctccaagattcac

SEQ ID NO: 22687 - DNA, 192 bp, Neocallimastix californiae
  Endoglucanase_F_dom3
agaagctcgtgaagattacattaaattcaacgaagatgtttacattccatctggttggactggtaagaatgctcaaggtgccaacatcagaagtggtgttaagttcattgatattcgtccaaagtacaaggaagatccagattgggctcaagtcgaagacttcctcaacggtggttccgctccaagattcac

SEQ ID NO: 22688 - DNA, 192 bp, Neocallimastix californiae
  Endoglucanase_F_dom3
agaggctcgtgaagattacatcaagttcaatgaagaagtatacattccatcgggatggtcaggtaagaacgctcaaggtgccaatattaagagtggagtcaagttcattgatattcgtccaaagtacaaggaagataaggattgggctcaagtggaagacttccttaatggaggatcggctccaagatttac

SEQ ID NO: 22689 - DNA, 192 bp, Neocallimastix californiae; identical to SEQ ID NO: 22685
  Endoglucanase_F_dom3

SEQ ID NO: 22690 - DNA, 192 bp, Neocallimastix californiae
  Endoglucanase_F_dom3
cgaagctcgtggtgattacgataaattcggaggagaagtttacattccaagaggatggagtggtaagaatgctcaaggtgctaacattagaaatggagttactttcattgatattcgtccaaaatataagcaagatccagattgggaacaagttgaagcttaccttaatggaggagaaccaccagtattcac

SEQ ID NO: 22691 - DNA, 189 bp, Neocallimastix californiae
  Endoglucanase_F_dom3
agctcgtgaagactatgccaagttctcatctgaagtttacattccatctggatggtctggtaagaacgctcaaggtgcaaacattaagaatggtgttactttcattgatattcgtccaaaatacaaacaagatcctgattgggcacaagttgaaaacttcattaatggaggagaaccaccaagattccg

SEQ ID NO: 22692 - DNA, 192 bp, Neocallimastix californiae
  Endoglucanase_F_dom3
agaagctcgtgaagattacaataagttcgaagaaaatgtttacattccttcaggttggactggtaagaacgctcaaggtgctaacatcagaagtggtgttaagttcattgatattcgtccaaaatacaagcaagataaggattgggctcaagttgaagactaccttaacggtggtaaccctccaaaattcac

SEQ ID NO: 22693 - DNA, 192 bp, Neocallimastix californiae
  Endoglucanase_F_dom3
agaagctcgtgaagattacattaagttcaatgaagatgtttacattccttcaggttggactggtaagaacgctcaaggtgctaacatcagaagtggtgttaagttcattgatattcgtccaaaatacaagcaagataaggattgggctcaagttgaagacttccttaacggtggtagcgctccaagattcac

SEQ ID NO: 22694 - DNA, 192 bp, Neocallimastix californiae
  Endoglucanase_F_dom3
agaagctcgtgaagattacattaagtttaatgaagaagtttacattccaagtggttggactggtaagaatgctcaaggtgctaacatcagaaatggtgtgaagttcattgatattcgtccaaagtataaggaagatccagactgggctcaagttgaaaacttccttaacggtggtgaagctccaagattcac

SEQ ID NO: 22695 - DNA, 192 bp, Neocallimastix californiae
  Endoglucanase_F_dom3
agaagctcgtgaagattacatcaaattcaatgaagaagtttacattccatacggatggactggtaagaatgctcaaggtgccacccttgaacatggtgttaagtttattgatattcgtccaaaatacaaacaagataaggattgggcacaagttgaaaacttccttaatggtggtgaagccccaagattcac

SEQ ID NO: 22696 - DNA, 192 bp, Neocallimastix californiae
  Endoglucanase_F_dom3
agaaccacgtggtgattacagtaaattcggtgaagaagtttacattccatctggttggactggtaagaatgctcaaggtgctaacattcgtagtggtgttactttcattgatattcgtccaaaatacaagcaagatccagattgggctcaagttgaaaactaccttaatggtggtagtgaaccacgtttcac

SEQ ID NO: 22697 - DNA, 192 bp, Neocallimastix californiae
  Endoglucanase_F_dom3
agaagctcgtgctgattacagtaaattcggagatgaagtttacattccatctggttggactggtaagaatgctcaaggtgctaaccttaagagtggtgttactttcattgatattcgtccaaaatacaagcaagatccagattgggctcaagttgaaaactaccttaacggtggtagtgaaccaaccttcac

SEQ ID NO: 22698 - DNA, 192 bp, Neocallimastix californiae
  Endoglucanase_F_dom3
agaagctcgtgctgattacgataaattcggtggtgaagtttacattccatctggttggactggtaagaacgctcaaggtgctaaccttaagagtggtgttactttcattgacattcgtccaaaatacaagcaagatccagattgggctcaagttgaaaactaccttaacggtggtagtgctccaaccttcaa

SEQ ID NO: 22699 - DNA, 192 bp, Neocallimastix californiae; identical to SEQ ID NO: 22698
  Endoglucanase_F_dom3

SEQ ID NO: 22700 - DNA, 174 bp, Neocallimastix californiae
  Endoglucanase_F_dom3
attctatcaatatcgtctttttaataaaaaattaccaattcaaaaggattttaaaggtgtttatggtagatctacaaaaattaatgataaatctagtttcttgtcaatccgtccatactataaacgcgataaaaattggaaaaaaattcaaacttttttagataaaggaactcc

SEQ ID NO: 22701 - DNA, 192 bp, Neocallimastix californiae
  Endoglucanase_F_dom3
agaagcccgtgaagattacattaaattcaatgaagaagtttacattccaagtggatggactggtaagaatgctcaaggtgctaacatcaggagtggagttaagttcattgatatccgtccaaaatacaaggaagatccagactgggctcaagttgaaaacttccttaacggtggtgaagctccaagattcac

SEQ ID NO: 22702 - DNA, 192 bp, Anaeromyces robustus; identical to SEQ ID NO: 22696
  Endoglucanase_F_dom3

SEQ ID NO: 22703 - DNA, 192 bp, Anaeromyces robustus; identical to SEQ ID NO: 22697
  Endoglucanase_F_dom3

SEQ ID NO: 22704 - DNA, 192 bp, Anaeromyces robustus
  Endoglucanase_F_dom3
agaagcacgtgaagattatgctaaattcggtggtgaagtttatgttccatctggttggactggtaagaatgctcaaggtgctaacattaagaatggtgttactttcattgatattcgtccaaagtataaacaagatccagattgggctcaagttgaaaacttccttaatggaggtgatccaccagaattcac

SEQ ID NO: 22705 - DNA, 183 bp, Anaeromyces robustus
  Endoglucanase_F_dom3
atttcatgataattattcaaaatttgcaaatccagtatattttcccaatgattggaagggtagaaatcctcaaggagcttatttaaaaagaggagcttgtttccttgatattcgaccaaaatataaagaagatcctgattggtatcaagttgaatattatcttaatgggtatgaaaatcctcc

SEQ ID NO: 22706 - DNA, 162 bp, Anaeromyces robustus
  Endoglucanase_F_dom3
tcgtttatttaataaaaaattaccaattcaaaaagatttcaaaggtgtttatggtcaatccgcaaaaattaatgataaatcaacatttatatctattcgtccttattataaaaaagataaaaattggaaaataattaaatcctatttaaatgatggaacacc

SEQ ID NO: 22707 - DNA, 174 bp, Piromyces finnis
  Endoglucanase_F_dom3
ttatcaatatcgtcgttttaataaaaaattaccaataccagaaggatttaaaggaatgtatggaagatcatcaaaaattaatgataaatcaacctttatctccatacgtccatactataaaaaggacaaagattggaaaataataaatacctttttaaataaaggaacaaccat

SEQ ID NO: 22708 - DNA, 189 bp, Piromyces finnis
  Endoglucanase_F_dom3
agaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcac

SEQ ID NO: 22709 - DNA, 189 bp, Piromyces finnis; identical to SEQ ID NO: 22708
  Endoglucanase_F_dom3

SEQ ID NO: 22710 - DNA, 192 bp, Piromyces finnis
  Endoglucanase_F_dom3
agaacaacgtcttgactacgaaaagttcggtggagaagtttacattccatctggctggactggtaagaatgctcaaggtgccaacattaagagtggtgttactttcattgatatccgtccaaagtacaagcaagatccagattgggctcaagttgaagaataccttaacggtggtaacccaccagaattcaa

SEQ ID NO: 22711 - DNA, 192 bp, Piromyces finnis; identical to SEQ ID NO: 22710
  Endoglucanase_F_dom3

SEQ ID NO: 22712 - DNA, 189 bp, Piromyces finnis; identical to SEQ ID NO: 22708
  Endoglucanase_F_dom3

SEQ ID NO: 22713 - DNA, 189 bp, Piromyces finnis; identical to SEQ ID NO: 22708
  Endoglucanase_F_dom3

SEQ ID NO: 22714 - DNA, 189 bp, Piromyces finnis
  Endoglucanase_F_dom3
agctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaa

SEQ ID NO: 22715 - DNA, 189 bp, Piromyces finnis; identical to SEQ ID NO: 22714
  Endoglucanase_F_dom3

SEQ ID NO: 22716 - DNA, 189 bp, Piromyces finnis; identical to SEQ ID NO: 22714
  Endoglucanase_F_dom3

SEQ ID NO: 22717 - DNA, 189 bp, Piromyces finnis; identical to SEQ ID NO: 22714
  Endoglucanase_F_dom3

SEQ ID NO: 22718 - DNA, 5523 bp, Anaeromyces robustus
  ENTEROBACTIN SYNTHASE COMPONENT F
tgatgatttatgttatgtatttttcacttctggtactacaggtaagccaaaaggaactatgatgactcataataatatgacaaacttttgtttatatagtcaacattttaatggcaatgaaaatatttatgattacggatttgaaaatgctttagcattctcaaaatttacttttgatatgtcattaattgaaatttattatcctttatataaaagatgtagagtagtactttgtaatgatgaagaatttaataattcagaaatgcttagtgatttaattattaaatataatgtaaattatatttgtagcgtgcaatctcgaataaagaactatatcaaggatgaaggatttaaaaaggcattaaaaaatgttaaatggattggtttagggggagaaaaattaaattctgacattattcaagatattaagaactgtagtaaagcgacattaataaattattatggaccaactgaaactacagtatgttgtacacttaaaaagtttgagaataatgaattaaataattttgaaaataataatacttccataaccatcggtaaaccactatgtaattgtaagatatatatattagacaaatatttaaaaccagttccgattggagttgaaggtgaaattttcattggaggaaactgtgttggtaaaggttatttgaaccgtgaagatttaaccaaggaaaaatttgttaattgtccatactacaactctattaatggatcatcaaataaaatgtatcgcacaggagatttaggtaaatggacaaaagaaggtgaaattatttgtttaggaagagctgatttccaagtaaaaattaatggacaaagaattgaattaagtgaaatagaaaatacaatgaaagaaataaatggaattgattatgctatagttattgataataataaagaaaatggtaataaatacttaaccggttattatattagtaaaaataacattacaggtaaagatattagaaagagtttaaaattaaaacttccaagtttcatgattccaaattatttcattcgtatatataatttaccaattacatctagtggaaaattagataaaaaaagtttaccaattccaaatattaatgatttaattaatgaacaatatgttgctccagaaactgaaactgaaaaattaatatgtaatgtatatagtaaaacattaaatattgatgaaagtaaaattggaaaaatgagcgatttctttgaattaggaggtgatagtttaaacgctataagaattatatcaatgattgaaaaggaattgaatataaaactctatataaaagatatattatcgcatcctttagtaagtgaaattagcgaatatattgaagatatattaactaataataaaaattcatatcaaatggaagttataaagaaatataatagtaaagaattcccaataacttcacaacaattgggtgtttatattgactcaattaaaaatccagatagtattatgtataatattccaagtgtatttaaattgaaaaaagatattgatattaataaaattaaaatggcattaaataaaatatttaaatgtcaagaaatcttaagaagcaaatattatgaaaaggaagttaatggaaagacagaaatatttggatatattgatgatgaatgcttattattatttgaagaatatacttatgaaaatgcaaaatcatttattagaccatttaaattatcagaagctccattaataagaattggttttattaaaaatgaaatattgttaattgatatgcatcatatcatttctgatggttcttcaatgttaattattaaaaatgaattaaatagttatttctataataatgaaataattcaagaattagaaatccaatttagtgattatagtatatatatgaatgaaaagaaatcggaagaatattacgataaagaaatagaattttataaaaaaatgttttcatgtgaatatgaactattaagtattcctatgaaaggtaagatattagatgaaaataaaactattgaaagtagtagcaagaactgctataaaagtattgataaatctactacgagtttaataaatgaatatattaaaaagcatggaataagtaaagcagcattcttcattactatatatggatatgtcttatccaaatatagtggacaaaatatagtttatagttcaatagttaatgccaatagaaataatcattatacagaaaatatgattggtatgtttgttagtacccaaccaattttattgaaatatgacgatgaagaaagttcattacttgaaattataaagcaaaatatgaataatttaatggaaatgtataataatcaagatatttcattttcagaattattgaaattattgaagttaaagaaaataaacaactcatttgtttttcaaccaaaagtaatgtttaataataataattcagagaattcaatattttcggatgataataatgaaaatatgtttacattgtatgaaagttctaatgaattgcttaataaagagaattcaaaatttgatattacttttaatgttgttgaaaacgaagaaaactatttaatttcaatcatctataatgaccatctttatgaatcaaaaattattaataatataattgatagttacctggaagtagccaaaaatattaatgaatataataataatattcataatattgaatatattccaaaaattgaaaaagaaagaataattgaaacattcaataataatgaatacaattatgatagaaataaattctatcatgaagaatttagtaaagtagctaaagaaatacctaacaaatgtgctattgtatgtaacaataatgaaattacatttaagaaattagacgaaatgagtaattctttagcacattatttaagaaaagaaaatattggtagaggagatattgttccaatcattagtgaacgttctcattactttgtaattgctacattagctataatgaaatctggtgcagcatttttaccaatagatccagacttcccaaaagaacgtattgaatatatgattaatgaagttaacgctaaatttattctaaaatatattacaaatattgaaacagaacgtaaaattaaatttgacaatgttattgaatatgaattacaaaaacataattataaagataatgttttcgaaattactaatattaataacagtgatgatttatgttatgtattatttacttctggtactacaggtaaaccaaaaggaactatgatgacacataacaatttaattaattattctctttacagtcaaacatataatggaaaagaaatatatacaaatgattttaataatgctttatctgcagctaaatttacttttgatatgtcactttgtgaaatattatatcctttaattaaaggaaaatgtgtattcatatgtgacgataatgaatataataatcctcaattaataggagaaaaaatattaaaatataatatagattatatatttagtacaccttcaagaattgaaaactatatgaaaaataaaacatacatgaaagctttaaagaatttaaagtgcattttaattggtggagagggttgtaatattaaaacagttgaaaatataattaaaaatacaaatgcaaatatatataatctttatggtccaactgaaacaaccattatgtgtactgtatcagaactctcaaatttgtataaacaaaacaaattaaatgttattactattggtaagccattatgtaattgtaaattgtacatcttagatgaatatttaaaaccagttccgattggagttgaaggtgaaatatatattggaggatatggtgttggtaaaggatatcttaatcgtgaacaattaactagagaaaaattcgttgattgtccatttaatatcaaaaatggtttaccaaatcaaatgtatagtactggtgatttaggaaaatggacagaaaaaggtgaaataatttgttctggacgtgctgatttccaagtaaaaattcgtggtcaaagaatagaattaacagaaatagaaaatactattaaaaaaattaaaggaattaaatattcaattgtaattgataagataaaggaaaacaatgataagtatttaatgtgttattatattacagatgaaaacattaatagtggagatataagaaattatttaaaaaataaacttccaatatatatgattcctagttacttcaaaaaaattgataatataccagttacttctaatggtaaactaaatagaaaagctttacctgaaccaaatatagatgatttaataaaagaaaattacattgcaccaatatccaaagttgaaaagattatttgcaaaatttattcgaatgtatttaatattaacgaaaatagtgttggattaatgaatgaattttatgaacttggaggtgacagtttaattgttattagtattttatcattaattgaaaaagaattaaagataaaattaaatgttaaagatattctttcacatcctttaattaaagatttatgtgattatatagaaactattttaagtaataatgaaaattcttatgaaattaaaagtattaagaaacactctgctaaagaattcccagtaactactcaacaattaggtgtttatgttgatactattaaaaacccagatgctatagtatataatacaccattaatatttaaattaactaaaaatattgatattaataaaattaaagaagcttttaataaattatttaaaaatcaagaaatattaagaagtaaatattatgaaaaggaaattaatggaaaaacggaaatttatggatttattgatgatgagtgtttattacttttcgaagaatatacatatgaaaatgctaaaacatttgttcgaccatttgaattatccaaagcaccattaataagagttggttttattaaaaatgaaatattattaattgatatgcatcatattatttccgatggatccactatgcttataattaagaaggaattaaataattattataataataatgaaataaaagaattggaaattcaatttagtgattatgctattgatttaaatgaaaataaaaataatgaatattacaataaacaaattgaattttataaagaaatgttttcatgtgaatatgaaaaattaaatattccaataagaaataacaatttactttcacctgaagaaagaaataaaaatgacatgaaatgtaatatttgtgtcaatattatagatgaatttacgagtgaaaaaattaatgaatatgttaaaaataataaaattagtaaaacagcgtttttccttagtatatatggatatattttatcaaaatacagtagacaagatataatctatagttcagttatgagtactaatcgtaataataattatattcaagacatgattggaatgtttgttagtacacaaccaatattacttaaatattctaacaaagaaatgaactcatttacagatatcataaaacaaataat

SEQ ID NO: 22719 - DNA, 453 bp, Neocallimastix californiae
  Esterase
tgaaaatactaaatccaatcgtccaatgaatattcttcttccaccaaactataatccggaaaagaaatacccaattttatatcttttacatggtattttatctgaccagaattcattaattaaatcaaaatatggtacaccaaacatagctggttatttaatgaataaaggtatggctaaagaaatgattattgcttatccatatacttatgctccaaaagacggtattgaagttgaaccaggatttactaaggaacatgccgccggttatgataattttattaatgaattactctttaatattatgccatatatggaaaagaattatccaattcttactggcagagataatacagctattgctggtttttcaatgggtggtcgtaacagtctttatattggttattctaagccagaattatttggttatattggtgccttctcaccagctcc

SEQ ID NO: 22720 - DNA, 534 bp, Neocallimastix californiae
  Esterase
cacaactactcaaagtgaacgtccattagttgttgttcttccaccaaattacaatgaaaagaagaagtacccagtcgtttacatattacacggtattatgactgatggtagtttcatgttacaagaaggtttcggtactgttactatcccaggaaatttattccataagcacatggctaaggaatttattatggttcttcctaatcaatacgctccagctccaggaaccgaagttgaacctaatttaaatgaagaatattttgctggttacaataacttcattaatgatttagttaatgatatcatgccatacatgaaaaaacattattctattgctactggtaagaaaaacacggccatatgtggttactcgtttggtggaagaaatagtttatacattggtttaaagagaccagatttatttggttacgtcggttccttctctccagctccaggtattcttccaggggatgatgtctttactggtcatcataatggtttatttaaagaagaaaaggatgtagtttttgcagg

SEQ ID NO: 22721 - DNA, 516 bp, Neocallimastix californiae
  Esterase
gacaactactaaaagtgaacgtccattacacgttcttcttccaccaagttatgatggaaagaaaaagttccctgttgtttacttattacacggtgttatgactaatggtgaatttatgttacaagaaggtttcggtacaattgcaattccaggaaatttgttccataaacacatggctaaggaatttattatggttcttccagatcaatatgctccagctccaggaaccgaagttgaaccaaatttaaatgaagagtactttgctggttacaataatttcattaatgatttagttaatgatatcatgccatacatgaaaaagaattatagaatatttactggtaagaaaaacactgccatctgtggttactccttcggtggaagaaacagtttatatattggtttaatgagaccagatttatttggtttcgttggcgctttctctccagctccaggtattcttccagctgaagatatgttcactcatcataatggtttattcaaggaagaaaaaga

SEQ ID NO: 22722 - DNA, 456 bp, Neocallimastix californiae
  Esterase
ctctaatactaaaaccgaccgtccaatgaatattcttcttccaccaaattatgatccagagaataaaaaatatccagttttatatcttttacatggtattttatctgatcaaaattctttaattaaaccaaaatatagtacaccaaatattgctggttatttaatgcatgaaggtcttgctaaggaaatgatcatcgtctttccttacacttatgctccaaaggatggtattgaagttgaaccaggatttactgaagaacactatgcaggttataataatttcattaatgaattacttgatgttattatgccatacatgaacgaaaactatccaattcttactggtagagataatactgcaattgctggtttctctatgggtggtcgtaacagtctttacattggttacactaagccagagttattcggttacattggtgctttctctccagcacc

SEQ ID NO: 22723 - DNA, 405 bp, Neocallimastix californiae
  Esterase
ttgggtttacttaccagcaggttatgatccagaagataaggacactaaatatccattatttatcttaatgcacggttttggtcaaactgaagataattggggtcttaccgaccaaggttctggtggtaagattaagggtatgatggatagaggtatggctaaaccaaaggatgaagaaggttctgttgaaaagttcattcttgttgttccaactggtatggccactagaaattacagagaaaatggtaactatgattacactgaaccatactatagatttggtggtgaacttagaaacgatcttattccatatatgaaaaagaattataacattaaagaaggtcgtgaaaatatggccatggctggtctttccatgggtggattccaaacattatatattggtat

SEQ ID NO: 22724 - DNA, 600 bp, Neocallimastix californiae
  Esterase
taatggttctaattcattaaatgtttacttaccatatggttacaatagtaatcaacaatacaatattttctatcttatgcatggtggtggtgaaaatgaaaacactatttttggtagtgacgtttatcttcaatacattattgatcatttaattatgaacggtgaacttgaaccattgattattgttactccaaccttcaataaatgtgaagctcaaaccttctacaaagaattccgtagttccgttattccattcgttgaaggtaaatactcaacatatgccaaatctacctctgaaagcgatattagagcctctagaatgcacagagcttatggtggtttctctatgggttctgtctctacttgggccgttctcattaattgcttagatattgttggttacttcatgccacttagtggtgactgttgggaagctaatgatgcatatggtaaggctaaggccgttgctgatgctattaatagatcaggtttaagaagtaatgaatacttcattttctgtgccactggttctgatgatattgcctatccaaatgttactccacaaattgaacaaatgaagaaaatgtctcaatttattta

SEQ ID NO: 22725 - DNA, 447 bp, Neocallimastix californiae
  Esterase
caacactactggaacagatcgtcaaatgaatattattcttccagttgactatgatggaactaaaaaatatccagttgtatattatttacatggtatttttggtaatgaagactctatgttagatgaaactgctatcgctcttccagttaacttatataatgaaggaaaggctaaggaagcaatttttgttcttccaaatacttatgctccaccaccaggtaaggaagttgtaccagattttaatcaagattattttgatggttacgataacttcattaatgagttaattgatgatattatgccatacgttgaacaaaattattctgttcttactggtaaggaaaatactggtctttgtggtttctctatgggtggtcgtaatagtctttacattggatacaagagaccagatttattcggttatgttggagccttttcaccagctcc

SEQ ID NO: 22726 - DNA, 453 bp, Neocallimastix californiae
  Esterase
tactactactgagagtaaacgtccattaattgttgttcttccaccaaactattctaaatccaagaagtatccagttctttatttattacatggtattatgacagatggttccttcatgttacaagaaggtttcggtaccattactattcctggtaatttaattcatgaacacaaagctaaggaattaattatggttttaccaaaccaatatgccccagctcctggtactgaagttgaaccagccttaaatgaaaaatactttgcaggttacaataatttcataaatgatttaattaacgatattatgccatacatgaaaaaaaattactctattgctactggtaaggaaaacactgccattgctggttactccttcggtggaagaaacagtctttacattgctttacaaagaccagatttatttggttttgttggtgctttctctccagctcc

SEQ ID NO: 22727 - DNA, 450 bp, Neocallimastix californiae
  Esterase
tacagctcaaatggaccgtaaaatgaatgttatcttacctgcaggttacactgaagataagaagtaccctgttttatattatttacatggtctttctggtaatgaagattcattattagcaaaagaaagagccactattgaaatttatggtaatttagttagtgaaggtaaagctaaggaaatgattattgttcttccagattgttatgtcccattagatggtgttttcgatagaccacaattttcaccagaatatttgaaggcttatgataacttcctctatgaattaattgatgatgttatgccatatattgaatctcattattctgttgctctcggaagagaaaatactgctcttgctggtttctctcaaggtggccgtaacactatctatattggttacaaacatccagaattattcggataccttggtgctttttcacctgctca

SEQ ID NO: 22728 - DNA, 465 bp, Neocallimastix californiae
  Esterase
taacactactcacactgaacgtcaaatgaatatcattttacctccagattattctaaagaaaaaaaataccctgttttatattatttacatgatttattaagtgatgaaaatggattattagaaaaaagtattggtactcttgaaatttatagtaatttagttaatttaggtaaggctaaggatatgattattgttcttccaaattgtattgttccagcagatggtgctaaaatagaaccaggaaattcagaagaatataatgctgcatatgataactttattaatgaattgcttcaagatgtaatgccattcatagaatcaaattattctgtagattctggtagagaaaataccgcaattgctggttttggtcaaggtggtcgtagttctctttacattggttacaaacatccagaattatttggataccttggtgctttctcacctactcaaggtcttttacc

SEQ ID NO: 22729 - DNA, 408 bp, Neocallimastix californiae
  Esterase
ttgggtttacttaccagctggttatgatccagaagataagaacactaaatatccattagttattttaatgcacggtttcggtcaaaatgaagataactggggtcttaccgatcaaggtactggtggtaaaattaagggaatgatggatagaggcatggctaaagctaaggatgaagaaggttccgttgaaaagtttgtacttattgttccaactggtatggcctctaaggacttcagagataataacaactacggtaacactgaaccatggtacaagtttggaaatgaaattagaaacgatattattccatatatgagaagtcattacaatattaaggagggtcgtgaaaatgtagccatggctggtctttctatgggtggtatgcaaaccttaaaccttggtattgg

SEQ ID NO: 22730 - DNA, 660 bp, Neocallimastix californiae
  Esterase
taacactttaaatgtttacttaccatatggttatgataagaataagcaatataatattttctatcttatgcatggtggtggtgaaaatgaaaatactatttttagtaatgatgttaatctacataatattcttgataatatgattatgaagggagagcttgaaccacttattgttgtcactccaaatttcaataaatgtgatgctcgtactttctataaggaattacgtgaaagtgttattccatttgttgaaggtaaatattctacttatgctaaatctacttccccagctgacattaaagcttctagaatgcacagagcctttggtggtttctctatgggttcagcatctacttgggctgttttaattaattgtttagatattgttgcctactacatgccacttagtggtgataactgggaagctaatggtggatacgctaaagctaaatctgttgctgacgctattgacaagtctggattacaaaagaatcaatactttatcttctgtgctactggttctgaagatattgcttacaacaacatgaacccacaaattgatgaaatgaagaagatgagtcaatttgtatacacttctgacttttccaagggtaacttctattatcttgttgctcaaggaaagactcactggtggggtta

SEQ ID NO: 22731 - DNA, 468 bp, Neocallimastix californiae
  Esterase
taatataactaagggttatcgaaaattaaatgttgttcttccaccaaactattccacagaaaagaagtatccagttttatatttacttcatggcatatatggagatgaagactctatgctcaacaatggtatgggtacacttaatgttccagctaatcttgcaaaggaaaataaagcaaaagaaatgattattgtacttcctaatgaagttgccttattaccaggaaccgatccaaacattacaaaaaatttttctttggagcatcttaaagtttatgataattttattaatgaattacttaataatattatgccatttatagaatatgaatattccgttgctaccggtagagacaatactgctattgccggtttctctatgggtggtcgtactgctctttacattggatacacaagaccagatttatttggttatgtcgccggtttttcaccagcatggggtcttac

SEQ ID NO: 22732 - DNA, 405 bp, Anaeromyces robustus
  Esterase
taaacacggatgggtttatcttccagctggttatgatgctgatgacaagaatactcaatatccattatttgttttacttcacggttttggacaaaatgaaaacacttggggtctttctaacaaaggacgtggtggtaaaattaagggtttcatggatagaggtatggctagtggtgatgttggtagatttattcttgtttgtgtaactggtgttgctagtagaaattggggtccaaatggtgctggtaatgatgttaatggtttcaatgcttttaaaggtgaacttagagatgatattattccatatatgagatctaaattcaatattaagagtggtcgtgataatgttgctcttgctggtctttctatgggtggtggtcaaactttcaatattggtattgctga

SEQ ID NO: 22733 - DNA, 453 bp, Anaeromyces robustus
  Esterase
aaaaactactaataatgatcgtaaaatgaatgttattctaccaattggatatactgaaagtaagaaatatccagttttatatttattacatggtattatgggtaatgaagattctatgttaagtacaaatatgggtagtattactattccaaccaatttattaagagaaggtaaagctaaagaaatgattattgttcttccaaatgaatatgctccagaaggtggtaaggaagttcctgctggtattaatcaagcttactttgaaggttatgataatttcattaatgatttaattggtagtattatgccatatatggaaaaaaattattctgttgctactggtagagaaaatactgctattgctggtttttctatgggaggtcgtaatagtctttatattggttataaaagatctgatttatttggttatattggagctttttcaccagctcc

SEQ ID NO: 22734 - DNA, 450 bp, Anaeromyces robustus
  Esterase
aaaagttactgaatctgaacgtaaaatgaatgttattcttccagttggatatgatgaaaataaaaaatacccagtagtatacttcttacatggtcttatgtcagatgaagatggtatgcttggcgatgaatctactattgctattccaactaatttaattaaagaaggtaaagctaaagaaatgattatggttcttccagatatttatgctccagtaccaggtacagctgttgagccaaattatgatccagaatattataaaggttatgataatttcattaatgaattaactgaagttattatgccatacatggaagaacattatccaattcttactggtagagaaaatacagctatttgtggtttctctatgggagctcgtactagtctttacattggatacatgaaatcagatttgattggttacactggtgcatttgcaccagctcc

SEQ ID NO: 22735 - DNA, 333 bp, Anaeromyces robustus
  Esterase
aaaagttactgaatctgaacgtaaaatgaatgttattcttccagttggatatgatgaaaataaaaaatacccagtagtatacttcttacatggtcttatgtcagatgaagatggtatgcttggtgatgaatctactattgctattccaactaatttaattaaagaaggtaaagctaaagaaatgattatggttcttccagatatttatgctccagtaccaggtacagctgttgaaccaaattatgatccagaatattataaaggttatgataatttcattaatgaattaactgaagttattatgccatacatggaagaacattatccaattct

SEQ ID NO: 22736 - DNA, 456 bp, Anaeromyces robustus
  Esterase
tgaaaatactaaaagtgatagaccaatgaatattcttcttccaccaaattatgacccagacaataaaaaatatccagttttatatcttttacatggtattctctcagatcaaaattctttaattaaaccaaaatatagtacaccaaatattgctggttatttaatgaatgaaggtttagctaaagaaatgattattgtatatccatatacttatgctccaaaagatggtattgaagttgaaccaggattttctgaagaacatgctgctggttataataatttcattaatgaattactttacaatattatgccatatatggaaaaaaattatccaattcttactggtagagataatactgctattgctggtttttcaatgggtggtcgtaatagtttttatattggtttaaataaaccagaattatttggttatattggtgctttctctcctgctcc

SEQ ID NO: 22737 - DNA, 447 bp, Anaeromyces robustus
  Esterase
ttcaaatactaatagtgaacgtaaaatgaatattattcttccagttggttatgatgaatctaagaaatacccaattgtttatttcttacacggtatttttggtgatgaagattctatgctcgatgaaagtactattgctattccaactaatttacttaaagaaggtaaagctaaagaatttattatggttcttccaagtgaatatgctccaactccaggtaatgaagttgaaccaggtttctctcaaaaatactttgatggttatgataacttcattaatgaattagttgatgttattatgccatatatggaacaaaattatccaattcttactggtaaggataacactgctctttgtggtttctctatgggtggtcgtaacagtctttacattgcttacaagagatcagatttattcggttatgttggtgctttctctccagctcc

SEQ ID NO: 22738 - DNA, 453 bp, Anaeromyces robustus
  Esterase
tactactactgaatctgaacgtccattaatcgttcttcttccaccaaattatactgaaactaagaaatatccagttctttatttattacatggtattatgggtactggtatgtttatgttacaagaaggttttggtactgttgctattccaggtaatttatatgctaaaaatatggctaaagaaatgattattgttcttccagatcaatatgctccagctccaggtactgaagttgaaccagatttaaatgaagaatattttgctggttataataattttattaatgatttaattaatgatattatgccattcttagaaaagaattattctattgctactggtagagaaaatactgctctttgtggttattcctttggtggtcgtaatagtctttacattggtttaaaaagaccagatttattcggttatattggtgctttctctccagctcc

SEQ ID NO: 22739 - DNA, 453 bp, Piromyces finnis
  Esterase
aaaaattacacaatcctatcgtccattaaatgttattcttccagtaggatatactgaaagtaaacaatatccagttttatacttattacacggtattatgtgtaatgaagattctatgttagaagctgaaatgggtagtcttactattccaacaaacttattcaatgatggtagagctaaagaaatgattattgttcttccatatgaatatgctccagaagctggtaaggaagttgaagccgcttttaatcaagcctactttgatggttatgataactttatcaatgaattaactgatgtcattatgccatacgtaaaggctaattactctattaaaactggtagagaaaatactgctatttgtggtttctctatgggtggtcgtaacagtctttacattggttttaagagatctgacttatttggttatgttggtgctttctctccagctcc

SEQ ID NO: 22740 - DNA, 447 bp, Piromyces finnis
  Esterase
atcccaacgcccattaaatgttattttaccaccaaattattcaaccgataaaaaatatccagtactttacttacttcatggtgtagctgctaatgaagatatcatggtagaagaatataatggtgctttaaatattccacctaaccttgctaaacaaggtaaggctaaggaaatgattattgtttctccacgtgttaatatttatccaccaggtgttgatgaagttgaattcgctttttccacagaatatctttctggttttgataattttattaatgatttaatagatagtattatgccattcattgaaactcattattcagttcttacaggtagaaacaatacagctattgctggcttttctatgggtggtcgtacagcactttatattggttatagtaaacctgaattatttggttatgtttgtggtctttcacccgcttttgg

SEQ ID NO: 22741 - DNA, 453 bp, Piromyces finnis
  Esterase
cactacaaccgaaactaaccgtactttaactgttcttgttccaccaaattattctccaaagaaaaagtacccagttctctatttgttacatggtattatgactgatggagcttggatgattcaagatggatttggtactattgccattccaggaaatttagctcatcaaaaaaaagctaaagaaatgttcattgttcttccagatcaatatgctccatcaccaggtaccgaagttgaaccagccttaaatcaagaattctttaatggttatgataactttattaatgatttagtcaatgatattatgccatttatgaaaaaacaatattctattaaaactgatagaaaaaatactgctatttctggttattcctttggtggacgtaacagtctttacattggtatcactagatctgatttatttggttatgttggttctttttcaccagctcc

SEQ ID NO: 22742 - DNA, 189 bp, Piromyces finnis
  Esterase
atcccaacgcccattaaatgttattttaccaccaaattattcaaccgataaaaaatatccagtactttacttacttcatggtgtagctgctaatgaagatatcatggtagaagaatataatggtgctttaaatattccacctaaccttgctaaacaaggtaaggctaaggaaatgattattgtttctcc

SEQ ID NO: 22743 - DNA, 330 bp, Neocallimastix californiae
  Expansin_CBD
tccagttaaaggtaatatctatattagaattcttccaggtgctaaccaatggtatttcgctattaatgtagttaatgttgccaatatgggttctcttgtagctgttgaagtattaagaaatggtaagtgggctccattagttcgtgatccaaattactcttctactagaccacaagaacgttacggttcatgggttgtcccaccattaaaggaaggtgaacaaagtgaaccattcactactccattaactttacgtttcactgattctgctttcaatactcttactgctccagatgctattaaggaatggccaacttccgatgattactt

SEQ ID NO: 22744 - DNA, 300 bp, Neocallimastix californiae
  Expansin_CBD
tccagttaagggtaacattcatgtctggttacgtccaggtgctggtccatggtactttgctcttaccgttgtcaatgtagctaatatgggttctcttgtcgctgttgaagtccaacaagctgatggtatctgggtaccattagttcgtgatccaaactattcatctactagaccacaagaacgttatggttcctggactgtcaaacaaggtactggtccattctctgttccaatgaatatgcgtttcacagatagtgccttcaacactcttactgctgaaggtgctattaaggattgggg

SEQ ID NO: 22745 - DNA, 240 bp, Neocallimastix californiae
  EXPANSIN_CBD
gtactttgctcttaccgttgtcaatgtagctaatatgggttctcttgtcgctgttgaagtccaacaagctgatggtatctgggtaccattagttcgtgatccaaactattcatctactagaccacaagaacgttatggttcctggactgtcaaacaaggtactggtccattctctgttccaatgaatatgcgtttcacagatagtgccttcaacactcttactgctgaaggtgctattaa

SEQ ID NO: 22746 - DNA, 300 bp, Neocallimastix californiae
  Expansin_CBD
tccatgtccaagattaggtaacatgtacatttggcttcgtaaagatgctggtccatactggttcgctttctctgttgttaactctgctggtttcggagctattgctgttcttgaagctaagaatgatgaaggtaaatgggttaagatgattcgtgatccaaactacactatgtctcgtccacaagaacgttatggtgtttgggttactccacaagatactggaccatacaaccttccagttgatattcgtttaactgatggttctggtgttactattgttgctgaaaaggctattaagtc

SEQ ID NO: 22747 - DNA, 276 bp, Neocallimastix californiae
  EXPANSIN_CBD
ctggttcgctttctctgttgttaactctgctggtttcggagctattgctgttcttgaagctaagaatgatgaaggtaaatgggttaagatgattcgtgatccaaactacactatgtctcgtccacaagaacgttatggtgtttgggttactccacaagatactggaccatacaaccttccagttgatattcgtttaactgatggttctggtgttactattgttgctgaaaaggctattaagtcctttactccaccagccgatgctattaaggacta

SEQ ID NO: 22748 - DNA, 300 bp, Neocallimastix californiae
  Expansin_CBD
tccatgtccaaagttaggtaatatgtacatctggcttcgtgaagatgctggtccatactggttcgccttctctgtcgttaactccgctggtttcggtgctattgctgttcttgaagctaagaatgatgaaggtaaatgggttaagatgattcgtgatccaaactacactatgtctcgtccacaagaacgttacggtgtctgggttactccacaagatactggaccatacaaccttccaatcgatattcgtttaactgatggttctggtgtaactgttgttgctgaagaagctattaaatc

SEQ ID NO: 22749 - DNA, 276 bp, Neocallimastix californiae
  EXPANSIN_CBD
ctggttcgccttctctgtcgttaactccgctggtttcggtgctattgctgttcttgaagctaagaatgatgaaggtaaatgggttaagatgattcgtgatccaaactacactatgtctcgtccacaagaacgttacggtgtctgggttactccacaagatactggaccatacaaccttccaatcgatattcgtttaactgatggttctggtgtaactgttgttgctgaagaagctattaaatctttcgatccaccagctgatgctattaaaggtta

SEQ ID NO: 22750 - DNA, 300 bp, Neocallimastix californiae
  Expansin_CBD
tccagtgaagggtaacattcacgtttggttacgtccaggtgccggtccatggtactttgctcttactgttgtcaatgttgctaacatgggttctcttgttgccgttgaagtccaacaagctgatggtgtttgggtaccattagttcgtgatccaaattactcttctactagaccacaagaacgttatggttcatggactgtcaaacaaggtactggaccatttactgttccaatgaacatgcgttttactgatagtgctttcaacactcttactgctgaaggtgccattaaagactgggg

SEQ ID NO: 22751 - DNA, 240 bp, Neocallimastix californiae
  EXPANSIN_CBD
gtactttgctcttactgttgtcaatgttgctaacatgggttctcttgttgccgttgaagtccaacaagctgatggtgtttgggtaccattagttcgtgatccaaattactcttctactagaccacaagaacgttatggttcatggactgtcaaacaaggtactggaccatttactgttccaatgaacatgcgttttactgatagtgctttcaacactcttactgctgaaggtgccattaa

SEQ ID NO: 22752 - DNA, 300 bp, Neocallimastix californiae
  Expansin_CBD
accatgtcccagattaggtaacatgtacatctggcttcgtgaagatgccggtccatactggtttgctttctctgtggtgaatagtgcaggttttggtgctattgctgttcttgaagccaagaatgatgaaggtaaatgggttaaaatgatacgtgatccaaattacaccatgtcacgtccacaagaacgttatggtgtctgggttactccacaagataccggaccctacaatcttccaattgatattcgtttaaccgatggttccggagtaactattgtagccgaaaaagccattaaatc

SEQ ID NO: 22753 - DNA, 276 bp, Neocallimastix californiae
  EXPANSIN_CBD
ctggtttgctttctctgtggtgaatagtgcaggttttggtgctattgctgttcttgaagccaagaatgatgaaggtaaatgggttaaaatgatacgtgatccaaattacaccatgtcacgtccacaagaacgttatggtgtctgggttactccacaagataccggaccctacaatcttccaattgatattcgtttaaccgatggttccggagtaactattgtagccgaaaaagccattaaatcctttgatccacctgccgatgccattaaaggata

SEQ ID NO: 22754 - DNA, 300 bp, Neocallimastix californiae
  Expansin_CBD
accatgcccaagattaggtaatatgtacatttggcttcgtcaaaatgcctcaccttactggttctcctttactgtagttaattctgctggttttggtggtattgctattcttgaagccaaaaatgatgaaggaaaatgggtaaagttaattcgtgatccaaattacacgatggcacgtccacaagaacgtttcggtacatgggccactccacaagattctggaccatacaatcttccaattgatattcgtttaaccgatggttctggtattacaattgtagcagaagaagccattaaatc

SEQ ID NO: 22755 - DNA, 276 bp, Neocallimastix californiae
  EXPANSIN_CBD
ctggttctcctttactgtagttaattctgctggttttggtggtattgctattcttgaagccaaaaatgatgaaggaaaatgggtaaagttaattcgtgatccaaattacacgatggcacgtccacaagaacgtttcggtacatgggccactccacaagattctggaccatacaatcttccaattgatattcgtttaaccgatggttctggtattacaattgtagcagaagaagccattaaatctttcactccacctgctgatgctcttagagatta

SEQ ID NO: 22756 - DNA, 249 bp, Neocallimastix californiae
  Expansin_CBD
tattaaattccaatttaaatctggtagtacccaattctggggtgaagttcaagttttcaatactcgttacccagtcgctaaagttgaatttttaagtggcggtaagtatgttggcttatacagacgtgcttataattactgggctcttaattctggtggttttggtgcgggtccatacactttccgtgttaccttagctgatagtacagttattgaagctaaaaatgttaaaatggttattccaggtaa

SEQ ID NO: 22757 - DNA, 324 bp, Neocallimastix californiae
  Expansin_CBD
tccagttaaaggtaacatttatattagaattcttccaggtgctaaccaatggtatttcgctatcaatgttgttaacgttgccaatatgggttctcttgttgccgttgaagttttaagaaatggtaaatgggctccattagctcgtgatccaaattattcttctactagaccacaagaacgttatggttcatgggttgttccaccattaaagaagggtgaacaaagtgaaccatttgaaactccattaactttacgtttcactgattctgctttcaatactcttactgctccagatgctattaaggaatggccagaaactgatga

SEQ ID NO: 22758 - DNA, 282 bp, Neocallimastix californiae
  Expansin_CBD
tccagtcaagggtaacattcacgtttggttacgtccaggtgctggtccatggtactttgcccttaccgttgttaatgttgccaatatgggttctcttgtcgctgttgaagtacaacaagaagatggtgtttgggtaccattagttcgtgatccaaattactcttctactagaccacaagaacgttatggttcatggactgtcaaacaaggtactggtccattcactgttccaatgaacatgcgtttcactgatagtgctttcaacactcttactgccaatgg

SEQ ID NO: 22759 - DNA, 232 bp, Neocallimastix californiae
  EXPANSIN_CBD
gtactttgcccttaccgttgttaatgttgccaatatgggttctcttgtcgctgttgaagtacaacaagaagatggtgtttgggtaccattagttcgtgatccaaattactcttctactagaccacaagaacgttatggttcatggactgtcaaacaaggtactggtccattcactgttccaatgaacatgcgtttcactgatagtgctttcaacactcttactgccaatggt

SEQ ID NO: 22760 - DNA, 324 bp, Anaeromyces robustus; identical to SEQ ID NO: 22757
  Expansin_CBD

SEQ ID NO: 22761 - DNA, 300 bp, Anaeromyces robustus
  Expansin_CBD
tccagtcaagggtaacattcacgtttggttacgtccaggtgctggtccatggtactttgcccttaccgttgttaatgttgccaatatgggttctcttgtcgctgttgaagtacaacaagaagatggtgtttgggtaccattagttcgtgatccaaattactcttctactagaccacaagaacgttatggttcatggactgtcaaacaaggtactggtccattcactgttccaatgaacatgcgtttcactgatagtgctttcaacactcttactgccaatggtgctattaaagattgggg

SEQ ID NO: 22762 - DNA, 240 bp, Anaeromyces robustus
  EXPANSIN_CBD
gtactttgcccttaccgttgttaatgttgccaatatgggttctcttgtcgctgttgaagtacaacaagaagatggtgtttgggtaccattagttcgtgatccaaattactcttctactagaccacaagaacgttatggttcatggactgtcaaacaaggtactggtccattcactgttccaatgaacatgcgtttcactgatagtgctttcaacactcttactgccaatggtgctattaa

SEQ ID NO: 22763 - DNA, 300 bp, Anaeromyces robustus
  Expansin_CBD
tccatgtccaagattaggtaatatgtacatttggcttcgtaaggatgccggtccatactggttctcattctctgttgttaactctgctggttatggtgctattgctgttcttgaagctaaggatgatgaaggtaattggattaagatgcaacgtgatccaaattacactatggctcgtccacaagaacgttatggtgtttgggctactccacaaggtgctggtccattcaatcttccagtcgatattcgtttaactgatggttctggtgtagttgttgttgctgaaaaggctattaaatc

SEQ ID NO: 22764 - DNA, 276 bp, Anaeromyces robustus
  EXPANSIN_CBD
ctggttctcattctctgttgttaactctgctggttatggtgctattgctgttcttgaagctaaggatgatgaaggtaattggattaagatgcaacgtgatccaaattacactatggctcgtccacaagaacgttatggtgtttgggctactccacaaggtgctggtccattcaatcttccagtcgatattcgtttaactgatggttctggtgtagttgttgttgctgaaaaggctattaaatcattcactccaccagctgattctattgaaggata

SEQ ID NO: 22765 - DNA, 258 bp, Anaeromyces robustus
  Expansin_CBD
ttcaccaattaaattccaatttaaatctggtagtactcaattctggggtgaagtagaagtctttaatactcgttatccagttgctaaagttgaattcttatctaatggtaaatatgaaagtttatacagacgtgcctataattattgggctcttaactctggtggttttggtgctggtccatatactttccgtgttactttagctgatgatactgttattgaagctaaaggagttgaaatggttattccaggtaatga

SEQ ID NO: 22766 - DNA, 291 bp, Piromyces finnis
  Expansin_CBD
tccagtcaagggtaacattcacgtctggttacgtccaggtgccggtcaatggtactttgctcttaccgttgtcaatgttgctaacatgggttctcttgttgccgtagaagtccaacaatctgatggtcaatgggttccattagttcgtgatccaaactactctactactagaccacaagaacgttacggttcatggactgtcaagcaaggtactggtccattcaccactccaatgaacatgcgtttcactgattctgctttcaacactcttactgctgaaggtgctatcca

SEQ ID NO: 22767 - DNA, 240 bp, Piromyces finnis
  EXPANSIN_CBD
gtactttgctcttaccgttgtcaatgttgctaacatgggttctcttgttgccgtagaagtccaacaatctgatggtcaatgggttccattagttcgtgatccaaactactctactactagaccacaagaacgttacggttcatggactgtcaagcaaggtactggtccattcaccactccaatgaacatgcgtttcactgattctgctttcaacactcttactgctgaaggtgctatcca

SEQ ID NO: 22768 - DNA, 288 bp, Piromyces finnis
  Expansin_CBD
tccattaaagttccaatttaaatctggttctacacaattctggggtgaagttgaagtatttaacactcgttacccagttgcaaaggttgaacttttattaaatggtaaatatcaaagtttatacagacgtgcttataattactgggctcttagttctggtggttttggtgcaggtccatacaccttccgtgttacattagccgataacactgtcattcaagcaacaaatgttgaaatggttattccagcaaatgatgaaggtgattcttactcatctggtactcaaac

SEQ ID NO: 22769 - DNA, 546 bp, Neocallimastix californiae
  EXPANSIN_EG45
tggtgcttgtgcttttggtgtttacggtttatgtagtttcaaatccaatgtcactatggaatctccaatttgtcaaacattctgtaagaactacccagatctttgtgaagatccagttgatactaagctttctcttagaggtaatttcattgctccaaatggtaactactacactcaattctggccatctctccaaggtgattatgataactatctttcttgtggtgaatgttatgaattagaaattactcaagaagatggttctctttatccagaagataatagacgttctgaaaacattattgctcaaattgttgattcctgtccatgttccgctaatgctaagtggtgttgtggttcaggtattgatcactgtaatgaaattgactttaagtatggttgtccaattccagaaggtagtgtacactttgatttatctgatattgctatggctcgtttacaaactaatgatccaaatggtggtatggttgaaggtgttattccaattcgttacaagcgtgttccatgtccagttaaaggtaatat

SEQ ID NO: 22770 - DNA, 531 bp, Neocallimastix californiae
  EXPANSIN_EG45
tggtgcttgtggtttcggtttatacggtttatgtactactaaattcaacgaaactggtgaactttgtgttagattctgtgaacattacccagatctttgtaaggatccagatgatatcactttaagaggtaatttctgtgctccaaatggtaattactacactcaattctggtcttctcttccaggtgattatgataactatctttcttgtggtgaatgttatgaagttgaaagaactttaccagatggttcatcttacccagctggagaaggtactgatcatattcttttacaagttgttgattcctgtccatgtaccgctaatgctaagtggtgttgtggttccggagttgatcactgtaatgaaattgatttcaagtatggttgtccaattccagaaggtagctggcacgttgatttatccgatattgctatgtctcgtttacaaaccaatgatccatatggtgttatggttgatggtgttattcctattaagtatagacgtgttccatgtccagttaagggtaacat

SEQ ID NO: 22771 - DNA, 381 bp, Neocallimastix californiae
  EXPANSIN_EG45
tttagcttgtaattgtgttccaaatgcaatggttgttggaccaactgttgctttagctgaagttgcttatggtgcttttgatcattttggcagtggtccagcatgtggtttatgttatcgtttatcaccatacgctactgctgatggtactccactctctccaatcccagaaccaattgtcttcagggttactgatgaatgtccacatcaatctaacgctgaatggtgtccaggacccgaaggtggtaaaaatgctcatggttttgaagatcactttgatgttaacattgatagttggggtggtaaattaagagattggttccaaggtggtcacatgcaagctaaatatgaattagtttcatgtgaagaatggccaggttg

SEQ ID NO: 22772 - DNA, 423 bp, Neocallimastix californiae
  EXPANSIN_EG45
tggttcttgtaatgttagtgctatgggtaacgccgctggtccaactgctgccattagtggtttatcttatggatcatggagtggtttaggtggtggtcctgcttgtggtctttgttacgctctaactgtatatggtagttatgatggtcaagctgatccagctttattcccgaagtgttctattgttgttcgtattaccgatcaatgtccatacccagataataaggaatggtgtccaggtccagaacaaccagaatctgagggtttcttaaatccacgtggtatgagatatcactttgatgttaatatttctagtggtcaaggtgaagctcgtgaatggttcccacgtgatgcctctggaaaccttttaggtactggtaaggtttacttcgaaatggtttcatgtagagaatggagtggttg

SEQ ID NO: 22773 - DNA, 546 bp, Neocallimastix californiae
  EXPANSIN_EG45
tggtgcttgtggttttggtttatatcaagtttgtggttctgaccataactacactggtgaattccgtactctttgtgatgccttctgtaaggcttacccaacattatgtaaagatccagctggtcgtacttatcgtggtaactttgctgctccacaaggtaactactacactcaattctggggtgccttagaaggtgatcaagataactacttgtcttgtggtgaatgctttgaagtttacaagactaagccagatggttctgattacaaaccaggagaagatggttaccaaccaccagttcttctttctgttattgattcctgtccatgtaatgctaatggtaaatggtgttgtggttctgaatgggatcaatgtcaagaaattgacttcaagtatggttgtccagttccaaaggatagtattcaccttgatctttcagatattgctatggctcgtcttcaatctggttcttccaacggacatatggaagctggtgttattccaaacaaatacagaagagttccatgtccaagattaggtaacat

SEQ ID NO: 22774 - DNA, 423 bp, Neocallimastix californiae
  EXPANSIN_EG45
tggttcctgtaatgttagtgctatgggtaatgctgctggtccaactgctgctattagtggtttatcttatggttcatggagtggtttaggtggtggtccagcttgtggtctttgctacgccttaactgtttatggtagttatgatggtcaagctgatccagctttattcccaaaatgttcacttgttgttcgtgttactgatcaatgtccatatccagataataaggaatggtgtccaggtccagaacaaccagaatctgagggattcttaaatccacgtggtatgagataccacttcgatattaatatttctagtggtcaaggtgaagctcgtgaatggttcccacgtgatgcctctggtaaccttttaggtactggtaaggtttactttgaaatggtttcatgtagagaatggagtggttg

SEQ ID NO: 22775 - DNA, 546 bp, Neocallimastix californiae
  EXPANSIN_EG45
tggtgcttgtggttttggtttataccaagtttgtggttcagatcacaactacactggtgaatttgctaccctttgtgatgctttctgtaaagcttatccaactttatgtaaggatccagctgatcgtacctatcgtggtaactttgctgctccacaaggtaactactacactcaattctggggtgctttagaaggtgatcaagataactacttatcttgtggtgaatgttttgaagtttacaagactaagccagatggttctgactacaaaccaggagaagatggttaccaaccaccagttcttctttctgttattgattcctgtccatgtaatgctaatggtaaatggtgttgtggttccgaatgggatcaatgtcaagaaattgacttcaagtatggttgtccagttccaaaggacagtattcaccttgatctttctgatattgctatggctcgtcttcaatccggttcttccaacggtcatatggaagctggtgttattccaaacaaatacagaagagttccatgtccaaagttaggtaatat

SEQ ID NO: 22776 - DNA, 531 bp, Neocallimastix californiae
  EXPANSIN_EG45
tggtgcatgtggtttcggtttatacggtttatgtactactaaatttaatgaaactggtgaactttgtgttagattctgtgaacactacccagatctttgtaaggatccagatgatattactttaagaggtaacttctgtgctccaaacggtaactactacactcaattctggtcttctcttccaggtgactatgataactatctttcctgtggtgaatgttacgaagttgaaagaactttaccagatggttcttcttacccagctggtgaaggtactgatcatattattttacaagttgttgattcctgtccatgtactgctaatgctaagtggtgctgtggatccggtgttgatcactgtaacgaaattgatttcaagtatggttgtccaatcccagaaggtagttggcacgttgatttatcagatattgccatgtctcgtttacaaacaaatgatccatatggggttatggttgatggtgttattccaattaagtacaagcgtgtcccatgtccagtgaagggtaacat

SEQ ID NO: 22777 - DNA, 546 bp, Neocallimastix californiae
  EXPANSIN_EG45
tggtgcatgtggttttggtttataccaagtttgtggttctgatcacaactacacaggagaatttgctactatgtgtagtgctttctgtaaagcctatcccactttatgtaaggatccagaaggttatacctatcgtggtaactttgctgccccacaaggtaactactacacccaattctggggttctttagaaggagatcaagataactatttatcctgtggtgaatgttttgaagtttataaaaccaaacccgatggttcagactatcaaccaggagaagaaggatatcaaccaccagttcttctttcagtcattgattcatgtccatgtaatgcgaatggtaaatggtgttgtggttctgaatgggatcaatgtcaagaaattgatttcaagtatggttgtccagttccaaaagacagtattcaccttgatctttccgatattgctatggcacgtcttcaatcgggttcatccaacggtcatatggaagctggtgtcattccaaataagtacagaagagtaccatgtcccagattaggtaacat

SEQ ID NO: 22778 - DNA, 381 bp, Neocallimastix californiae
  EXPANSIN_EG45
tttagcttgtaattgtgttccaaatgcaatggttgttggtccaactgttgctttagccgaagttgcttatggtgcttttgatcatttcggaagtggtccagcatgtggtttatgttatcgtttatctccatatgcaactgctgatggaactccactttctcctatccctgaaccaattgtcttcagagttactgatgaatgtccacatcagtccaatactgaatggtgtccaggaccagaaggtggtaaaaacgctcacggttttgaagatcactttgatgtaaacattgatagttggggtggtaaattaagagattggttccaaggtggtcatatgcaagctaaatatgaattagtttcatgtgaagaatggccaggatg

SEQ ID NO: 22779 - DNA, 549 bp, Neocallimastix californiae
  EXPANSIN_EG45
tggtgcttgtggtttcggtttatatcaagtttgtggtaaaaatcttaaatatactggtgaatttgctaaactttgtgatgctttctgtaaagcctatccatctttatgtcaagatcccgaaggtcttacctaccgtggtaattttgctgcaccacaaggtaattactacacccaattttggggtatattagaaggagatcaagataactatttatcatgtggtgaatgttttgaagtatataaaacaaaagaagatggtactgattacaaaccaggagaagaaggttacacacctccagttcttctttcggttattgattcatgtccatgtagtgccaatggtaaatggtgttgtggttcagaatgggatcaatgtcaagaagttaacaactttaaatacggttgtccagtacccaaggatagtattcaccttgatctttctgatgttgctatggcacgtcttcaatctggtactcccgatggacatatgccagcaggtgttattccaaacaagtaccgtagagtaccatgcccaagattaggtaatat

SEQ ID NO: 22780 - DNA, 546 bp, Neocallimastix californiae
  EXPANSIN_EG45
tggtgcctgtgctttcggtgtttatggtttatgtagttttaaatccaatgtaacaatggaatccgaaatttgtcaaaaattctgtaagaattacccagatctttgtgaagatccagttgatactaaactttctcttagaggtaacttcattgctccaaacggtaactactacactcaattctggtcttctcttccaggagattatgataattatctttcttgtggtgaatgttatgaattagaaattacccaagaagatggttctctttatccagaaaaacaaagacgttctgaaaacattattgcccaaattgtagattcctgtccatgttctgccaatgctaaatggtgttgtggatcaggtattgaccattgtaatgaaattgactttaaatatggttgtccaatcccagaagatagtgtacactttgatttatctgatattgctatggctcgtttacaaaccaatgatccaaacggaggaatggttgaaggtgttattccaattcgttacaaacgtgttccatgtccagttaaaggtaacat

SEQ ID NO: 22781 - DNA, 531 bp, Neocallimastix californiae
  EXPANSIN_EG45
tggtgcttgtggtttcggtttatacggtttatgtactactaagtacaacgaaactggtgctctttgtcaaaagttctgtaagaactacccagatctttgtaaggatccagataacatctctttaagaggtaacttctgtgctccaaacggtaactattacactcaattctggtcttctcttccaggagattatgataactacctttcctgtggtgaatgttatgaagttgaaagaactcaaccagatggttcttcctacccaaaagatacgaagactgataacattcttttacaagttgtcgattcctgtccatgtactgctaatgctaagtggtgttgtggttctggtgttgatcactgtaatgaaattgacttcaaatatggttgtccaattccagaaggtagctggcacgtcgatttatcagatattgctatgtctcgtttacaaactaacgatccatacggtactatgtttgatggtgttattccaattcgttacaagcgtgttccatgtccagtcaagggtaacat

SEQ ID NO: 22782 - DNA, 546 bp, Anaeromyces robustus; identical to SEQ ID NO: 22780
  EXPANSIN_EG45

SEQ ID NO: 22783 - DNA, 531 bp, Anaeromyces robustus; identical to SEQ ID NO: 22781
  EXPANSIN_EG45

SEQ ID NO: 22784 - DNA, 549 bp, Anaeromyces robustus
  EXPANSIN_EG45
tggtgcttgtggttttggtttataccaagtttgtggttcagaccataattacactggtgaatttgctactctttgtactgcattctgtagagcttatccaactttatgtaaggatccagtcggtcgttcttaccgtggtaactttgctgctccacaaggtaactactacactcaattctggggttctttagaaggtgatcaagataattacttatcttgtggtgaatgtttcgaagtttacaaaacaaaggaagatggttctgattacaagccaggagaagaaggttatcaaccaccagttcttctttcagttattgattcatgtccatgtagtgctaatggtaaatggtgttgtggttctgaatgggatcaatgtcaagaagtcaataacttcaaatacggttgtccagttccaaaagacagtattcaccttgatctttcagatattgctatggctcgtcttcaaagtggttcctctaatggtcatatggaagctggtgttattccaaacaaatacagaagagttccatgtccaagattaggtaatat

SEQ ID NO: 22785 - DNA, 423 bp, Anaeromyces robustus
  EXPANSIN_EG45
tggttcatgtaacgttagtgctatgggtaatgctgccggtccaactgctgctattagtggtttatcttatggttcatggagtggtttaggtggtggtccagcttgtggtctttgctatgccttgacggtttatggtagttacgatggacaagctgatccagctttattcccaaaatgttcaattgttgttcgtattactgatcaatgtccatatccagataataaagaatggtgtccaggaccagaacaaccagaatctgaaaaattcttaaacccacgtggtatgagatatcactttgatattaacatttctagtggtcaaggtgaagcccgtgaatggttcccacgtgatgcttctggtaatcttttaggtactggtaaagtatacttccaaatggtttcatgtagagaatggagtggttg

SEQ ID NO: 22786 - DNA, 381 bp, Anaeromyces robustus
  EXPANSIN_EG45
tttagcttgtaactgtgttccaaatgctatggttgttggtccaaccgttgctttggctgaagttgcttatggtgctttcgatcactttggtagtggtccagcttgtggtttatgttaccgtttatctccatttgctactgctgacggtactccacttaatccaaaaccagaaccaatagttttcagagttactgatgaatgtccacatcaatccaatgctgaatggtgtccaggtccagaaggtggtaaaaatgcccatggttttgaacatcactttgatgttaatattgatagttgggaaggtaaattaagagattggttccaaggtggtcacatgcaagctaactttgaattagtttcttgtgaagaatggccaggttg

SEQ ID NO: 22787 - DNA, 423 bp, Piromyces finnis
  EXPANSIN_EG45
tggttcttgtaatgttagtgctatgggtaatgctgctggtccaactgctgctattagtggtttatcatatggttcatggagtggtttaggtggtggtccagcttgtggtctttgctatgccttgactgtttttggtagttatgatggtcaagctgatccagaattattcccaaaatgttctattgttgttcgtattactgatcaatgtccatacccagataacaaggaatggtgcccaggtccagaacaaccagaatctgagggattcttaaacccacgtggtatgagatatcactttgatattaatatttctagtggtcaaggtgaagctcgtgaatggttcccacgtgatgcttctggtaaccttttaggtaccggtaaagtttacttcgaaatggtttcatgcagagaatggagtggttg

SEQ ID NO: 22788 - DNA, 531 bp, Piromyces finnis
  EXPANSIN_EG45
tggtgcttgtggtttcggtttatatggtttatgtactactaagtacaatgaaactggtgaactctgtatgagattctgtgacaaatacccagatctttgtgctgatccaccaaacatttctttaagaggtaacttctgtgctccaaacggtaactactacactcaattctggtcttctcttccaggagattatgataactacctttcctgtggtgaatgttatgaagttgaaagaactcaaccagatggttcatcttacccagaaggtgaaggtactgataacattcttttacaagttgttgattcctgtccatgtactgctaatgctaagtggtgctgtggttctggtgttgatcactgtaatgaaattgacttcaaatatggttgtccaatcccagaaggtagctggcacgttgatttatctgatattgctatgtctcgtttacaaactaacgatccatacggtggaatggttgatggtgttattccaattcgttacaagcgtgttccatgtccagtcaagggtaacat

SEQ ID NO: 22789 - DNA, 381 bp, Piromyces finnis
  EXPANSIN_EG45
tttagcttgtaattgtgttccaaatgctatggttgtaggtcctactgttgctttagctgaagttgcttatggtgcttttgaccactttggtagtggtccagcttgtggtttatgttatcgtttatccccatttgctactgctgatggtaaacctctttctccaattccagaaccaattgttttcagagttactgatgaatgtccacatcaatctaatatggaatggtgtccaggtccagaaggtggcttaaacgatcatggttttgcaaatcactttgatgttaacattgatagttggggtggtaaattaagagactggttccaaggtggtcacatgcaagctaactttgaattagtttcttgtgaagaatggccaggttg

SEQ ID NO: 22790 - DNA, 2433 bp, Neocallimastix californiae
  EXTRACELLULAR MATRIX GLYCOPROTEIN RELATED
tccaaatgaacaaagcgattatccaaattgtaaaaataaggatacagaaatattatatagttcagatgatactaaaaaagaatggggagaagaaaatgatgattggtgtattattactgatcttcaacgttgtcctaattcttctgatggttatccatgttgtccagattgtaatgtagtttacactgatgaaaataatcaagtttggggaaatttaaatgatgaatggtgttctattccatatcgttgtagttcaaatagtactgaagtattaaaatctgatgattattcaagtactactagttcatcaggcattagtaatacatctgaagttattcttaatgaatatggtttaagatggactgatgagagttggggtaatacaaactgtagattccaaaatggtgaaatggtttgtagttttaaaggaagtaatggtgaatggcccgcttttagtttcagtaattatcaagattacactggaggtagaattgttataagaatgagggctgctagacctaatcaagatgtttatatattaacttttgatcgttctggaaattataaagtaagattcaattttaaggctacatcttattatgctgattatacttatgatattccagaagatggtacttattatagatttgctattcaagaaggtagtggaaatgataatactttctacattaaaagtattctttattatccaaaggactattcaggtaacaacaacaacaactacaacaacaacaataataataattattattctaatcaatctgtagctattgttgatggaaatggtttacattgggaggatgctagttggggtaatactaattgtaatttccaatattataacggtatggtctgttcctttgttggagaaatgaatgaatatccagctttcagttttaaaacagataattcctttaaaaaaggtactcttgttatcaatatgaaggttttaaaaccagatttagatgttcatttaatggcttatgacgttaatgaaaattattactctattaaaagttttaaggctacatcttattatgctgattatacttttgatattccagctctttctaattcattaagttattatcgttttgctattcaggaaatttctaatcaagataatactttttacattaagagtgtcacattttatccacaggatgctcaagttccaaaaaccactactacaactactgtaagtaaaactccaactccatcggttacttatcttgatcatcctgatgctattattgatggaagtggtttacattgggaagatgctagttggggtagaacttcttgtagattccaacgttctaatggtatggtttgttcctttgttggagaaaataatgcttggccagctttcagtttcaaaacaaataatcattataataagggtactcttgtcatcaacatgaaggtttcaaatccagatttatcgattaatatattagcttatgatcttaatgataattattattctattggtaactttaaagctacaactgaatacgaagattatactattgaagttccagctcgtattaattcattaatatatcgttttgctattcaagaagtttctaatcaagataatacttattacattaagagcgtcacttattatccaccaaatgttaaagttccaactactactaaaaagactactacaaccactgctaaaagaactactacaaccactactacaaccactactaaaagaactactaaaagaactactacaaccactactacaaccacagtcagtaaaactccaactccaactgttacttatcttgatcatgctgatgttattattgatgaaagtggtttacattgggaagatgctagttggggtagaacttcttgtagattccaacgttctaatggtatggtttgttcctttgttggagaaaataatgcttggccagctttcagtttcaaaacagataatcattacagtaagggtactcttgtcatcaacatgaaggtttcaaatccagatttattgattaatatattagcttatgatattaatgaaaattattattctattggtaactttagagctacaactgaatacgaagattatactattgaagttccagctcgtattaattcattaatatatcgttttgctattcaagaagtttctaatcaagataatacttattatattaagaagatcgtttattatccaccaaatgttaaaattccaactactactcaaaagactaccactaccactaccactactactactactgttaagaaaacaacaacaacaactactaccacaaccaccaccaccataaagaaaacaactactactaaagcacaaccaaaaccaactactactactaccactactaccactactacttcttcaacaggtcctaccagtgc

SEQ ID NO: 22791 - DNA, 2280 bp, Neocallimastix californiae
  EXTRACELLULAR MATRIX GLYCOPROTEIN RELATED
cgatcagaatttggatgaaatgctacctcaatttcatattgatgaagaaggttatgctaaaattaacgatgccgaagttttaagtggaaaatatattacagaagatatatataaaaatattaaagatattgatgaatacgaattttatgaaagagtattaagtaacgatccaaattttaatattacttctattaccaaagctattgatagaatgactgaagaaggtccacagtttaaaatttttaatgatgttgataaaatttttagaaagaatattatttatgatattattgatgatgatgatactgaagaatttaaaactaaaaatggtaccatgagcgttgaaattaatggtgaacgaaaagaatttagtaaacttactttaaaattagggggaagatcttcacgttcttatggtaaaccttgttataacataaaaattcgtaataaagatgatttatatggcaggactcaatttaaaatacgatctggatccagagatgctacatttttaagaaataaattagcatgcgatatacataatgctttaggtattccatctatttcagctaattatattacgttatatattaatgaggactatttaggtttttatattattatggatgctataaaattgtcatgggttgaatttttatataatgataagaattccacatttttatataaatgtgatgatgtacataatggaatttcaaagaaaactgctgttaaaggatgtacaaatgaaaatgagaattttactgataaaaaagattgggaagaatttttaacttcaatagatgaagctgaatctgccaataacctagaagatatattagatattgatcaatatttaacggaaatagcattagaatatttatttggttcatgggatcattatccagttcatagtcataacttttatttttataaagcaaatagtgtcgataaaaaatggaaatatttaatttatgattttgatggagaatttggacaagatattaatagtcattttatttcacaaatagaatttccatcatctaaatcatttttcatttctaattcaacattatattcttcattattacgtagaaccgacagtagtttaaatgaaaccgaaataaatcaaaataataaaacaattgcatccaacaatatagaagaactttttattgatcatgaagataaaaaatatgaatttgcagcctattcctttactgaatggtataatggacaggaccatttaattaaaattttaatattaaatcatcccactcggtttgttgatacactaaaaaagattatcactaaagtttttaatccaactatacttttcccacatatcgatgaaattaaaaaatttattacgccctatgtaaagaaggaaaagtacccagatgaaaatggtaaatatcctggaaatttagataaatctttagaaatttattcattagaacaatgggatgctaacagtgaatttactgccattgctgaccctatcggccgttataaaagttatggaattaagtattggattcttgtgaaataccgttatttatgtcaaatcctttcattggaatgtgattctaaatatatggatgaaaactttgaatatccaattaatattaatgtagactatgataccattttttcaaataatgataatgataatgaagataatgattttgataatgaagataatgattttgataatgatttcgataatgataccgataataataataatgatgatgttggaaatattggtaatgatgaaaatggtgataatactgaaaataataaaaatattgaaaatgataataatactgaagatgtaaaagataatagtaataatacaaatatttccgataattcaactataatttcatcaattaatccatcaaccacaacagctattctttcatcaaccaccacttctactacctcatctacttcattaatcattccatcaactacaacatctgattcttcattgacaacctccattactatcacctcttcttctataactactacctcctcttcttcttctacttctttaacgtcatctacaagtatttcagcagaaatatcaccttcttctatatcatcaagtacaacttccaatgttgaaactacatccacttctatcacagaaacaacgacatccaatgttgaaactacatccactactatcacagaaacaacaacatccagtgttgaaactacatcaaattctatcacagaaacaacaacttccaaggaaactccatattc

SEQ ID NO: 22792 - DNA, 384 bp, Neocallimastix californiae
  FabD/lysophospholipase-like
tatgtccttcacaggtcaaggcagtattaagccaggagttggtaaggaattatttagaacccaacccgtcttccgtgccgctatggaaaagtgtgatgctgtggttaagaagtctaccggaatttctattcttgatgccctctatgatcaaaatcaaggtcatcacttaaagaaggctcaaattgctcaacctgctttattcgcttatgaatatgctatgtacatgctttggaaatcttggggtattaagccagtcattgttaatggtcacagtttaggtgaaattgttgccgctgccgccaccggcgctatagatattgatttagccattgatttcattattgaaagagccagatgcatgggtgaatatggtgaaaagccagg

SEQ ID NO: 22793 - DNA, 309 bp, Neocallimastix californiae
  FabD/lysophospholipase-like
tgccttccattctccattaatggacccagccattgaagaattaaatggttggattgaagaaaagaatgatgcccagttcagacaaactttaaaggtaaagttcatttccaacgttgatagtaccattaagcctgtcggtgatcgtcttgaaaaggattactggggtaagcatgctagaaatgccgttcgtttcgttgacggtgtaaagtctatgattgaatccgaaaagaagttattggctgtcattgaagttggtccagccgccacgttgaccaacatgagttctcgtttcgttcgtgaaacagaatc

SEQ ID NO: 22794 - DNA, 411 bp, Neocallimastix californiae
  FabD/lysophospholipase-like
tgcttttgcttttactggtcaaggtgttgctaaggttggtatgggtaagcacttctaccaaactcaaccagttttccgtgaagctatggacagatgtgatgctgttactcgtcgtcttcttggcgtttccattgttgaggttttatataatgtttcaaacattccaaatggtactgaagaaggtgaaaaggctctcaagaagtcctctgttgcccaaccagctttattcgcttatgaatatgctatgagtcaattatggattagttggggaattaaaccatctatggttcttggtcattcacttggtgaaattgttgccactaccattgctggtggtattgactttgaattagctatggaattcattgttgaaagagcttcatgtatggaaaagtatggtattaagccagg

SEQ ID NO: 22795 - DNA, 312 bp, Neocallimastix californiae
  FabD/lysophospholipase-like
agctttccactctgctttaatggatccagctattgaaaagttatacgaatggattgatagtaagccagatgaaaaattccgtcaaccattaaaatatggtcttatttctaatgttactggtaagcttattccagctggtgaacgtcttccaaagaactactggggtgagcatgctagaaatgctgttcaatttgttaaggctgttgaaaccttattagccaatagtgaaactttattaaatgttattgaagttggtccagcttccgttttaactaacatgagttctcgtattttacgtgaaaagaaggttga

SEQ ID NO: 22796 - DNA, 402 bp, Neocallimastix californiae
  FabD/lysophospholipase-like
gttagccttcactttttcaggacagggtactcaatatcctgatatgggtcgacaactgtatcattctaacccttattttgctaatattattgactattgtaacgaaatcgttctttccatctccaaaaaagatttattaaaggaaaccggtttattcggtgatttgccagtaaatgaagaaaacttaatggatcctcaatattccttcttagcgatcggtattattcaattggctcttgtagaattttggaaggcctatggtgtagaaccttcattggtctttggtcatagtatgggtgaagtagctgctgcatatgctgcgggtattttaactttagaagatgccattctcctactgtatcattatggtcttatcagtcaaaatttggaggaaaataatga

SEQ ID NO: 22797 - DNA, 279 bp, Neocallimastix californiae
  FabD/lysophospholipase-like
ggctttccataccccattcattctttcagctaaggagaaattccttaaaggtattgaaggtattcatttaagagttcagccaccaaagattccattcatctcttctactcatggtaatgaatatcaaggtccatttgatgccaactattggtggtccaatattattaatccagtgaactttagtcaagcagtaaaaattgctcataccaaggttgataaggtcttagaaattagtagtacgccagttttaggtatctatataagtagtgtcttccaacc

SEQ ID NO: 22798 - DNA, 315 bp, Neocallimastix californiae
  FabD/lysophospholipase-like
tgtctctgatttatatcatcgtcttccaagcttccgacaagccataaaagaatgtgataaagaaattaagaaattaacccaatataaatattctcttattaaggatttggctagtttaggtgaagaaagcaagaagagtaatttgagctatcttggtaacgttcttgttcttgcccttcattatgccttctataaggtcatcagaagtattcatcctgtcgaaggaactttacttgtcggttatggctatggtgaacttgccgctattcttaatgccggtggtatttccttcggaaaagcggcccaattccttaa

SEQ ID NO: 22799 - DNA, 282 bp, Neocallimastix californiae
  FabD/lysophospholipase-like
agctttccattctccatatgttgaaggtgctgaacaagcctttaaggaaagcattagaggtattagtgaacgtacttccgctccaaagtgtaaatttatttctgcatgctttggtcaagaatatgaaggtccatttgatgaaaactactggtgggctaacattcgaaatccagtaagtttctatgctgctgctagtattggtactcaattctctaaacgtgtattggaaattggtgctcacccagttcttagtgtgtatcttaaagaaatttatggtaaaga

SEQ ID NO: 22800 - DNA, 405 bp, Neocallimastix californiae
  FabD/lysophospholipase-like
ctttgctttttctggtcaaggttctcaatttataaatatgggtagacgtatgtatcaagtaaatggtcttttcaagagaattgtagactattgtgctgccgttcttgttacctacaatggtggtgaagatatttttgaaaagtaccatattttcaagggtgatgtttctcaaattagtgaagctgatctttctcttccacaatactctattcttgctattggtgttgctcaaattgctcttactgaaatttggaaggctatgggtgttactccagaagctgtttttggtcacagcatgggtgaagttgctgctgcctatgctgctggtattcttacacttgaagatgctatcttattattatacatgcgtggacatattcttgctcaattagatggtaccggaaa

SEQ ID NO: 22801 - DNA, 231 bp, Neocallimastix californiae
  FabD/lysophospholipase-like
tttgttaaatgctactcaattcactcaaccagcaattacccttactgaaaaggctgcctttgaagatatgtatgaaaagggttacatttgtgatgatgcagtttacgccggtcactctcttggtgaatacgctgctctttcctgtgttgctaacaccttaagtattgaaagtatggctgaaattgtcttctaccgtggtcttgtcatgcaatcctctgtcgaaagagatga

SEQ ID NO: 22802 - DNA, 66 bp, Neocallimastix californiae
  FabD/lysophospholipase-like
tccattccactccagttacttactttggggtgttccaaccttccgtgaattacttcaccaacgtgt

SEQ ID NO: 22803 - DNA, 234 bp, Neocallimastix californiae
  FabD/lysophospholipase-like
taactctgcctacttggaaaagattattgaagaatgggatcaacacttgtttgaaattccatacattattatggttgaattattatcttatcaattagcttctgctgttcaatggattaagactcaagaattcttattcagttctcaaaagaagggtggtgctgatattgaacgtcttattgaatttggtccaactccaactttagttggtatggctaaacgtactcttggtat

SEQ ID NO: 22804 - DNA, 162 bp, Neocallimastix californiae
  FabD/lysophospholipase-like
tgcctacgttttcactggtcaaggtgctcaagaagttggtatgggtcaagatctctacaacaaatctgctgttgccaaggctgtttgggatagagctgatgcctacttaatgaagaagtacggttactctatcttggaaattgttcgtactaatccaaagtc

SEQ ID NO: 22805 - DNA, 471 bp, Neocallimastix californiae
  FabD/lysophospholipase-like
tgttttcggtggtcaaggttacccaggttttaatgaaattcttcaagcttatactatgtatggtgccatcgttcgtgactacattgctgaactttccaccattttaaaggaattagcttctaagccagagttccaacgtacctacaaacaaggtcttgatattttaaaatggttacgtaacccagaatctcttccagaagatgcttacttagattctgctccagtttccttcccattaattggtattgttcaattagttcaatacttaattcttttccgtaccttccgtaaaactccagattgggctcgtcatttattcgctggtactactggtcactcccaaggtttagttacctctgttgttattgcttcatctggtaccgaagaagaatacttggaaaactctaagaaggctgtttccttattattcttgattggtgctcgttcccaacaaatttttgctattactcc

SEQ ID NO: 22806 - DNA, 318 bp, Neocallimastix californiae
  FabD/lysophospholipase-like
tccagctcacaatgaaatcttaaaggaagctgctgaattagttgttgaagatgctgccaagttaaacattacattcccaactaagaacttagctattccagtctaccgtactgataatggtgttgatatgaaggaagaatctgatattactgatgttgttgaacctgttgtcaaccaaatttgtatcttaccagtcgattgggttaaggccactaatgttccaggattaactcacgttttagatttcggacctggtggtgcctctggtattggttctcttatccaaaagaacaaggaaggtactggtgttcaagttat

SEQ ID NO: 22807 - DNA, 285 bp, Neocallimastix californiae
  FabD/lysophospholipase-like
ttgtacaccatatctaaatgattttaaggatgaattctttgcttcattaaagggtattggtaataattgcaagaccccagttattaaatttatttctacgactttgggacaaccatttaatggaccattaaatgaatattattggtgggcaaatttatcaagtactgtaaactttagtcatgctctttctcttgcaatgaatgaacaacaaaagggtagtgggtacattttagatgttggtagtggttacgctaatgctgctctctttaccaattactttggtgc

SEQ ID NO: 22808 - DNA, 405 bp, Neocallimastix californiae
  FabD/lysophospholipase-like
aacttttgtatttagaggaatgagccaattaaattcaaatattggctatagtttataccaatataaccaaaaatttgccgaaattgttgattactgtgataaggtacttgaaaaggtaagtggtggcgtttgctcacttaagagagaatttggtttattccaatcagaaaatttgaatttcctttctcttcaaaatccaaagatgtcaattattggtaatggcatgatacaattggctttgggtcatctattaaagagctatggtattaaaccatcttctgttgttggttacaattctggtgaaatcgctgctgcttatacagcaggtattattagtttagaggatgctatcttagttttatatcaatacagtactattttagaaaaagttccaaacaaaaagaa

SEQ ID NO: 22809 - DNA, 66 bp, Neocallimastix californiae
  FabD/lysophospholipase-like
tccattccactctagtttcttattaagaggtgttgctccattccgtcaatacttgatgagtaagtt

SEQ ID NO: 22810 - DNA, 162 bp, Neocallimastix californiae
  FabD/lysophospholipase-like
tgcttatgtcttcactggtcaaggtgctcaagaagtaggtatgggtatggacttgtatgaaaagtcaccagtagctagagaaatttgggatcgtgctgatgctcacttgatggaaaattatggtttctctattattgatattgttaagaataatccaactga

SEQ ID NO: 22811 - DNA, 231 bp, Neocallimastix californiae
  FabD/lysophospholipase-like
tttattatcggctactcaattcacacaaccatcccttgttttaatggaaaaggctgcttttgaagaaatgagatctcgtggtttcattcaacaaaacagtgcttttgctggtcatagtttaggtgaatatgctgccttaactgctattggtgatgtcttaagtattgaaacgttggttgatgtcgttttctatcgtggtatgactatgcaaagagccgttcaacgtgattc

SEQ ID NO: 22812 - DNA, 240 bp, Neocallimastix californiae
  FabD/lysophospholipase-like
taattcttctcgtattaagaatgtcttaaagggttggactgatgataaatacgcttctccacgtcttcaacaaaaattgggttacattcttttaattgaattattagcttaccaatttgctagtgctgtcagatggattgaaactcaagatagattattcgttgatattggtgttgaacgtttaattgaaattggtccaggtccaacactttctggtatggctcaaaagaccttaaagtt

SEQ ID NO: 22813 - DNA, 276 bp, Neocallimastix californiae
  FabD/lysophospholipase-like
tccattccattgtgattacttaaaggatgttaatgatattattatgaaggatgttgaacgtgatcatttaattcttggtaagggtgaattagttattccaattttatctactgagactggtgaagatttaagaggtcatccacaatttacttatgaattaattaaacaaatttgtactttacctgttcattgggaaaaggctacctctgttactaatgctactcatgtattagaatttggtccttctggtgctggtgttggtttattaacccacag

SEQ ID NO: 22814 - DNA, 477 bp, Neocallimastix californiae
  FabD/lysophospholipase-like
tgccgtttttggtggtcaaggtagtgaagattactttaatgaaattaaggaaatttacagtacctatgaagttatcattaaatcttatttagaaagaatgtcttgcatgttagaagaattagcttcaaagccagaacttttacaattctttccaaagggtttacatgttttaaaatggttagaagaaccagaaactttaccagatactaaatatttagttaatgctccaatttctttaccattagttggtctttgtcaacttttacattactctgttttatataaaattttaggaaaaactccagatgaaatgagaagatgttttgttggtaccactggtcactcccaaggtattatttcatctgttgttgtttcatcctctggaactgaagaagaatttattgaaaattctcaaaaggctttatctttattattctggattggtgttagatctcaaatggcttatccagaaaccac

SEQ ID NO: 22815 - DNA, 240 bp, Neocallimastix californiae; identical to SEQ ID NO: 22812
  FabD/lysophospholipase-like

SEQ ID NO: 22816 - DNA, 231 bp, Neocallimastix californiae; identical to SEQ ID NO: 22811
  FabD/lysophospholipase-like

SEQ ID NO: 22817 - DNA, 66 bp, Neocallimastix californiae; identical to SEQ ID NO: 22809
  FabD/lysophospholipase-like

SEQ ID NO: 22818 - DNA, 162 bp, Neocallimastix californiae; identical to SEQ ID NO: 22810
  FabD/lysophospholipase-like

SEQ ID NO: 22819 - DNA, 411 bp, Neocallimastix californiae
  FabD/lysophospholipase-like
taccttttatgatacctgtagagatttctattgtaataatagctactttgctgactgcattgattattgtgatcaggtattaaagatgataagtggacgttctcttcttgaagattatggtcttttccaatccgtaaaggaagaagaaaaggaaaaggaaaaggaaaagaaaaacaaattaagagaagatcttctcaaggatcctactactactcttttaattaatggtataattcaattaggattagtggcactctaccgttattatggcatttctccaaatgcagttattggttatggtgctggtgaaattgctgctgcctatgctgcagaaaagatagatttaaaatcggctgttcaaattctttatcattatggaagggtattatcgatggtgaagaaggatgataa

SEQ ID NO: 22820 - DNA, 258 bp, Neocallimastix californiae
  FabD/lysophospholipase-like
cgccatccacaccaaaaagatttctgaagcaatgaaggaagaactggtaaagcgtttaacgaacattaaatccaagccttcctccattgccatgttctcgaccaccaaattcagtaaagaaggaaagccatataccgacgcattagatggtcagtactggtggatgaatatgagaaatccagtgctctatgctcattccctctcccaaacggccaacttccttccaaccgatggtaaaaatattttagagattggtct

SEQ ID NO: 22821 - DNA, 357 bp, Neocallimastix californiae
  FabD/lysophospholipase-like
tgcttgctacctctaccgtacttatcctgtctatgctaaagccttagaggaatgtgatcgtatcatctctgaattaagtaactttaaggtcttattagttaatttgatcatttgtatgggtgaattagttcaaccagatcttttaaaggaatacaagaaacaagtcgatgaagatccatgtatggctcaattcattattctttcgatgaactatgcactcaccgcgctcttacgtcatttgaatatttctatcaatttagtcatgggagatggtttcggtgaagtcagtgccgctttagcttgccaaaaaattaccttaagaaacgcttttattctcattcaatatctttgtaagaa

SEQ ID NO: 22822 - DNA, 477 bp, Neocallimastix californiae
  FabD/lysophospholipase-like
tgccgtttttggtggtcaaggtagtgaagattattttaatgaaattaaagaaatttacagtacctatgaagttatcattaagtcatatttagaaagaatgtcttgtatgttagaagaattagcttctaaaccagaacttttacaattcttcccaaaaggtttacatgttttaaaatggttagaagaaccagaaactttacctgatactaaatatttaattaatgctccaatttctttaccattagttggtctttgtcaacttttacattactctgttttatataaatctttaggcaaaactccagatgaaatgagaagatgttttgttggtactactggtcactcacaaggtattatttcatctgttgttgtttcatcttctgggactgaagaagaatttattgataattctgaaaaggctttatctttattattctggattggtgttagatctcaaatggcttatccagaaactac

SEQ ID NO: 22823 - DNA, 276 bp, Neocallimastix californiae
  FabD/lysophospholipase-like
tccattccattgtgattacttaaaggatgttaatgatattgttatgaaggatgttgaacgtgataacttaacccttggtaagggtgaattagctatcccaattttatctactgaaactggtgaagatttaagaggtcatccacagtttacttatgaattaattaagcaaatttgtactttaccagtttactgggaaaaggctacttctattactaatgctactcatatcttagaatttggtccatctggtgctggtgtcggtttattaactcacag

SEQ ID NO: 22824 - DNA, 240 bp, Neocallimastix californiae
  FabD/lysophospholipase-like
taattcttctcgtattaagaatgtattaaagggatggacggatgataagtatgcttctccacgtcttcaacaaaagttaggttacattcttttaattgaattattagcttaccaatttgctagtgctgttcgttggattgaaactcaagatagattattcgttgatattggtgttgaacgtttaattgaaattggtccaggtccaacgctttctggtatggctcaaaagacattaaagtt

SEQ ID NO: 22825 - DNA, 231 bp, Neocallimastix californiae
  FabD/lysophospholipase-like
tttattatcggcaactcaattcactcaaccatcgcttgttttgatggaaaaggcagctttcgaagaaatgagaactcgtggtttcatccaacaaaatagtgctttcgctggtcacagtttaggtgaatatgccgccttaactgctattggtgatgtcttaagtattgaaaccttagtggatgtcgtcttctatcgtggtatgaccatgcagagagctgttcaacgtgattc

SEQ ID NO: 22826 - DNA, 66 bp, Neocallimastix californiae
  FabD/lysophospholipase-like
tccattccactctagcttcttattaagaggtgttgctccattccgtcaatacttaatgagtaaatt

SEQ ID NO: 22827 - DNA, 162 bp, Neocallimastix californiae
  FabD/lysophospholipase-like
tgcctatgttttcactggtcaaggtgctcaagaagttggtatgggtatggatttgtatgaaaagtctccagttgcaagagaaatttgggatcgtgcggatgctcacttaatggaaagctatggtttctccatcattgatattgtcaagaataacccaaccga

SEQ ID NO: 22828 - DNA, 471 bp, Neocallimastix californiae
  FabD/lysophospholipase-like
tgttttcggtggtcaaggttacccaggtttcaatgaaatacttcaagcctacactatctatggtgctattgttcgtgattacattgctgaactttccactgttttaaaggaattagctgctaagccagaattcgaacgtacctacaagcaaggtcttgatatcttaaagtggttacgtaatccagaatctcttccagaagatgcttaccttgattctgctccagtttctttcccattaattggtattgttcaattagttcaatacttaattcttttccgttccttccgtaaaactccagattgggctcgtcgtttattcgctggtaccactggtcactctcaaggtttagttacttctgttgttattgcctcctccggtactgaagaagaatacttagaaaactctaagaaggctgtttccttattattcttaatcggtgctcgttcccaacaaatctttgctattacccc

SEQ ID NO: 22829 - DNA, 318 bp, Neocallimastix californiae
  FabD/lysophospholipase-like
tccagctcacaatgaaatcttaaaggatgctgccgaattagttgttgatgatgctgccaagttaaacattactttcccaactaagaacttagctattccagtttaccgtaccgataatggtgttgacatgaaggaagaagctgaagttaccgatgttgtcgagtctgttgtcaaccaaatttgtattttaccagttgattgggttaaggctactaatgttccaggtttaactcatgttttagatttcggacctggtggtgcctctggtatcggttctcttattcaaaagaacaaggaaggtactggtgttcaagttat

SEQ ID NO: 22830 - DNA, 231 bp, Neocallimastix californiae
  FabD/lysophospholipase-like
taactctacctacttggaaaagattattgaagaatgggatgatcatttattcgaaattccatacattattatggttgaattattagcttatcaattagcttctgctgttcaatggattaagactcaagaattcttattcagttctaagaataagggtggtgctgatgttgaacgtcttattgaattcggtccaactccaactttagttggtatggctaaacgtactcttgg

SEQ ID NO: 22831 - DNA, 162 bp, Neocallimastix californiae
  FabD/lysophospholipase-like
tgcctacgttttcactggtcaaggtgctcaagaagttggtatgggtcaagaactctacaacaaatctgctgttgccaaggctgtttgggatagagctgatgcctacttaatgaagaagtatggttactctatcttagaaattgttcgtactaatccaaagtc

SEQ ID NO: 22832 - DNA, 66 bp, Neocallimastix californiae
  FabD/lysophospholipase-like
tccattccactccagttacttactttggggtgttccaaccttccgtgaattacttcatcaacgtgt

SEQ ID NO: 22833 - DNA, 231 bp, Neocallimastix californiae
  FabD/lysophospholipase-like
tttattaaatgctactcaattcactcaaccagctattactcttactgaaaaggctgcctttgaagatatgctcgaaaatggttacatctgtgatgatgctgtctatgctggtcactctcttggtgaatatgccgctctttcttgtgtcgctaacaccttgagtattgaaagtatggctgaaattgtcttctaccgtggtcttgttatgcaatcctctgtcgaaagagatga

SEQ ID NO: 22834 - DNA, 207 bp, Neocallimastix californiae
  FabD/lysophospholipase-like
tgctttccattctccattaatggacccagctatcgaagaattaaataactggattgaagaaaaggatgatgctaagttcagacagtccttaaaggttaagttcatctctaatcttgatggtaccattaagccagttggtgatcgtcttgaagaagattactgggctaaacacgctagaaatgctgttcgtttcgttgatggtgttaa

SEQ ID NO: 22835 - DNA, 384 bp, Neocallimastix californiae
  FabD/lysophospholipase-like
tatgtccttcactggtcaaggtagtatcaagccaggcgttggtcaagaattattcagaagtcaaccagttttccatgcagctatggaaaagtgcgatgctgttgttaagaaggttaccggtgtttctatcattgatgccctctatgatcaaagtcaagcccatcacttaaagaaggctcaaattgctcaacctgccttattcgcttatgaatatgccatgtgtatgctttggaagtcttggggtgttgaacccgtcatcgtcaatggtcacagcttaggtgaaattgtggctgctgctgttactggtgctatcgatattgatttagccatcgatttcattattgagagagccagatgtatgggtgaatatggtgaaaagcctgg

SEQ ID NO: 22836 - DNA, 504 bp, Neocallimastix californiae
  FabD/lysophospholipase-like
aataaaagacgtttatcaaaattatgactactataaggaatgctttatctactgtgaacaaaagatacaaaaacttggaggagataaaaaatatccaatgtttgatgttgtttttgaacatgacaaaataaatattgataccctagatcctattgtgaagcgtttaattatattttcacatttctattctcttcataaacttttccttaattttaatattagtattaatgctattagtggaaaaggaattggagaatattttactttagccatttcctatgcactctctttagaagattcattgagactcctaattaactattataataatactacagtggacagtgataaaattgagaaagaagttaaattaataatgtccattcagaagccacttcgttgttatttctattctaatgctacgaaaagactcttaaagactaatgagtatctagatgagacttactggaaaactcttttatccaatgtagttttccaagaaga

SEQ ID NO: 22837 - DNA, 507 bp, Neocallimastix californiae
  FabD/lysophospholipase-like
aataaaagacgtttatcaaaattatgactactataaggaatgctttatctactgtgaacaaaagatacaaaaacttggaggagataaaaaatatccaatgtttgatgttgtttttgaacatgacaaaataaatattgataccctagatcctattgtgaagcgtttaattatattttcacatttctattctcttcataaacttttccttaattttaatattagtattaatgctattagtggaaaaggaattggagaatattttactttagccatttcctatgcactctctttagaagattcattgagactcctaattaactattataataatactacagtggacagtgataaaattgagaaagaagttaaattaataatgtccattcagaagccacttcgttgttatttctattctaatgctacgaaaagactcttaaagactaatgagtatctagatgagacttactggaaaactcttttatccaatgtagttttccaagaagaaaa

SEQ ID NO: 22838 - DNA, 468 bp, Neocallimastix californiae
  FabD/lysophospholipase-like
aattaaagagatctatcaatattatgattattacaaagaatgttttatctattgtgaacaaaagattcaaagtcttggaggaaataaaaaacatccaatgtttgatgttgtttttgatagtaattactctgatattaaaaatttagatcctatagttaaacgtttaattatattttcacatttctattcacttcataaacttttccttaattttaatgtcagtattaattctattggtggagaaggcattggtgaatattttgctctggccatttcaggtgtcctctcattagaagaatcattaaaactattaataaattatcataatattattgtggataaaaacaaaattgaaaaagaagttaaatcattactttctattcaaaagccacttcgatgtcatttttactctagtgctacaaaaaggttaatgaaaactagccaatatctagatgattcctattggaa

SEQ ID NO: 22839 - DNA, 219 bp, Neocallimastix californiae
  FabD/lysophospholipase-like
tggtatacattctaagataattacagaagctatgaaggatgaattaacaaagcgtcttgaaaacatttcatctcattcttcttctattgcgatgttttcaactgcaaaattcaatgagaagagcgaaccgtacactggtgctttagatggttcatactggtggatgaatatgagaaatccagtactttatgcccatactctttctcaaacagttaacta

SEQ ID NO: 22840 - DNA, 225 bp, Neocallimastix californiae
  FabD/lysophospholipase-like
agatcttcttaaggatccttcaaccgctcttttaattagtggtattgttcaatttagcttggtatctctctataaatactatggtattacgcctagtgttgttattggctatggtgcaggtgaaattactgcggcgtatgcagctgaaaaaatagatttgaaggatgccgttcagattctttaccactacggtcaagtcctatccatggcaaacaattcatcacc

SEQ ID NO: 22841 - DNA, 471 bp, Anaeromyces robustus
  FabD/lysophospholipase-like
cgttttcggtggtcaaggttatccaggttttaatgaaattcttcaagcttacactatttacggtgctattgttcgtgattacattgatgaactttccaccgttttaaaggatttagcttctaaaccagaatttgaacgtacctataaacaaggtcttgatatcttaaaatggttacgtcatccagattcccttccagaagatgcctaccttgattctgctccagtttccttcccattaattggtattgttcaacttgttcaatacttgattcttttccgtaccttccgtaaaactccagattgggctcgtcatttattcgctggtaccactggtcactctcaaggtttagttacctctgttgttattgcctcttctggtactgaagaagaatatttagaaaattctaagaaggctgtttcccttcttttcttaattggtgctcgttctcaacaaaaatttgccattactcc

SEQ ID NO: 22842 - DNA, 318 bp, Anaeromyces robustus
  FabD/lysophospholipase-like
tccagctcacaatgaaattttaaaggaagctgctgatttaattattgaagatgccgctaaattaaatattactttcccaactcaagatttagctattccagtttaccgtaccgataatggtgttgatatgaaggaagaagttgatgttccagatgttgttgaatctgttgtcaaacaaatttgtattcttccagtggattgggttaaggctactaatgttccaggtttaactcatgttttagatttcggtccaggtggtgcctctggtattggttctttaattcaaaagaataaggaaggtactggtgttcaagttat

SEQ ID NO: 22843 - DNA, 237 bp, Anaeromyces robustus
  FabD/lysophospholipase-like
taattctacctatttagaaaagattattgaagaatgggatcaacatcttttcgaaattccatatattattatgattgaattattagcttatcaattagcttctgctgttcaatggattaaaactcaagaattcctctttagtagtgaaaagaagggtggcgttgatattgaacgtcttattgaatttggtccaactccaactttagtgggtatggctaaacgtactcttgctaagaa

SEQ ID NO: 22844 - DNA, 231 bp, Anaeromyces robustus
  FabD/lysophospholipase-like
tttattaaatgctactcaatttactcaacctgctattacccttactgaaaaggctgcctttgaagatatgcttgaaaatggttacatttgtgatgatgccgtttatgctggtcactctcttggtgaatatgctgctcttagttgtgttgctaatactttaagtattgaaagtatggctgaaattgtattctaccgtggtcttgttatgcaatcctctgtagaaagagatgc

SEQ ID NO: 22845 - DNA, 66 bp, Anaeromyces robustus
  FabD/lysophospholipase-like
tccattccattctagttatttattatggggagtcccaaccttccgtgaattacttcatcaaagagt

SEQ ID NO: 22846 - DNA, 162 bp, Anaeromyces robustus
  FabD/lysophospholipase-like
tgcttatgtctttactggtcaaggtgctcaagaagttggtatgggacaagaattatataataaatcggctgtcgctaaatccgtttgggatagagctgatgcctatttaatgaaaaagtatggttattccattttagaaattgttcgtactaatccaaaatc

SEQ ID NO: 22847 - DNA, 402 bp, Anaeromyces robustus
  FabD/lysophospholipase-like
gttagcctttactttttcaggtcaggccactcaatacccagatatgggtcgtcaactttatcattctaatccttattttgctagtattattaattattgtaatgaaattattattcgtttgtcacaaaaagatcttattaaagatactggattgtttagtgatacaccagtagatgaagaaaaattaattgatccacaatattctttccttgctataggtattattcaattagcccttgttgaattttggaaattatatggtgttgaaccagctcttgtttttggtcatagtatgggtgaagttgctgctgcttatgctgctggaattttaaccatagaagatgctatcttattactttataattatggtcttattagtcaaaatgttgatgatattcatga

SEQ ID NO: 22848 - DNA, 288 bp, Anaeromyces robustus
  FabD/lysophospholipase-like
ggcattccatacaccatatattattacagcaaaacaaaaatttattcaaggcattcaaggtattggtagtagagttaattcaccaaaaattccatttatttcttcaacttatggtaaagaatatcaaggaccatttgatgaagaatattggtggactaatattattaatccagttaactttagtcaagctacaaaagtagctcgtactaaagtagaaaaagtattagaaattggttcaacaccggtattaggtatatatatgagtaaaattttcaatccagataatat

SEQ ID NO: 22849 - DNA, 312 bp, Anaeromyces robustus
  FabD/lysophospholipase-like
agctttccattctgctttaatgaatccagctattgaaaagttatacgaatggattgaaactaaaccagatgataaattccgtaaaccattgaagtacggtcttatttctaatgttactggtgaacttattccagctggtgaacgtcttccaaagaactattggggtgaacatgcaagaaatgctgttcaatttgttaaggctgttgaaaccttattagctaacagtgagactttattaaatgttattgaagttggtccatctaatgtcttaactaatatgagtgctcgtattttacgtgaaaagaagattga

SEQ ID NO: 22850 - DNA, 408 bp, Anaeromyces robustus
  FabD/lysophospholipase-like
ttttgcattcactggtcaaggtgttgctaaggttggtatgggtaaacatttctaccaaacacaaccagtcttccgtaaggctatggacaaatgtgatgaagtcactcgtcgtcttcttaatgtatctattgttgaagttttatacaatatttctaatgcaccaaatggtattgaaaaaggtgaaaatgctcttaaaaaatcttctgttgctcaaccagccttatttgcttatgaatatgctatgagtcaactttggataagttggggtgttgaaccatctatggttcttggtcactctcttggtgaaattgttgctactactattgcaggtggtattgatttcgaattagctatggaattcattgttcaaagagcttcttgtatggaaaaatatggtattaaaccagg

SEQ ID NO: 22851 - DNA, 312 bp, Anaeromyces robustus
  FabD/lysophospholipase-like
tgctttccactctccattaatggaaccagctattgaagaattagataaatggattgaaggaaaggatgatgaaaaattcagacaaccattaaaggttagatttatttctaatgttgatggtaagattaaggaagttggtgaacgtcttgatgaaaattattgggctgaacatgctagaagtactgttagatttgttgatggtgttaaatctatgattgaatctgaaaataataatatattagctgtgattgaagttggtccagctgctactttatctcatatgagtgcacgttatgttcgtgaaaatgaagc

SEQ ID NO: 22852 - DNA, 384 bp, Anaeromyces robustus
  FabD/lysophospholipase-like
tatgtctttcactggtcaaggtagtattaaaccaggtgttggtcaagaattatatagaagtcaaccagttttccgtgatgctattgataaatgtgatactgttttaaagaaggtcactggtatttcacttgttgatgttctttacaatccacaacaagctcatcatttaaagaaagctcaaattgcacaaccagctttatttgcttttgaatatgctatgtgtatgctttggaaatcttggggtgttgaaccaactattgttaatggtcatagtttaggtgaaattgttgctgctgctgttactggcgcaatggatattgatttagctattgatttcattgttgaaagagctagatgtataggcgaatatggtgaaaaaccagg

SEQ ID NO: 22853 - DNA, 66 bp, Anaeromyces robustus
  FabD/lysophospholipase-like
accattccactctagtttcttattaagaggtgttgctccattccgtcaatatttaatgagtaaatt

SEQ ID NO: 22854 - DNA, 231 bp, Anaeromyces robustus
  FabD/lysophospholipase-like
tttattatctgctactcaatttacacaaccttccttagtattaatggaaaaggctgcttttgaagaaatgagatctcgtggtttcattcaacaaaatagtgctttcgctggtcacagtttaggtgaatatgctgccttaactgctattggtgatgttttaagtattgaaactttagttgatgtcgttttctatcgtggtatgactatgcaaagagctgtccaacgtgattc

SEQ ID NO: 22855 - DNA, 162 bp, Anaeromyces robustus
  FabD/lysophospholipase-like
tgcttatgtctttactggtcaaggtgctcaagaagttggtatgggtatggacttgtatgaaaaatctgctgttgctagagaaatttgggatcgtgctgatgctcacttaatggaaacttatggtttctctattattgatattgttaaaaataatccaactga

SEQ ID NO: 22856 - DNA, 240 bp, Anaeromyces robustus
  FabD/lysophospholipase-like
taattctagtcgtattaagaatgtattaaagggttggactgatgataaatatgcttcaccacgtcttcaacaaaaacttggttatattcttttaattgaattattagcttatcaatttgctagtgctgttcgttggattgaaactcaagatcgtttattcgttgatattggtgttgaacgtttaattgaaattggtccaggtccaacactttctggtatggctcaaaagactttaaaatt

SEQ ID NO: 22857 - DNA, 477 bp, Anaeromyces robustus
  FabD/lysophospholipase-like
tgccgtttttggtggtcaaggtagtgaagattactttgatgaaattaaagaaatttacaatacatatgaagttcttattaaatcttatttagaaagaatggcttgcgttttagaagaattagcttctaaaccagaacttttacaatttttcccaaaaggtttacatgttttaaagtggttagaagaaccagaaactttaccagatactaaatatatgattaatgctccaatttctttacctttagttggtctttgtcaacttttacattactgtgttttatataaatcattaggaaaaactccagatgaaatgagaagcagttttgttggtactactggtcattcacaaggtattatttcttctgtagttgtttcctcttctggaactgaagaagaatttattgaaaattctattaaagccttatctttattattctggattggtgttagatctcaaatggcttatccagaaactac

SEQ ID NO: 22858 - DNA, 279 bp, Anaeromyces robustus
  FabD/lysophospholipase-like
tccattccattgtgattatttaaaggatgttaatgatactattatgaaggatgttgaacgtgatcatttaattcttggtaaaggtgaattggctattccaatttattctactgaaactggtgaagatttaagaggtcatccacaatttacttatgaattaattaaacaaatttgtactttaccagttcactgggaaaaagctacttctattactaatgctacccatattttagaatttggtccatctggtgctggtgttggtttattaactcacagaaa

SEQ ID NO: 22859 - DNA, 402 bp, Anaeromyces robustus
  FabD/lysophospholipase-like
tacttttgtctttagaggtattagtgaattaaattcaaactttagttatagtttatacaagtataatcaaaagtttgctaaaattgttgactattgtgataaggttcttgagaaagttagtcaaggtttatcccttaagagagattatggtcttttccagaaggaaaactttgatgaaaccactttaagagatccaaaaatttctgttattggtagtggtattattcaacttaccatggctcatctcttaaaatcctatgctattattccatcctctgttgttggttatagtattggtgaaatttccgctgcttatgccgctggtattatttccttagaggatgcggttcttattttatatcaatatagttctattttagaaaaggttccaggtaaggaaga

SEQ ID NO: 22860 - DNA, 252 bp, Anaeromyces robustus
  FabD/lysophospholipase-like
ttgtactccatatcttaatgactttaaggatgaattctatgaatctttaagagatattggtagtagatgtaaggatccagttattccatttatttcaactactttaggtcaaccatttaatggtccattaaatgaattctattggtgggctaatttaactagtactgttaactttagttctgctctttcacttgctatgaatgagcaaccaaatggtagtggttatattttggatgttggtagtggttattc

SEQ ID NO: 22861 - DNA, 309 bp, Piromyces finnis
  FabD/lysophospholipase-like
tgctttccattcaccattaatggatccagctgttagcgaattaaataaatggattgaaagaaaggatgactccaaattcagacaagacttgaaggttaaatttatttctaatgtcgatggtaacattaaaccagttggctctcgtcttgaagaagactattggggtaagcatgctagaaatgctgttcgtttcgttgatggtgttaaatccatgattgaatccgaaaagaagttattagctgttattgaagttggtccagccgctaccttaactaacatgagctctcgtttcgttcgtgaaaccgaatc

SEQ ID NO: 22862 - DNA, 384 bp, Piromyces finnis
  FabD/lysophospholipase-like
tatgtctttcaccggtcaaggtagtattaaatcaggtgttggtttagaattatacagaactcaaccagttttccgtgatgctcttaacaagtgtgatgttgttgttaaaaaggctaccggtatttctcttattgacgctctttacaatccaagtcaaagtcatcacttaaacaaggcacaaattgctcagccagctttatttgcttacgaatatgctatgtgtatgctttggaaatcatggggtattaacccaactattgtcaatggtcacagtttaggggaaattgttgctgctgcttctactggtgctatggatattgatttagctattgatttcattattgaaagagctagatgcatgggtgaatatggtgaaaaaccagg

SEQ ID NO: 22863 - DNA, 312 bp, Piromyces finnis
  FabD/lysophospholipase-like
atcagaactctataacagtcaaccagtatttagaaaggttattaagaactgtgataaggaaatcatggaaattactcatcaacaatattcattagttaaggatattgccagtttaggaaaagaagaaaagaaagatatgccttatattaataatattattacattagctattcaccacgcctattataaattaatgaagtctgtatattctgtagataattctttattcattggttatggttatggtgaactttctgctattcttaatgcaggtggtatttcctttaaagcagcttcacagttacttaaact

SEQ ID NO: 22864 - DNA, 324 bp, Piromyces finnis
  FabD/lysophospholipase-like
attacttgttgaattatacatatctcgtcctgaatttaaacaagctattgaagaatgtgacgctatcattactactattagtaataatgtctattctttagttgatgacattacttcaaagggaatgaacattaatgaaagcaaggatgcattcaaaaacataaaaatactttcattctattatgctttatctaaagttatagataatgaattgaatgttaaacaatccatttttggtggatatggacttggtgaaatcatttctattttaatcaacaatggcatttctattgaaaaagcaattcgattcctaaaacttgtcaa

SEQ ID NO: 22865 - DNA, 243 bp, Piromyces finnis
  FabD/lysophospholipase-like
tccattccttaacaatttcaagaatgaattccatgaagccttaaaggacattggtagccgctgcaaagctccagcaactccatttatctcaactactttaagtcaaccattcaatggtccattaaatgaatattattggtgggctaactttactagtactgttaactttaatgttgctctttcccttgctatgaatgaacaacaaaaaggtagtggatatattttagatgttggctgtggtta

SEQ ID NO: 22866 - DNA, 402 bp, Piromyces finnis
  FabD/lysophospholipase-like
tacttttgtttttagaggtattagtgagttaaaaaccaatttaggttatagcttataccaaaataataaaatgtttgctgatgttgttgactattgtgacaagattcttgagaagattagccagggctactctgttaagaaaaacaccggtcttttcttaaaggaaaacttagatgctgctacccttcaaagtccaaagatttctgttgttggtagtggtatgatccaacttgctatggctcatcttttaaagacctatggtattgttccatcctctgttgttggttacaatactggtgaaatcgctgctgcttatgccactggtattatttctttagaagatgccattcttattttataccaatttagtaatatattagaaaaggtcccaggtaaggaaga

SEQ ID NO: 22867 - DNA, 312 bp, Piromyces finnis
  FabD/lysophospholipase-like
agccttccattctgctcttatggatccagctattgaaaaattatatgaatggattaatactaaaccagatgaaaagttccgtcaaccattaaagtatggtcttatttctaatgttactggtgaacttattgaggctggtgaacgtcttccaaagaattattggggagaacatgctagaaatgctgttcaatttgttaaggctgttgaaaccctattagctaatagtgaaactttattaaatgttattgaagttggtccagctaatgttttaactaatatgagttctcgtattttacgtgaaaagagaattga

SEQ ID NO: 22868 - DNA, 408 bp, Piromyces finnis
  FabD/lysophospholipase-like
ctttgctttcactggtcaaggtgttgctaaggttggtatgggtaagcatttctatcaaactcaaccagttttccgtaaggctatggacaaatgcgatgaagttactcgtcgtcttctcgatgtttctattgtcgaagttctttacaatatctcaaattctccaaatggtgtcgaagaaggtgaaaaggctcttaagaaatcttcagttgctcaaccagctttatttgcttatgaatatgctatgagtcaactttggattagttggggtgttgaaccatcaatggttcttggtcattcacttggtgaaatcgttgctacaactattgcaggtggtattgactttgaattagctatggaatttattgttcaaagagcttcttgcatggaaaagtatggtgtaaaaccagg

SEQ ID NO: 22869 - DNA, 312 bp, Piromyces finnis; identical to SEQ ID NO: 22867
  FabD/lysophospholipase-like

SEQ ID NO: 22870 - DNA, 408 bp, Piromyces finnis; identical to SEQ ID NO: 22868
  FabD/lysophospholipase-like

SEQ ID NO: 22871 - DNA, 396 bp, Piromyces finnis
  FabD/lysophospholipase-like
tacatattacaattgttgtagaaatctttactgtaataataaatacttttctgattgtattgattattgtgatggtattttcaaggctttaagtcaacgttctcttcttcaagattacggcttatttactactgaaatgatggataacaataaatttaaaaaatttaattctgatcttagaaaggatccattagtcatgataatgtttggtggtatggttcaattaactttgtctgccttattaaaatattatggtctatttcctaatgcagttattggttatggtgctggtgaaattgttgctgcctatgttgctgataagatggatttaaagactacggttaaagttctttaccactatggtagagttttaagtcacgcttactctcaagaaaa

SEQ ID NO: 22872 - DNA, 258 bp, Piromyces finnis
  FabD/lysophospholipase-like
tggcttacattcaatgatgattaatgataaaatgaaggaagatcttgtgaacagtcttaaggacattcctttacaaacttctgatattgctttcttcactaccactaagctcaataaggatggtaagccatacgaaggaaaactagacggtgaatactggtggatgaatatgagaaatccagttctttatgctcacgctttatctcaaacagtcgcctttttaccaatagatggtaagaatataatagaaattggttt

SEQ ID NO: 22873 - DNA, 477 bp, Piromyces finnis
  FabD/lysophospholipase-like
tgctgtttttggtggtcaaggtagtgaagactattttgatgaaattaatgaaatttatagtacatatgaagccatggttaagtcttacttagaaagaatggcatgcattttagaagaattagcttctaaaccagaacttttacaattcttcccaaagggtttacatgtcttaaagtggttagaagaaccagaaacccttccagataaaaaatatttagtcaatgctccaatttctttaccattagtaggactttgccaacttttacattacactgtattatataagtctttaggaaagactccggatgaaatgagaagaagctttattggtactactggtcattctcaaggtattatttcatctgttgttgtttcttcttcaggaacagaagaagaatttattgaaaattcagaaaaggctttatctttattattctggattggtgttagatctcaaatggcttacccagaaaccac

SEQ ID NO: 22874 - DNA, 276 bp, Piromyces finnis
  FabD/lysophospholipase-like
tccattccactgtgattacttaaaggatgttaatgatattattatgaaggatgtcgaacgtgatcatttaattcttggtaagggtgaattagccattccaatttattctactgaaaatggtgaagatttaagaggtcacccacaattcacttatgaattaattaagcaaatttgtactttaccagttcattgggaaaaagctacttctgttactaatgctacccatatcttagaatttggtcctgttggtgctggtgttggtttattaactcacag

SEQ ID NO: 22875 - DNA, 162 bp, Piromyces finnis
  FabD/lysophospholipase-like
tgcttatgtcttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactga

SEQ ID NO: 22876 - DNA, 228 bp, Piromyces finnis
  FabD/lysophospholipase-like
tattaagaatgttttaaagggatggactgatgataagtatgcttccccacttcttcaacaaaagttaggttacattcttttaattgaattattagcttaccaatttgcaagtgctgttcgttggattgaaactcaagatagattattcgttgatattggtgttgaacgtttaattgaaattggtccaggtccaactctttctggtatggctcaaaagacattaaagtt

SEQ ID NO: 22877 - DNA, 66 bp, Piromyces finnis
  FabD/lysophospholipase-like
accattccactctagtttcttattaagaggtgttgctccattccgtcaatacttaatgagtaagtt

SEQ ID NO: 22878 - DNA, 231 bp, Piromyces finnis
  FabD/lysophospholipase-like
tttattatcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaagagctgtccaacgtgattc

SEQ ID NO: 22879 - DNA, 477 bp, Piromyces finnis; identical to SEQ ID NO: 22873
  FabD/lysophospholipase-like

SEQ ID NO: 22880 - DNA, 276 bp, Piromyces finnis; identical to SEQ ID NO: 22874
  FabD/lysophospholipase-like

SEQ ID NO: 22881 - DNA, 162 bp, Piromyces finnis; identical to SEQ ID NO: 22875
  FabD/lysophospholipase-like

SEQ ID NO: 22882 - DNA, 228 bp, Piromyces finnis; identical to SEQ ID NO: 22876
  FabD/lysophospholipase-like

SEQ ID NO: 22883 - DNA, 66 bp, Piromyces finnis; identical to SEQ ID NO: 22877
  FabD/lysophospholipase-like

SEQ ID NO: 22884 - DNA, 231 bp, Piromyces finnis; identical to SEQ ID NO: 22878
  FabD/lysophospholipase-like

SEQ ID NO: 22885 - DNA, 162 bp, Piromyces finnis; identical to SEQ ID NO: 22875
  FabD/lysophospholipase-like

SEQ ID NO: 22886 - DNA, 228 bp, Piromyces finnis; identical to SEQ ID NO: 22876
  FabD/lysophospholipase-like

SEQ ID NO: 22887 - DNA, 66 bp, Piromyces finnis; identical to SEQ ID NO: 22877
  FabD/lysophospholipase-like

SEQ ID NO: 22888 - DNA, 231 bp, Piromyces finnis; identical to SEQ ID NO: 22878
  FabD/lysophospholipase-like

SEQ ID NO: 22889 - DNA, 477 bp, Piromyces finnis; identical to SEQ ID NO: 22873
  FabD/lysophospholipase-like

SEQ ID NO: 22890 - DNA, 276 bp, Piromyces finnis; identical to SEQ ID NO: 22874
  FabD/lysophospholipase-like

SEQ ID NO: 22891 - DNA, 477 bp, Piromyces finnis; identical to SEQ ID NO: 22873
  FabD/lysophospholipase-like

SEQ ID NO: 22892 - DNA, 276 bp, Piromyces finnis; identical to SEQ ID NO: 22874
  FabD/lysophospholipase-like

SEQ ID NO: 22893 - DNA, 162 bp, Piromyces finnis; identical to SEQ ID NO: 22875
  FabD/lysophospholipase-like

SEQ ID NO: 22894 - DNA, 66 bp, Piromyces finnis; identical to SEQ ID NO: 22877
  FabD/lysophospholipase-like

SEQ ID NO: 22895 - DNA, 228 bp, Piromyces finnis; identical to SEQ ID NO: 22876
  FabD/lysophospholipase-like

SEQ ID NO: 22896 - DNA, 231 bp, Piromyces finnis; identical to SEQ ID NO: 22878
  FabD/lysophospholipase-like

SEQ ID NO: 22897 - DNA, 276 bp, Piromyces finnis
  FabD/lysophospholipase-like
ggctttccatacttcctacattattacagctaaggacaaattccttcaaagtatccaaggtattggtaatagagttaaagcaccaaagattccattcatatcctctacctatggcagagaatatcaaggtccatttgatgaagaatattggtggacaaatatcattagtccagtcaactttagccaagcaaccaagattgctcgttcaaagatcgataaagttttagaaattggttccacaccagttttaggtatctatatgagtaacgatttcca

SEQ ID NO: 22898 - DNA, 402 bp, Piromyces finnis
  FabD/lysophospholipase-like
ggtagccttcaccttctcaggtcaaggtactcaatatccagaaatgggtcttcaactttacaatatgaacccatatttcgcaagtattattgattactgcaattctatccatacccaaatttctaaaaaagatcttttaaaggagactggcttatttggtaagggtcctgtaaatgaagaaaaacttttagatccacagtattcattcccagctattggaataatagaattagctctagttgaactatggaaacgttatggtgttgaaccagctcttgtctttggtcatagtatgggtgaagttgctgctgcttatgctgctggtattttaactattgaggatgctattcttttactttataactatggacaaataagcgaaaatgtagttgatgctggtgc

SEQ ID NO: 22899 - DNA, 291 bp, Piromyces finnis
  FabD/lysophospholipase-like
agctttccattctccatacgttgaaggtgctgaaaaggctttcaaggaaagtattagaggcattggtgaacgtactaaagctccaaattgtaagtttgtttctgcttgttttggtcaagaatatgaaggtccattcgatgaaaattactggtgggctaatattcgtaatccagttagtttccatgctgctgcttctattgctactcaattctctaagcgtgttttagaaattggtgctcatccagttcttggtatgtatcttaaggaaatctatggtaaggataacgtcta

SEQ ID NO: 22900 - DNA, 405 bp, Piromyces finnis
  FabD/lysophospholipase-like
ctttgctttctctggtcaaggttctcaatttataaatatgggtagacgtatgtatcaaaccaatgatctctttaagaaggttgtcgattattgtgctgctgttcttgttactattaatggcggtgaagatatctttgaaaagtatagcatctttaagggagatgttgctcaaattagcgaaaccgatctttctcttccacaattctctgttcttgctattggtattgctcaaattgctttaattgaagtttggaagtctatgggtgttacaccaaaggctgtctatggtcatagtatgggtgaagttgctgctgcttatgctgctggtgttcttactatcgatgatgctgtcttattattatacatgcgtggtcatattcttgctcaattagatggtactggtaa

SEQ ID NO: 22901 - DNA, 90 bp, Piromyces finnis
  FabD/lysophospholipase-like
aatggaacatagtcaatccttttattcttccattcatcaacaggtattttcaaagggtcaaaatctcaatggagattattgggttaaatt

SEQ ID NO: 22902 - DNA, 378 bp, Piromyces finnis
  FabD/lysophospholipase-like
ctatctctaccgtactcaacctgtctatgctaaagccttagaagaatgtgataagattatcactgagttaagtaactttaagattttattggtcaatttggttatttgtatgggcgaattgatacaaccagaattattacaagaatacaaaaagcaagtagatgaagatccatgtatggctcaattcattgctctttccatgaactatgctttaataaaacttttagaacatttatctatttcaccaaatcttgttgtgggttataaatttggtgaaattacagctgctcttgcctgtggtaagatttctttgagaaatgctttccttattattcattacatttgtaaaataattcgtaagaatatccaactttctga

SEQ ID NO: 22903 - DNA, 822 bp, Neocallimastix californiae; identical to SEQ ID NO: 13985
  FAMILY NOT NAMED

SEQ ID NO: 22904 - DNA, 588 bp, Neocallimastix californiae; identical to SEQ ID NO: 17625
  FAMILY NOT NAMED

SEQ ID NO: 22905 - DNA, 951 bp, Neocallimastix californiae; identical to SEQ ID NO: 17626
  FAMILY NOT NAMED

SEQ ID NO: 22906 - DNA, 951 bp, Neocallimastix californiae; identical to SEQ ID NO: 17627
  FAMILY NOT NAMED

SEQ ID NO: 22907 - DNA, 1485 bp, Neocallimastix californiae
  FAMILY NOT NAMED
aggggcttcttatcgtgttgaacatgtttatgctggtgatttagatggtgatggtacatatgatttcgttgtgaagcgtatgtcagataatcgtgaccctattcttcttgaagcatacaaattagatggtacattcttatggcgtatgaatcttggtccaaatatcgaaacttacacttcttcccttactagtcctgtcttagtttacgattttgatggtgatggtaaggctgaagttatggttaaaaccagtgaaggtaccgttttcggtgatggtactaagattggtgatgtcaatcatgatggtagaacagattattgtgaaagaaacagaactcaatatcaagttcttactggacctgaatttatttctatggttgatggtatgacaggtaaggaaattgatcgtgtcgatttccttgaacgtggtaataccaatgattggggtgataactatggtaaccgtatgaactttatttttgtcactgtcgcttatttagatggtaaggaaccatccatggtccttactcgtggtgctggagatttaagaaataagagggctatcactgcttatgctttaaaattccaaaacagaaaattcactgttcaatggactttccgtattcttgattacaagaataaaattccagctggtcacggtatggtagaattccactctattcgtggtgttgatttagatggtgatggttttgatgaaattcatcttggtggtttcgccattgatcatgatggtaaattactttactccaccgaattaggtcatggtgatcgttttattatcgcagatattaatccaaaccgtaagggattagaatactttgccattcaacaaaaccatgaaggaaaactcggtaccgctcttttagatgccgctactggtaaaactatttggaaacaatatttacctcaaaaggaagatgtcggtcgtggagatgctgcctccattttagatgtctatggtatgcaatgttggagtagtagtttcccaggattttatgatgtaaacggaaaacaattgactaataatcgttctttcccatctcttagtatctggtgggatggtgatttaaaacgtgaatttttagatggtattggtaaggaaggatacaacccagcaattaacaagtggaatgttgctaaggacagtaatgatcgtatctttactatctataatgatggtggtaactacagtgtcataagtccttattctggtcgtgtaccactctatggtgatcttattggggactggcgtgaagaaattgttttagaaaccgctaatcatcaagaacttcgtgtttacaccaccaccgttggaacagaatacagtatttacactttaatgcataatccagcctatcgtaactgtgttaatgttaagggttaccttcaatccactgaagtagattactacttgggttatggtgctgacgttaagaacattccaaaaccagatatttacgttaa

SEQ ID NO: 22908 - DNA, 774 bp, Neocallimastix californiae; identical to SEQ ID NO: 13986
  FAMILY NOT NAMED

SEQ ID NO: 22909 - DNA, 942 bp, Neocallimastix californiae
  FAMILY NOT NAMED
caatggttatgaacttttaaaaaattactctaagggtttcagaattggtgctgctactaacaccattcattacaacaacgctaactatgttaatgctatgaaagcattcaactatatggttgctgaaaatgcttgtaagttcgttagtattcaaggtactaagggtagattcaatttcaatgattgtgatgcccactacaacaaagcaaaggaattaggtatggactttagaggtcacgctttaatttggcacagtatggctccaaagtggcttgaatacgaagattctaatactatgagaaattccatagttaatcacattacaactgtcttaaagcactacgaaggtaaaattgatacttgggatgttgttaatgaagctattgatgatgattccaatggtaatggttggaagtatcgtaattcattcctttaccaaaagaacagagatttcattgatcttgctttcaagactgctcgtcaagtagctccaaaggttaaacttttctacaacgattataatactgaaggtatttggggtaagagtgaatctgtttaccaatttgttgctgatttaaagaaacgtaatattccaattgatggtgttggtcttcaataccatgtcagtgttcaaaatcaaccacaattcaacaaaattaacgatttaattggtcgttactgtaagttaggccttgaagttcacattactgaattagatgtcagttgtgttaattcttgtaatgctggagatgttgaaagcagacaatcccaagttttcactaatgctttaaaggcttgtcttaacaactcctgttgtactgctttccttgtctggggtattggtgatccagacagttggttaggtaatgataagaagggtttacttttcaatggtaattaccaaccaaaatctcaatacaatgctctcttaaacgtcttaaa

SEQ ID NO: 22910 - DNA, 966 bp, Neocallimastix californiae
  FAMILY NOT NAMED
tgtaattcaacaagttagacctgatttctactttggtgtttctacagcctctcatttctttgctaacccaaagtacaatgatattatttctacttacaacttacaagttgctggtaatgaatgtaaattctatacttttaacggttctcaaactttcaacacaaagccatgtgatgacactgttgctttcgctaagaagtatggagctaagttccgtggtcacaatcttttctggccagcttactctccacaatggttccaagatgctcatgatggtagtgacccagaagctgtaaaagaatacattcttgactatgttgctaaggttttagatcattacaaggatgaagaagatattatttactgggatgttattaatgaatctgttactgacgattctactgctaagaacatcaagttacgtactggttctgataacagtaatgaattcgaaggttgggatacttacacagaagatattttcaaggttgctcgtgaacacaccaacgaaaatgtaaagttattctataacgattacaatgccgaagcaaacaatggaaactttgatggaaaaactggtgctgttttcgaatacatcagatctatgagagaaaagggtgtcccaattgatggtgtcggcttacaaatgcacgtttcctgtaattggactccaaattatgaacaacttacaaagttaatttctcaatatgaagaaattggcgttgaagttcatattactgaaattgatgttaaaagaactcaatgtaaatctgctgaagctcaaaaagaagttttcatgaacgtcttcaaagcttgtttcgatcatgaaaactgtaaggtcttcactgtttggggttcctacgatgaagaatcctgggttggtgttgaaaatgaaccagttctttttgatgttgatatgtatccaaaggacatttactttgatatgttggactacgttttagaaaa

SEQ ID NO: 22911 - DNA, 327 bp, Neocallimastix californiae
  FAMILY NOT NAMED
tggtcgtatgagaactaatgttcgttacaagtctggtaagttcgaagttcgtgctaagatgccaattgctagtggtttagttccagctatttactttgcctctactccagataacactaacggtaaccaagatgaatttgatttcgaattaattggaagcaaccgtatgcaaactaatttattcatttatggtaatggtggtcgtgaacaagtttggaacccaccaaccgatttatctaaagatttccacctttacacctttgaatggaattcaaattccattgttttaaaggttgataaccaagttattcgtaccttcaataatcc

SEQ ID NO: 22912 - DNA, 636 bp, Neocallimastix californiae
  FAMILY NOT NAMED
atatactggtgatggtaccacttatggtgatccacttacaggaggttattgtatgatgccagattctgaagcttacacgaaagatatgatgtttgctgctatgaatttaccacaatataatatttctgctggatgcggaagttgtcttattttagctcaagctgataaaccagaaagagttatcagagttcgtgttgtagatcgttgtggtgaatgtccaaagggtgatattgatcttagtaataccgcttggaaagctttaactggtgattttattccaggtcgtgtaaagattatatggagtattgttccatgtaccgaaacttggtatgattacccacctttagttgaagaagattctccaataaaattaaaatggaagatggcttcttcagtatactggggtggtattcaagcttttaatactcgttatccagtcacatctattgaacgttgggatgatgcatctaatgattgggttcatcttagaagggatgatatgtttcattatatgtgggataccactattccaggtggtccaatgaaggtacgtgtaactcaaggtgatggtgttcaagttgttgttgatggcttaactattgatggttcatggtatgatgttgatgataattatac

SEQ ID NO: 22913 - DNA, 951 bp, Neocallimastix californiae
  FAMILY NOT NAMED
tgcttatgctgatgcctatgaccttttaaaggattattctaatggttttagaattggtgctgccaccaacactagattctacaacaatggtaactacgttaatgccatgaaggctttcaactatatggttgctgaaaatgcttgtaagtttgttagtattcaaggtacaaagggtaaattcaacttcaatgactgtgataatcacctcaagaaagctaaggaattaggtatggacttcagaggtcacgcccttgtttggcactctatggctccagattggcttaaaaatgaagattcaaaaactatgagacaatccatcgttaaccacattactaaggtcttacaacactatgacggtaagattgatacctgggatgttgttaatgaagctattgatgatgattccaatggtaatggctggaaataccgtaactccttcctttaccaaaagaacagagatttcattgatcttgctttcaagaccgctcgtcaagttgctccaaaggttaaacttttctacaacgactacaacaccgaaggtatttggggcaagagtgaatctgtctaccaatttattgctgacttaaagaagcgtaacattccaattgatggggtcggtattcaataccacgtcagtgtcaagaaccaaccccaattaaacaaaattactgacttaattggccgttactgtaagttaggccttgaggttcacattaccgaaattgatgtcagttgtgaaggtgcctgtaacaacggtgatgttcaaaaccgtcaagctcaagtcttcacaaatgccttaaaggcttgtcttgccaactcctgctgtaccgcttatcttgtttggggtattggggataatgacagttggttaggtgctgataagaagggtttacttttcgatggtagttacaagccaaaagctcaatacactgccctcttaaacaccttaaa

SEQ ID NO: 22914 - DNA, 816 bp, Neocallimastix californiae
  FAMILY NOT NAMED
agaattctgtaaagaaaataacattaaaatgagaggtcacactttagtatggcatgttcaaactccagaatggttcttccgtactgactttagtgatagtggttcatatgtcaatgcagccaagatggaaaagcgtatggaaagttatattaaacaaatgttagaattcgttcaatattattatccaggtattgttgatgtttgggatgttgttaatgaagctgttgaaattgaaggtggtagttatgatgcctcaactggttggaatactcgtactagatataatggtagtccaaatccatggtatactactatgggcgctgactatgttattaaggctttccgtattgctcgtaaatatgctgacaaaaatgttaaacttatttacaatgattacaacacttttatgtcacaaaagactactgctatttgtaatcttattaaaaaattaaaggctgaaaacttagttgatggcgttggtcttcaatcttacttaaatgccgactggccaaatcgtaatgactataagactgctattcaaaagtttgctgctcttggtgttgaagttcaagctacagaattaactattagaactgatggtactgcaaataaatataatactcaagctaaacattatgaagaagttttcaagatttacaaagatttgaagaagagtggtgtcaatattactagtgttacagtctttggcttacaagatggttatttattttataataatgattcaactgatacacgtttatgggaccataatcttaagaaaaaaccagtttacaattctattatgaaagtattatc

SEQ ID NO: 22915 - DNA, 966 bp, Neocallimastix californiae
  FAMILY NOT NAMED
tgaaattattaaatatcaatttaattctgtaactttcactaatcttatgaaagctgaatttatgttagataaaagtgcttctcaagccaacgctagaaatggtaatgatatgccagttttaaagtttgatacaattgttgatggtttagaattctgtaaggaaaataatattaagatgagaggtcacactttagtttggcacactcaagctccagaatggttcttccgtactggatttaatgataacggtagttatgttgataagaacaaaatggaaaaacgtatggaaagttacattaaacaaatgttagaatttattcaatattactatccaggtgtcattgatgtatgggatgttgttaatgaagctgttgaaattgctaacggtagttatgatgcttcatccggatggaatactcgtactaagtttgataacaacaagactaatccatggtatgcaactatgggtcctgactatgtatttaaggctttccgttttgctcgtaaatatgctgataagaatgtcaagcttatttacaacgattttaatacattccaatatccaaaaactgataatatctgtaaccttgttaagaaattaaaggctgaaaacttaattgatggtgttggtctccaatcttacttaggtccaagttggccaaatcgtaacgattacaagaacgctattcaaaagttcggtgctcttggtgttgaagttcaaattactgaattaactattagtgttgaaaatggtaataacaaattcactacccaagctaatcaatatagagatgttttcaagatctataaggacttaaagaaaagtggtgttaacatcactagtgttactgtcttcggtttacaagatcattacttattctatgataatgataatactgaaactcgtttatgggatggtaatcttaagaagaagccagtatacaatgctattatgaatgtattaaa

SEQ ID NO: 22916 - DNA, 1044 bp, Neocallimastix californiae
  FAMILY NOT NAMED
agaaggttttgttcaaacggatggaactaattttgtagtggatggttgtaaacgttatttctctggttctaatacctactatttgatggtatcaagtcatgaaagagtggatttagctcttgaagcttatgctagacataatctcaatgttgttagagcttgggctttctgtgatgaatgtgaagacgccacaagattagtcgatttctctggtccagaagttaagcttaactccttaaatatggaaaaggttgattattatcttgcagctgctgctcaaagaaatattcgtgtggttttaactcttactaacaattggactgattatggtggtatggatgtttgggtcaaaaagttcggtggaaaatatcatgatgaattttataccaacagaaaaattattgaaggttataaacaatatattaaagctatgattaaccgtgttaacacatacaccggtcaattatataaggatgatccaactattttctcatggcaacttgctaatgaagctcgttgtaacaatggtccacatggtcttccagttaaaaattgtaatacggatactattacaaagtggatggatgaaatcgctacttttatccataaagaagatccaaatcatttagtttcttctggtattgaaggtattggtcttactccaccagctggtgttgatccatatacttatgtatacacttatactgaaggtactgattatgaagctatcagtgctcttgattctattgattataatactgttcatatgtatccagttggttggggattaaaagattatgccaaagatggtgttacttggattcaagctcatgctgatgtcgataaaaaatttaacaaaccaacagttgttgaagaatggggtctcagtacttcagttgataatgttccaattaaagagcgtgatccaatttatactcaatggatgaatgcagttttagctaatgataatattggaatgaatatgttctggtatgtctgtggtgaagattattatggaacagatggctacttattagaagatga

SEQ ID NO: 22917 - DNA, 834 bp, Neocallimastix californiae; identical to SEQ ID NO: 13987
  FAMILY NOT NAMED

SEQ ID NO: 22918 - DNA, 945 bp, Neocallimastix californiae
  FAMILY NOT NAMED
taatggttatgaactcttaagagatgccgccaagggtttcagaattggtgctgctacaaacactattcactataataatccaaattatattaatgctatgaaggctttcaattatatggttgctgaaaatgcttgtaaatttgtaagtattcaatacactaaaggtaaatttaactttgacgattgtgataatcacttaaagaaagctaaggaattaggtatggctttcagaggtcatgctttaatatggcatgctatggctccaggttggcttgaacgtgaagatggaaatactatgaaacaatctattattaatcatattaccactgtattaaagcattatgaaggtaaaattgatacttgggatgtcgttaatgaagctcttgatgatagttctaatggtaatggttggaaacttcgtaattctttcctttatcaaaaggttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaaattcgaaaaaattaacaatttaattagtcgttactgtaaattaggtgttgaagttcacatcactgaattagatgtcagttgcgatgacaactgtcgtgacgcagacggtggtgagagcaagcaaggacaagtttacactaatgccctaaaggcttgtcttaataattcttgttgtactggtttccttgtttggggtattggtgataaggatagttggagaggtgttgaaagtaaaccattacttttcgatgctaactaccaaccaaagggtcaatacactgctatattaaacactttaaa

SEQ ID NO: 22919 - DNA, 693 bp, Neocallimastix californiae
  FAMILY NOT NAMED
tgctatggctccaggttggcttgaacgtgaagatggaaatactatgaaacaatctattattaatcatattaccactgtattaaagcattatgaaggtaaaattgatacttgggatgtcgttaatgaagctattgatgatggttctaatggtaatggttggaaacttcgtaattctttcctttatcaaaaagttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaagttcgaaaaaattaatgatttaattagtcgttactgtaaactaggtgttgaagttcatatcactgaattagatgtcagttgtgatgacaactgtcgtgatgcagacggtggtgacagtaagcaaggacaagtttacactaatgccctaaaggcttgtcttaataattcttgttgtactggtttccttgtttggggtattggtgataatgatagttggagaggtgccgaaaacaagccattacttttcaatactaattatcaaccaaagggtcaatataccgctgtcttaaacacattgaa

SEQ ID NO: 22920 - DNA, 954 bp, Neocallimastix californiae
  FAMILY NOT NAMED
tgctgctgctaatggttatgaacttttaagagatgccgctaatggtttcagaattggtgccgctaccaatactattcattacaacaatccaaattatattaatgctatgaaggcttttaactatatggttgctgaaaatgcttgtaaattcgttagtattcaatataataaaggtagatacaactttgatgattgtgataatcatttaaagaaagctcaagaattaggtatggctttcagaggtcacgctttaatttggcatgctatggctccaggatggcttgaacgtgaagatggtaacactatgaagcaatctattattgatcacattactactgtattaaaacattatgaaggtaaaattgatacttgggatgttgttaatgaagctatcgatgatggttctaatggtaatggttggaaattacgtaattctttcctttaccaaaaggttccaaactttattgatattgctttccaaactgctcgtaaggtctcaccaaaaactaaacttttctacaatgattacaacactgaaggtatttgggccaagagtgaatctgtttatcaatttgttgctgatatgaaaagacgtaatattccaattgatggtgttggtattcaatatcacgttggtatcaatgttcaaccacaattccaaaagattaatgatttaattggtcgttactgtaagttaggagttgaagttcatatcactgaattagatgtcagttgtgatgataattgtcgtgattgggatggtggtgaaagtaaacaaggacaagtttacactaatgctttaaaggcttgtcttggtaattcttgttgtaccggtttccttgtttggggtattggtgataaggatagttggagaggtgaagaaaacaagccattacttttcaattctaactatcaaccaaagggtcaatacacagctatcttaaatactttaaa

SEQ ID NO: 22921 - DNA, 948 bp, Neocallimastix californiae
  FAMILY NOT NAMED
tagtagtagcactcttcttagagatcatgcaaacggcttcagaattggtgctgctgctaacacaatgtactttaacaaccaaagttatatcaatgccttaaagtctttcaactatatggttgctgaaaatggttgtaagctttcaggtattcaacaacaaaaaggtgtttacaatttcaatgattgcgataatcacttaaagaaggctcaagaattaggtatggatttccgtggtcactgtcttatctggcacgcttaccaaccatcttggttcgaaaatgctgatgctaatactttaaagaacgctattgttgatcatattactaagactttacaacattatgaaggaaagattgatacttgggatgttgttaatgaagctattgatgatagttctaatggtaatggttggaaaatgcgtaactccttcctttatcaaaaggttccaaactttattgatttagctttccaaactgcacgtaaggtttctccaaacactaaacttttctacaatgattacaatactgaaggtatttatggaaaatctgaatctgtttaccaattcgttaaagatttagtttcacgtaatattccaattgatggtgttggtattcaatatcacgtttctgtccaaagtcaaccacaatataacaagattaacgatttaatttctcgttactgtaaacttggacttgaagttcacattactgaacttgatgttaaatgtgataatcaatgttatagtggtaatgttgaacaacaacaagctacagtctttactaatgccttaaaggcttgtcttagtaactcttgttgtactggttaccttgtttggggtgttggtgacaacaattcatggttaggtagtgataagaagggtttacttttcgacggtaactacagaccaaaatctcaatacactgctgtccttaacatgttaaaggaatt

SEQ ID NO: 22922 - DNA, 834 bp, Neocallimastix californiae; identical to SEQ ID NO: 13988
  FAMILY NOT NAMED

SEQ ID NO: 22923 - DNA, 2379 bp, Neocallimastix californiae; identical to SEQ ID NO: 14533
  FAMILY NOT NAMED

SEQ ID NO: 22924 - DNA, 909 bp, Neocallimastix californiae; identical to SEQ ID NO: 17628
  FAMILY NOT NAMED

SEQ ID NO: 22925 - DNA, 2157 bp, Neocallimastix californiae
  FAMILY NOT NAMED
agggttaattttattatgcattccagcatgtttttctgttgaatataactggtataacactaaaattggtggtggtggtttcgtcaccaatttaatttacaatccaggagaggaaggattattatatttaagaactgatatgggtggttcttaccgttatgatcaaacaaacaaatcatggattccaattcaagatgtttttggtggtagtgaatggtggttattcggttgtgaaagtttaggtgttgatactaaagaaccaaatcgtgtatatattgcagctggtacttacatgagttatggtgaaaatggtgcaattattagttcagatgattatggtaagacttggaaacatcgttgggatgccccattccactttggtgctaatgatgatggtcgtggtcgtggtgaaagacttgctgtcaacccagttgataataacatcattttcttcggtacaagaaagaatggtttatacaagtctactaactatggtgaatccttcgaaccagttaaaggttttccagctgaccatgatataccatttattcttttcgttccaggttctaagggtaaaactgtaattgttgctacagatgatactaaggctccattatacatcagtaaggatggaggttcctcctttgataaaattagtggtcaaccaaatattggttacttcccacaacatggtgctttcagtgctgatggtaaatacttatacgttacttatgctaattctattggtccaaatggagctactcaaggtgatgtttaccgtattagtcttccagatttcacttttaaggaaattactccagttcacggttcatacgaaactcagcaatttggttacactggtgttcaaaccagtggtactaacgcaggagttgttattgtttcaaccttaaacttatggtggccaagtgatgaagtttacatgagtactgattatggtgagacttggtcagaaggtgttgctagtcatgctgaattagatattagtgaatacccatggcttgatttcggtaaggaagataacttaaagttcggttggtggattgctgccttagctatggatccattcaatgatgataatgtttcctacggtactggtgctactgtttacactacaaccgaattcactaaagctatgaagaatgaatcaactcactgggctccaaatgttgtcggttttgaagaaacagccattaatgatattgaagctccaccatctggtccaggaattccaaaacttttgactgctttaggtgatcttggtggttttactcaagatgatattaatgaagccgtagaaatgtgggtcaatccaacttacaccactggtaactctgttgaatatgctgtctctaaccctaagattgttgtctcttgtggtactgataatgctgcttactctactgatggtggttacacctggactccaatgaagactttaccatatgaaaaggctactggtggtcatattactatttctggtgacggtaaggttgttacctggattccaaatcaatctcaaattccatactacactactgataatggtgccacctggactgctgttgatacttgtaagaattgtaaccaagttcgtccagatggtaagaatccaaaattaatgtacggtttcgattaccaaaccttatacattagtgaagatggtggtaagacttatattaagcaaggaggaaatatgggagctggtcaattaatgtcaccatacaatgtagaaggtcacttatggttagcttgtacctactggggaggtgttcaattctcatctgatatgggtaagacctttaaggaagttgatccaaaattcaaatctgctgattctgttggttttggtaaggctgctccaggatctgatgctccatacactgtttatattgttggtaaatatgatgattactatggtgtctaccgttccactgatcttggtagcacatgggaattacttaatgatgattctcatcaatggggtgtttacaatagtaaggttattggtgatccagatattttcggtcgtgtttacattgctaccaacggtagaggtgttgttgttggtgatgatactagtgttgttagtgatggaggccatagttctggaagtaaaagtagtagtaacaatagtaa

SEQ ID NO: 22926 - DNA, 714 bp, Neocallimastix californiae
  FAMILY NOT NAMED
agctattgattattttattgctgctgcatctcaaagaaatataagattggtgctaggttttacaaataactggactgattatggtggtatggatgaatgggtaaaaggttttggaggaaaatatcacgacgatttttatactaataaagaaattcgtaatgcatttaaaaggtatattaaaactgtaataactcgtattaatcgtcatactaatattcgttatagagatgatccaacaattttttcatggcagttggcaaatgaaccaagatgtggtaatggtccatctggacttcctcaatcagggaagtgtactccggaagttattactgaatgggctgatgatattagttcgtatattaaagaattagatccaaatcatcttgtctcagttggtgttgaaggttttggtcttgaagcacctaaaggatctaaaggattatatgcatataaatatgatgaaggaactgattttgaagcattaaccgcattaccaaatgtagattataatacatatcattattacccaattccatggggaatgacagacttaatttctcatactaaagattggattgaatcacatcaagctgttggaaaaaaattaaataaacctgtagtttttgaagagtggggtcttgaagtaccgaccgattgttcaaaagaagaacgaattcaatattataaaacttggacaaaacaaattcttgatgc

SEQ ID NO: 22927 - DNA, 951 bp, Neocallimastix californiae
  FAMILY NOT NAMED
tagtggtagttacgaacttcttaaagactatgctaatggtttcagaattggtgttgctgctaacactatgaaatttaataatcaagcctataatgaagccttaaaagcctttaattatatggttgctgaaaatggttgtaaattgtctggtattcaacagcaaaaaggtgtttacaacttcagtgattgtgataaccacttaaagaaagctaaagaattaggcatggacttccgtggtcactgtcttatctggcactcataccaaccatcttggttcgaaaatgctgatgcaaacaccttaaagaatgctatcgttgatcacattactaagactttacaacactatgaaggaaagattgatacttgggatgttgttaacgaagctattgatgacagttctaatggaaatggttggaaaatgcgtaactccttcctttaccaaaaagttccaaactttgttgatttagctttccaaactgctcgtaaagtttctccaaatactaaacttttctataacgattataatactgaaggtatttatggtaaatctgaatcggtataccaatttgtaaaagatatgatttctcgtaacattcctattgatggtgtaggtattcaatatcatgtttctgtttcaagtcagccaaaatacgaaaaaattaatgatttaatttcccgttactgtaaacttggtattgaagttcatattactgaactcgatgttaaatgtgataatcaatgcaacagcaataatgttgaacaacaacaagctacagtcttcactaatgctttaaaggcttgtttcagtaattcatgctgtaccggttatcttgtttggggtgtaggtgataatgatagttggttaggttctgacaagaaaggtttacttttcaatagtaactacaagccaaagtctcaatacaccgctattcttaatttcttaaaagaaaa

SEQ ID NO: 22928 - DNA, 1014 bp, Neocallimastix californiae
  FAMILY NOT NAMED
tgctagtattgaaaattctactgtttcatctaaaactatgagagaagttatcaaacatcaattcaattctgttacttactcaaaccttatgaaatcattatttattcttaatcaagaaggtagtattaagaatcttaaagaaggtaaacaagatccagctttagatttcagtggtattgttgatggtttagatttctgtcaaaagaatggtattcacatgagaggtcatgttttagtttggcacaaccaagtcccaagatggttcttcaccaaagattattctgaagatggtgaatttgttgatccagaaactatggaataccgtttagatagtttcattagacaatatcttggttttgttcaatactactacccaggtgttgttgatgtttgggatgttgttaatgaagctgttgaagttgttggtgaacaatatgataattctactggttggtacactcgtactttatatgatgaagttaaaccaaacatgtggtatgatatgtttggtccagattacgttgttaaaactttccgtattgctcgtaagtatgcccttccaaatgttaaattagtttacaacgattactgtacttatgtcactaaaccaattagtaagagagatgctattgttaaacttcttggtattttacaaaaggaagatttagttgatgctattggtatgcaatcctacatcaacccagaagaagatgttaatgaccatttagcagctattgaagtataccaacaaaccggattagaaattcaaattactgaattaactattcgtgttaagaatactgatgactgggaagaatacaatattcaacaatacagtcaactctttgaaggtattatgaaatatgttagaaagggttacaatattggtagtgttactgttttcggtttacaagatggatacagattctatgaaaacgattccaccaagactcgtctcttcgatcacgatcttcaaaagaagaaggtttaccgtgctattatggatatcattaa

SEQ ID NO: 22929 - DNA, 825 bp, Neocallimastix californiae
  FAMILY NOT NAMED
agattttgctttaaagaataatattcacgttagaggtcatgtattagtatggcacacccaaactccagattggttcttcagaaaaggattcaattctgaaaatgaatttgctgatgttgaaactatctatcaacgtttagaaagttatattcgtcaatatcttggatttgttcaacacaattatccaggtgtcattgatgtttgggatgttgttaatgaagctattgaaattaatgatggatatttcgataactctactggatggtataccagagtctctactcaaactgaagaaagtttatggtataagattgttggaccagattatgttaagaaaacatttgaaattgctcgtaaatacgctcttccaaatgttaaattagtttacaatgattacaatactttccaaacctatccacatgataaaactcaagccatcattgatcttatgaatattttaagaaaagataatttagttgatgctcttggtatgcaatcttatattggtgaaacttggccaaagattgaagaatatgttagagccattgaacgtttcactgaagctggtttagaacttcaaattaccgaattaaccattaccccaccaagtggagaaggttggttagaaaaacaagctcaacaatatcgtgaattctttgaaaaagttatggaacaaattaataagggagctaatattaccagtgttactgtatttggtattcaagatggatatagattctacacctctgacagtactaagactcgtcttttagatcatgatcttcaaaagaaaccaaattacgaagccattatggaagttttaaa

SEQ ID NO: 22930 - DNA, 966 bp, Neocallimastix californiae
  FAMILY NOT NAMED
tgacgtaatcgcctatcaatttaattctgttaccttcactaatcttatgaaagctgatcaaatgttggataaggccgcctctcaagctaacgccagaagtggtaatgatatgccagttttaaaatttgattccatcgtggatggtttagaatactgtaaagcgaataacatcaagatgagaggacataccttggtttggcatgttcaagctccagaatggttcttccgtactggatttaacgataatggtaactatgtggataaaaataaaatggaaaaacgtatggaaagttacattaaacaaatgtttgaatttgttcagcactactatcctggtgtagttgatgtctgggatgtcgttaatgaagcggtcgaaattactaatggtagttttgatgcttcctccggttggaatactcgtactaaatatgataataataaaacaaatccatggtatgctaccatgggtcctgattatgtcttcaaagctttccgttttgctcgtaaatacgccaataaagatgttaaactcgtctataacgacttcaatacttttatgtctcaaaagacaaatgccatctgtaatcttgtaaagaaattaaaggctgaaaacttaattgatggtgttggtcttcaatcctacttaggtccaagctggccaaatcgtaatgactataagaatgccattcaaaagtttagtgctctcggtgttgaaattcaaattaccgaattaaccattagtgtcgaagaatccaataataaattcaatgctcaagctaatcactacagagatgtcttcaagatttataaggatttaaagaaaagtggtgttaacattaccagtgtcactgttttcggtttacaagatcactacttattctatgataatgataagacagaaactcgtttatgggaccgcaatcttaagaagaaacaagcttacaattctgtcatgagtgtcttaaa

SEQ ID NO: 22931 - DNA, 966 bp, Neocallimastix californiae
  FAMILY NOT NAMED
cgttattcaacaagtcagaccagatttctattttggtgttgcaactcaaaaaactttctttgctaacccaaaatacaaagatatcatgtcaacttttaatttagaagttggtggtaacgaatgtaaattctatactataaatggatctgaaactttcaacactaaggcttgtgatgaatctattgcttttgctaagaaacaaggtgctaagtaccgtggtcacaatcttttctggccagctaattctccaagttggtttaagagtgcttacgatggtaaagacccagaagaagttaaggaatacattcttgactacattacaaaggttttagatcattacaaggatgaagaagatatcatttactgggatgttattaatgaatcagttaccgatgattctaccccagaaaatattaaattacgtaccggatccgatactagtaatgaatttaagggttgggatacctatactgaagatatcttcaaacttgctcgtgaacacactaatgaaaatgttaaattaatttacaatgattataatgctgaagctaatggtggaaacttcggtggtaagactggtgctgtattccaatacattaaatccatgaaagaaaacggtgttccaatcgatggtgttggtttacaaatgcacatttcttgtaattggactccaaattacgaagaacttactaaattaatttctcagtatgaagaaattggtgttgaagttcatgttactgaaattgatgttaaaatggagaactgtaaaactcatgatgatcaaaggaaggtatacatgaacatcttcaaagcttgtttcgatcatgaaaactgtaaagtcttcactgtttggggtgcttacgattctgaatcatgggttggtgctgaaaacgaaccacttattttcgatgaagatatgtatccaaaggacatttactttgacatgttagattacgttatcgataa

SEQ ID NO: 22932 - DNA, 951 bp, Neocallimastix californiae; identical to SEQ ID NO: 17629
  FAMILY NOT NAMED

SEQ ID NO: 22933 - DNA, 2172 bp, Neocallimastix californiae
  FAMILY NOT NAMED
attgtcgtataaatggaagaatgctgaaattgttggtggaggttttgtaccaggtattgttttcagtgaggctgaaaaagatttagtttatgctagaactgatattggtggtttatatcgtttaaataaatccacaaagagatgggaaaatttatcagaatgggttggagttgataattggggttatgctggtattgatactatgtgtgcagatccagtggatgcaaatagagtttatgctgctgttggtatgtatactaatgattgggatccaaataatggtgctattatttcatcaacagatcgtggtgataattggtctatttctgaattaccattcaaggttggtggtaatgatccaggtcgtggtatgggtgaaagaattgctgttgatcctaacaataataaaattcttttctttggtgctcgtgctggtaaaggtttatggaagagtacagattatgctaaaacttggtcacaagtcaagagttttactaatgtaggtaaatatgctgcagataatcaatacttcaccgaagccatcggtatttcatttgtaacttttgatcgttatagtggtaaaaagggttctccaaccccaaatatttatgttggtgtagctgataattccacatcaacagtttatgtttcaaaggatgctggtgtatcatggactgcaattcctgatcaaccagcccattatttcccacataaaggaaagattactgaagatggtatgctttacgttacttatactgatggttgtggtccatacgatggtcaagctggtgctatttatcgttacaatactaaaactggagaatggaaggatatcagtccacatcaagaaccatactttggttatggaggtttggcaattgatgctcaaaatcaaaagacccttgttgtagctactttgaattcatggtggccagatgccattttattccgttctactgatggtggtgatacttggtctcatatttgggaatgggatggctatccacaacgtaagcttaaatatgaaattgatccatctatttctccatggattgaagatgatatgaaacaaattccagaacctaccacaaagttaggttggatgattgaatccttagaaattgatccatttaattctgatcgtattatgtggggtacaggtgccactatttggggttctgaagatcttacgaattgggatagtggtaaaaaattccatatttcagttatggcttcaggtattgaagaaacttccgtacaagatttagtttctccagctacaggagatgctcatttattgagtgttatgggtgatattggtggtttcagacacacagatttagataaatgtccagaaattaatttcagatcaccaaccttcactactggttattctattgattatgctgaaaatgttccaaacttctgggttcgtgtaggtacagaaccttatattgctatttcttggggtaatggtgaatcatggtattctggtcaagccccaggtggtgtaacggaaggtggtattgtagctgttggtgctgatggagatgtcgtttgggctccaaaaccttatgatttaggtgtcttctacggtaaggaatctttcaaatcttccaagggtattccaggtggtgccagaatttgttcagatcgtgtaaatggtaagattttctatggttaccttggagataccttctatcgtagtaccgataccggtgtcaccttctctaaagtttacacaggacttccagaaattgaaccaggttatgctaaaaatattaaggccgtagctggtcatgaaggcgatgtttggcttgccggtaataaaggtggtctctaccatacagaagatggtggtgaaacatttacatcaattgatggagtcgaaattgctaataccattggtttcggtaaggctgcagaaggttcagattatccagcactttacattaccggtaaaattggtaatgttaatggtattttccgttctgatgataagggaaagaattgggttcgtattaatgatgacgatcatcaatatggtactatcaatttctgtattacaggtgatccacgtatctatggtcgtgtctacgtttgtactaatggttatggtattgtctatggtgatatcgatggtgattctggtactccagttagtggctccgg

SEQ ID NO: 22934 - DNA, 1044 bp, Neocallimastix californiae
  FAMILY NOT NAMED
agaaggttttgttcaaactgatggcaccaacttcgtggttgatggttgcaaacgttatttctctggttctaatacatactatttaatggtatcaaatcacgaaagagttgatttagctcttgaagcttatgctagacataatcttaatgttgttagagcttgggctttctgtgatgaatgtgaagatgctacaagattagttgatttttctggtccagaagttacccttaatagtgaaaacatggaaaaggttgattattatcttgctgcggctgctcaaagaaatattcgtgttgttttaactcttacaaataattggactgattatggtggtatggatgtttgggttaaacaatttggtggaaaatatcatgatgaattctatacaaatagaaaaattgttgaaggttataagcaatatattaaagctatgattaatcgagttaacacttacactggtcaattatataaggatgatccaacaattttctcatggcaacttgctaatgaagcccgttgtaacaatggaccacatggtcttccagttaaaaattgtaatactgatactattacaaattggatggacgaaattgcttcatttatacatcaagaagatccaaatcatttagtttcttctggtattgaaggtattggtcttactccaccatcgggtgttgatccaaatacttatgtttatagatatgatgaaggaactgattatgaagctattagtgctcttgattctattgactataatactgttcatatgtatccagttggatggggactaaaggattatagcaaagatggtgttacatggattaaagcccacgctgatgttgataagaaatttaataaaccaactgttgttgaagaatggggtcttagtacttcagcagataatgttccacttgaagaacgtgatccaatttatacaaaatggatggatgctgtattggctaatgataatattggtatgaatatgttctggtatgtttgtggtgaagattattatggaactgatggttatttattagaagatga

SEQ ID NO: 22935 - DNA, 2208 bp, Neocallimastix californiae
  FAMILY NOT NAMED
gaaaacattagctttaactcttttagggttaattacattatgcattccagcatgtttctctgttgaatataactggtataatactaatattggtggtggaggtttcgtcaccaatttaatttacaatcctgcagaggaaggattattatatttaagaactgatatgggtggttcttatcgttacgatcaagccaacaaatcttggatccctattcaagatgtattcagtggtagtgaatggtggttatttggttgtgaaagtattggtattgatacgaaggaacccaatcgtgtctatattgctgcaggtacctacatgagttacggtgaaaatggagccattattagttctgatgactatggtaaaacttggaagcatcgttgggatgctcctttccactttggagctaatgatgatggtcgtggtcgtggtgaaagacttgctgtcaatcccgtcgacaataacatcatttactttggtaccagaaaatctggtttatacaaatcaagtaattatggtgaatcttttgaacaagtaaaaggattccccactaaccacgatattccattcattcttttcgttccaggttctaagggaaaaaccatcatagttgctaccgatgatacgaaggcaccactgtacataagtaatgatggtggttccagtttcaagcaaattagtggccaaccaaatatcggttactatccacaacatggagctttcagtgctgatggtaaatatttatatgttacctatgccaattctattggtccaaatggagccacacaaggagacgtttaccgtatcagtcttccagattacaaatttaaggaggttactccagttcatggatcctatgaaacacaacaatttggttacaccggggttcaaaccagtggtactaatccaggtgttgttattgtctctaccttgaatctttggtggccaagcgatgaattgtacatgagtagtgactatggtgagacttggtctgaaggagttgccagtcatgctgaattagatattagtgaatacccatggcttgatttcggtaaagccgacaatttgaaatttggatggtggatagccgccttagccatggatcccttcaatgataataacgtttcctacggtactggtgctaccgtctacaccaccacggatttcactaatgcaaagaagaatgccgttacccattgggctcctaatgttcgtggatttgaagaaacagctattaatgatattgaagcaccacctgctggaccaggtattccacaacttttaactgcattgggagatcttggaggtttcacccaagatgatatccatgaaaccgtagagatgtgggtcaatccaacctacaccacgggtaactcagtagaatatgcagtctccaaccccaaaattgtagtttcctgcggtactgataatgcagcctattccaccgatggaggtcactcctggacaccaatgaaatccttaccctatgaaaaggccactggtggtcatattaccatttcaggggatggtaaggtagtgacctggattccaaaccaatcacaaaagccatactacaccaccaactatggtgcctcttggactgcagtcaacagctgtaataactgtattcaaattcgaccagatggtaagaatccaacgttgatgtacggttatgaccatcaagatctatacatcagtgaggatggaggtaaaacgtacaagaagcaagcaagcaacatgagttccggacagttgatgtcaccctatgaagttgaaggtcatttatggttagcctgtacctattggggaggggttcaaatatctacggataagggtaagaccttcaaggaagttgatccaaagtttaaaacagcagattccgttggttttggtaaggccgccccaggttccagcgctccatatacagtttatgttgttggtaagtatgatggatactatggtgtttaccgttccacagatcttggtagtacttgggaattacttaatgatgattcacaccaatggggagtctacaacagtaaagttattggagatccaaatattttcggacgtgtttacgtggctactaacggtcgtggtgttattgttggagatgataccagtgttactggtaatggtggtagtaaaacaaagacctcaagtaaaactaccacaaccaagagaccctctagtacttccatttccaa

SEQ ID NO: 22936 - DNA, 648 bp, Neocallimastix californiae
  FAMILY NOT NAMED
atatacttttgttgatggtccaatttacagtggtgatggtacagcttatggagatgccacttcaggtggtaattgtttattcccaaagaaggaatactataatgatatgatgtacgctgctctcaacaataaacaatacaatacagatatgggttgtggtctctgtgcagtagtagtttcaactagtaacccatacaaaccaattagagtacgtattattgatcaatgtccagaatgtgctcacggaagtttagatttcagtgataaggcttttaaggccctttcaaacaaaactccggatcgtattaagattacttgggctcttattccttgtgatgtcgatgtaaatgaattcccagctcttgtaaaaccaaattctgctattaaattccaatttaaatctggtagtacccaattctggggtgaagttcaagttttcaatactcgttacccagtcgctaaagttgaatttttaagtggcggtaagtatgttggcttatacagacgtgcttataattactgggctcttaattctggtggttttggtgcgggtccatacactttccgtgttaccttagctgatagtacagttattgaagctaaaaatgttaaaatggttattccaggtaatgatgaaggtgatgattt

SEQ ID NO: 22937 - DNA, 1014 bp, Neocallimastix californiae
  FAMILY NOT NAMED
tggtgctattgaaaactccacaacttcttccaaaacgatgagagaggttattaagcatcaattcaactccgttacctattctaacctcatgaaagcagtatttgtacttaatcaagaaggtagtattaagaatcttaagaaaggtaaacaagatccagttttagatttcagtacttttgtggatggtttagatttctgtcaaaagaatggtattcacatgagaggtcatgtcttagtttggcacaaccaagctccaagatggttcttcacgaagaactatgaagaagatggtgaatatgtagatgctaaaacgatggaataccgtttagagagttacattaagcaatatcttagctttgttcaattcaattacccaggggttgttgatgtttgggatgttgttaacgaagccattgaagttgttgataatcaatatgataaatctactggttggtacactcgtaccttatacggtaataactcaccaaacatgtggtatgatatatttggtccagattacgttgtgaagaccttccgtattgctcgtaagtacgctcttccaaatgtcaaattagtttacaacgattattccaccttcgtcaccaagccagtgagtaagagagatgctatcattaaacttcttggtattttaaagaaggaagatttagttgatgccattggtatgcaatcctatattaatcccgatgaagatattaatgaatatttagctgctgtggatgaataccaaaaaactgggttagaaattcaaattactgaattaaccattcgtgtgaagagtacggatgattgggaagaatacaatattcaacaatactctcagctctttgaaggtcttatgaaacgtgttaagaaaggttacaatattggaagtgttactgttttcggtttacaagatggttacagattctatgaaaacgatactcaaaaattccgtcttttcgatcacgatcttaaaaagaagaaggtctaccatgccatcatgaaaatacttaa

SEQ ID NO: 22938 - DNA, 1485 bp, Neocallimastix californiae
  FAMILY NOT NAMED
gggtgcttcctatcgtgttgaacatgtttatgcaggtgatttagatggtgatggtacctatgatttcgttgtgaagcgtatgtcagataatcgtgatcctattcttcttgaagcttataaattagatggtaccttcttatggcgtattaatctcggtccaaatattgaaacttacacttcctctctcactagtcctgtcttggtttacgattttgatggggatggtaaggctgaagttatggttaaaactggggagggtacagttttcggtgacggtactaaaattggtgatgtcaatcgcgatggtaaaacggattatcgtgaaaggaacagaactcagtaccaagttcttacaggtcctgaatttatttctatggttgatggtatgaccggtaaggaaattgatcgtgttaatttcattgaacgtggtaacaccaatgattggggagataactatggtaaccgtatgaactttattttcgttaccgttgcttatttagatggtaaggaaccttcgatggtccttagtcgtggtgctggtgatttaaaaaatagaaaagcgatcacagcttatgccttaaaattccaaaacaaaaaattcaccgttcaatggactttccgtattcttgattacaagaacaaaattcctgccggccacggtatggtcgaattccattccattcgtgcccttgatttagatggtgatggctttgatgaaattcatcttggtggttttgctatcgaccacaacggtaaattactctactctactgaattgggtcatggggatcgtttcattattgcagatattgatccaaaccgtaagggcctggaatactttgccgtacaacaaaaccgtgatgaccttcttggtacagctcttttggatgccgctactggtaaaacgatttggaaacaatatttaccttcgaaggctgatgtaggtcgtggtgatgccgcctccattttagatacctatggtatgcaatgttggagtagtagtttcccaggttattatgatgccaacagaaaacaactgactactactcgttccttcccatcacttagtatctggtgggatggtgatttaaaacgtgaattcttggatggtattggtaaggaaggttacaatcctgccattaacaagtggaacgcttctaatggtagtaatgatcgtcttttcactatctataatgatggaggtaactacagcgtcatcagtccttactcaggtcgtgtaccactctacggtgatcttattggggactggcgtgaagaagtggttttagaaaccgccaatcataaagaaattcgtatctatactaccaccattggtactgattacaccatctataccttaatgcataatccagcctatcgtaactgtgttaatgttaagggttaccttcaatcgactgaagtagattactacttaggttatggtgctgatattaagaaaattccaaagccagatatttatgttaa

SEQ ID NO: 22939 - DNA, 1107 bp, Neocallimastix californiae
  FAMILY NOT NAMED
aaagccaatcgccttccctggtgctgatggtggaggtaaatttgctactggaggtcgtggtggtgaagtttattatgtaactaatttaaatgatagtggtgctggttcatttagagatgcagtcagtagatcaaatcgtattgttgtttttaaggttagtggtaccattgaattaaaaagtgatgttgttgttaaaggtaatataactgttgcaggtcaaacagctccaggtggtcatggtgtcgttttaaagaatttcaaaattggtttaggtggaacaaatattattcttcgtttcattggatcaagaccaggtgaaagaggctcgaatgcagattatgatgcttttggtggggctgaaggaagcaacagtattgtagatcattgttccattggttgggctaatgatgaacaatggggtttatactctaaaagtgatgatatgactgttcaatattctgttattggtccatctaattctttctcataccacagtaaaggtattcatggttttgctatcatgcttggtcgtaagaatgtttcataccaccataatttaattgcacacaatgtttctagaaactttagaggtaaggtgccagataagaatgcatgtgattttactaataatgttatctacaattggggttcccaaactacttatggtaccattggtcacttaaattatgttggtaatactttaaaaatgggtccatcaacaaaaggtggacgtaattatgttagtgttgctgatagtggtacaaaaccagaaaattatttgatttatttaaccggtaatcgtttccttaatagtaataataccccttataatgatttttctaataataattggaaaggtatcacctataaaaataattccaaaaatgaaggaaatactaaatccaactctccattcgttatgaataatggaagtgataattcttcaacaattgctcatgttgaatctgcagaaaaagcttatgataatgttttagctcatgctggtaatggtatttctcctgataaaagaattgctattgataaacaatgtgcagccgaaactaagaatggtactggtagcttagttggtgcccgtccatataatca

SEQ ID NO: 22940 - DNA, 1029 bp, Neocallimastix californiae
  FAMILY NOT NAMED
tgttgatataaataattacactccaagttcaaagaaaatgatggaacttatcaagtatcaatttaactctatgacttattctaatggtatgaaaagtattaaaattatggatgaagaaggatctcgtaagaatatagccgaaggtagagaagaagttgctgttgacttttctggaattattgatggtcttgaatttgccaagaaaaatggtattcacattagaggtcacgtcttagtttggcacaaacaaactccagactggttcttcagaaaagattttgatactgaaaaggaatatgctgatgttgaaactatctttgttcgtttagaaagctacatgaaagctttctttgacttccttaacttcaattacccaggtgttgttgatgtctttgatgttgttaatgaagccattgaagtcagagaaggaaaattcgataactcaactggttggtacactcgtactgaatctcttgaaggtgatgacaatatttggaatactcttgttggtccaagttacgttgttagagctttccgtattgctcgtaaatacgctcttccaactaccaaattagtttacaatgatgttgataccttcatgactaagccacatgacaagacccaagctgttattgatctcatgaacatattaagagctgaagatttagttgatgcccttggtatggaatcttacattgatcaagacttagttaatgtagatgccccagaagactacgctcgtgccattgaacgtttcaccgaagctggtttagaaattcaaattacagaatttactatctacaatgatgatagagaagattggttagaaactcaaactaagagatacagagacttcttccaagttgttatagatcatgttaagaagggatatgataatatttctagtttcactgttttcggtttacaagatggatacagattctacgataatgatactcaaaaaactcgtctcttcgatcatgatcttcaaaagaagccaaactactatgccatcatggaaattttaaa

SEQ ID NO: 22941 - DNA, 2193 bp, Neocallimastix californiae
  FAMILY NOT NAMED
gctgaatatacactttttgattttattatctactttatgtattactttttcgtcagcttatcaatggaaaaatgcagaaattgttggtggtggttttattccaggtattattttcagtgaagctgaaaaagatttaatttatgctagaactgatattggaggtttatatcgtatgaataaatccactaagagatgggaaaatttattaaaatgggtcggcgttgataattggaattatggtggtgttgatactatgtgcgctgatccaatagattctaatagagtatatgctgcagttggtatgtatactaatgattgggatcaaaataacggtgctattatttcatcaaatgatcatggtgatacatggtctataactgaattaccatttaaagttggtggtaatgatccaggtcgtggaatgggtgaaagaattgctgttgatccaaatgataataaaattcttttctttggcgcccgtgctggtaaaggattatggaagagcattgattatgctaaaacttggtcccaagttaaaagttttacaaatgtaggtaaatattcaccaagtcctgaatatttcccagctgcaattggtatttcttttgttactttcgataaatatagtggtaataagggatcaccaactccaaatatttatgttggtgttgctgataattctacttctactgtttatgtttctaaagatgcaggtgtttcatggactccaattccagatcaaccagctcattacttcccacataaaggtaaaattactaaagatggtatgctttatattacttattctgatggttgtggcccttatgatggtcaagctggtgctatttatcgttacaataccaagactggagaatggaaagatattagtcctcaccaagaaccatactttggttatggtggtttagctattgatgcacaaaatcaaaagaatattgttgttgctactttaaattcatggtggccagatgctatcttattccgttctactgatggcggtgatacttggtcccacatttgggaatgggatggttatccaaatcgtaaattaaaatatgaaattgacgcttccatttctccatggattgaagatgatactaaacaaattccagaaccaactactaaattaggatggatgattgaatctttagaaattgatccatttaattctgatcgtattatgtggggtaccggtgcaactatttggggttccgaagaccttaccaattgggacaatggacaaaccttccatatttcagttatggcatctggtattgaggaaaccgctattcttgatttagtttcaccagctactggggaagctcatttaatgagtgttatgtatgatattggtggttttatgcatacagatttagatacttgtccaaaaacacaatttagaacaccaaatttttcttcaggtaattcaattgattatgctgaaaatgttccaaatttctgggttcgtgttggtaccgaaccatatatagcttattcttggggttcaggttcatcttggtatgctggtcatgctccaaatggtgttactgaaggtggtttagttgctgttggtgctgaaggtgatgttttatgggctccaaaaccatatgaactaggagtattctatggtaaggaatccttccaatcatctaaaggtattccaggtggtgctagaatttgttctgatcgtgttaacggcaagattttctatggttatcttggtgatactttctaccgtagcactgatactggtgctaccttcactaaaatgtacactggtctaccagaaattgaaactgggtttgccaagaacattaaggctgttgccgatcatgaaggtgatgtttggcttgccgctaataaaggtggtcttttccatactgaagatggtggtaagaccttcactcaaattaatggtataacgattgctaatactattggttttggtaaagctgctgatggttcagactatccagctctttatattactggtaaaattggagatgttaatggtattttccgttcagatgataagggtcaaaactgggttcgtataaatgatgataaaaatcaatatggcactataaatttctgtatcactggtgacccacgtatctatggacgtgtctacgtttgtactaatggttttggaattgtttatggtgatattgatga

SEQ ID NO: 22942 - DNA, 954 bp, Neocallimastix californiae
  FAMILY NOT NAMED
tgtaattcaacaagttcgtccagatttttattttggtgtagcaacatcgattgcttattcctctaatccaaaatataaggatattgtttcttcttttaatttacatgttggaggaaatgaatgtaaattctataccattcaagcttctaaaacccgaaatttctatcaatgtgatcagtcattgtcctacgcaaaaaaatttggagccaagtatcgtggtcataatctcttctggccagcaaattcaccaaattggtttaagacctacagtgatgatattgaagttactaaaagctatattattgactacattaaaagtgttttaaatcattatcgtgatgatgatagtattatctattgggatgttattaatgaatcagttatggatgaatccacctccaatgatattcaattacgtacaggttcaaaaactagtgatgaatttttgggatgggatacgtataccgaggatatctttaaattagcaagagataatatcaatgaaaatgtcaaattgatttacaatgattattattgtgaagccaataatggtaattttgatggaaaaacaggtgcagttttcaattacattaaaaatatgaaggaaaaggaggttcctattgatggtgttggtcttcaaatgcatgtttcttgtaatgacgcaccatcatatgatgatctttacctgttgatttcacgatatgaagaaattggagttgaagttcacgttactgaaattgacgtaaccatggctcgttgtaacagtctcaaagatcaaaaggatgtctatatgaatattttcaaggcttgttttaatcataacaactgtaaagttttcactgtctggggagcctatgatacagaatcatggattggagctgagaatactccattaatatttgattcagatatgtatcccaaagatatctattttgaaatgttagattatgtttt

SEQ ID NO: 22943 - DNA, 1785 bp, Neocallimastix californiae
  FAMILY NOT NAMED
tgtttctggtgtcagtttgacacaaaacaataactcatatattttaaaaaataactatgctaccgtggttatttctaaaaaagatggttatattacttcattaaagattgctggtgacaatcaagaatttttaaatagagcttatattgatgctaatggttcaaaagctggctttcatgcaaaaaaaagtacaattattaagaataccaatgatcatgttgaaattgcattcactgataatgtattaaatatggattgggaagttagatatactatgcttaatgatactaagggtgtttacttctcattaaaacttgaccataaagcaagctatgctgatacacaattcagtgaaatacgtttagtttttagattaaagagtaatccattcaattggttacaaattgaagataatgttggtcgttacttaccaactgctgaagaacaaaagaattgtgaagtaatgggtccaaaggaagcttgtaaggttaaaactggtgaagttcttcacaagtacgattggtctattgatgctttaaaacatgatgttcatggtttctctactaaaaatggtttaggttgttggtttgtccttccatctatggaatggaagaatggtggtgcctacaatcgtgatcttgcctgtcacaatggtgaaaatgattccatacaaattatgtacatggctggttctcactatggtgctggtgatgaatacccaaagaagggtgaaaattggtcaaaggtttacggtccatatttaatttatgtaaataaagctggttctccacaagcctcatggaaagatgctaaggcagttgctcaagctgaaaaagcaaaatggccatactctttcgtttctcaaccaggatacgttaaacaacgtggaaaagtcactggtaaattaactattaagaatcagttagataattctgttttcaagttagatgatgccgtcgtaactttagttcaaccggaatctaacagtgaatccattccaaatcaacaatggcgtcattactccttctggactcatagtatttctggtgtcagtccaaacttcactattaataatgttattccaggtacctatcaattacgtgcttggtctaagggtgttgttggtgaatttatcttaaacaaaactattactgtaactgctggtcaaaccactaatcttggtgaaattgtcttcaccgaaaagagagttggtccaattgcttgggaaatcggtattccagatcgtactgctatggaatataagcatggggatcatttcaatcaatggggtcttccatataaatttccacaagaattcccaaatggagtcaattactacattggaaaatcaaactatgctaaagattggaattattgtcatgtttctgttccaggaaatgggggaacatataaatccgttccatggaatatttactttaatttaaataaaaaaccaacaggtactgcagttttacgtgtttctgttgctgctaatacttccactgctctttcagtttcaattaatggtggtaaaaattcagctgaagtttcaaactttaaagatgatgcttgtgttcgtcgtgatggtattcgtggattctatcgtgaattagaattcaaatttagtccaaatgacttcaagattggagaaaataagattactttgaatgccagaaagactggtggttacactaatagttatcaatttgatggtattatgtatgatcatattcgtcttgaaactccaggtattggtagtaacagtagtaacaacaacaataataa

SEQ ID NO: 22944 - DNA, 951 bp, Neocallimastix californiae; identical to SEQ ID NO: 17630
  FAMILY NOT NAMED

SEQ ID NO: 22945 - DNA, 816 bp, Neocallimastix californiae
  FAMILY NOT NAMED
agaattctgtaaggaaaacaatattaaaatgagaggtcacaccttagtttggcacgttcaaacaccagaatggttcttccgtacaaactttagcgatagtggttcatatgttaatgcccaaaaaatggaaaagcgtatggaaagttatattaaacaaatgctagagtttgttcaatactactacccaggtgttgttgatgtttgggatgtcgttaatgaagctgttgaaattgaaggtggtagttacgatagttctactggttggaacacacgtactaagtacaatggaagtgcaaatccatggtatgctactatgggtcctgattatgtcttcaaggcattccgatttgctcgtaaatacgctgacaaaaatgttaaacttatttacaatgattacaatactttcatgtcacaaaagactaatgctatttataatcttgtaaaaaaattaaagtctgaaaatttaattgatggtgttggtcttcaatcttacttaaacgctgactggccaaatcgtaacgattacaagaatgctatgcaaaggtttgcatctcttggtgtagaaattcaagctactgaattaactattaaaactgatggatctagtaataagttcaataatcaagctaaacactaccaagaagtcttcaagatttacaaagatttgaagaagagcggtgttaacattactagtgttacagtcttcggcttacaagatggctacttattctatagtaatgattcaaccgatactcgtttatgggaccataatcttaagaaaaagccagtttactattctattatgaatgctttaaa

SEQ ID NO: 22946 - DNA, 1056 bp, Neocallimastix californiae
  FAMILY NOT NAMED
agcgaaggaagcgcctttccgttttggtgttggattaactggaaccaatttacaagtttccacaaccgtttcggaaaagatgagagatatcattaagcatcaatttaattcgatgacctacaccaatttaatgaagcctctctacattttagataaggaaggaagtatccaaaatattaagaatggcattcaagatccaaagttaaactttactagtatcgtcgatggattagaatttgcttataaaaatggtatccacattagaggacatgtcttgatttggcacactcaaactccagattggttctttaatgaaggctatactgacgatggaaaaaaagtcagtccagaggttatggaatctcgtttagatagttatataaaacaatatcttagttttgtacaatttaattatccaggagtagtagatgtatgggatgttgtcaatgaagccatagaaattactgatggacaatatgatgccaatacaggatggtatacccgtaccatgttaaacaatacccctaatccatattacgatatgtttggaccagattacgtcattaaagccttccgtatagctcgtaaatatgctcttccaaatgtgaaattagtgtataacgatttcaatacattccaagtatggccccacaataagacacaagccattatggatttagccggaattttacagaaagaagatttaattgatggtattggattacaatcgtatttaggagtcacctggccatcccttgatgaatactttagaggtgtcgaaagattagccaccacaggacttgagcttcaaattaccgaattaactattaccgccccagatggagataattggttagaagcacaagcagaacaatacagagatttctttgaaagattaatgaagcatgttgaagaaggatacaatattggcagtgtcaccgtatttggacttcaagatggctatctcttctacgctagtgattcgacaaaaacaagacttcttgatcatgatcttcaaaagaagccaaactttgaggcgattatgagcattttaaa

SEQ ID NO: 22947 - DNA, 798 bp, Neocallimastix californiae
  FAMILY NOT NAMED
taaaatcgaacaacctactactattgaaaccgacgaaccaactactattttagctgaccaaccaacaagcattgaagcttcacaaccaacaaatattgaagttgtacaaccatcaaataatgaagcagttcaacaaataactacagaaaccgatgaaccaactactattttagctgatcaatcaaccgctattgaaattgcacaaccaacaaatattgaagttgtacaatcagaaattacagaaaccgatgaaccaactactattttagctgatcaatcaaccactattgaaattgcacaaccaacaaatattgaagttgtacaatcagaaattacagaaaccgatgaaccaactactattttagctgatcaaacaaccactattgaagttgcacaaccaacaaatatagaagttgtacaatcagaaattacagaaaccgatgaaccaactaccattttagctgaccaaacaaccactattgaagttgcacaaccaacaaatatagaagttgtacaatcagaaattacagaaaccgatgaaccaactaccattttagctgaccaaacaaccactattgaagttgcacaaccaacaaatattgaagttgtacaatcagaaattacagaaaccgatgaaccaactactattttagctgaccaaacaaccactattgaagttgcacaaccaacaaatatagaagttgtacaatcagaaattacagaaaccgatgaaccaactaccattttagctgaccaaacaaccactattgaagttgcacaaccaacaaccattgtcgt

SEQ ID NO: 22948 - DNA, 996 bp, Neocallimastix californiae
  FAMILY NOT NAMED
aaatggttatgaactcttaagagattattctaagggtttcagaattggtgctgctactaacactattcactacagtaattctaactataacaatgctatgaaagctttcaattatatggttgctgaaaatgcttgtaaatttgttagtattcaaggtaccaagggaaaattcaactttaatgattgtgataatcatttaaagaaagctcaagaattaggtatggatttcagaggtcatgctttagtttggcatagtatggccccaaaatggcttgaaaacgaagatgcaaatactatgaaaaactctataattaatcatattactactgtattaaagcattatgaaggaaaaattgatacttgggatgtagttaatgaagctattgatgatagttctaatggtaatggatggaatatgcgtaaatccttcctttacaataaagttccaaactttattgatattgctttccaaactgctcgtcaagtatctccaaaaactaaacttttctataatgattataatactgaaggtatttggggaaagagtgaatctgtttaccaatttgttgctgatttaaagaaacgtaatattccaattgatggtgttggtattcaatatcacgttagtcttgaaaataatccacgtttcgacaaaattaatgatttaattagtcgttattgtaaattaggtgttgaagttcacattactgaaatggatgtcagttgtgacaaaaactgttgggccagtgatgttgaacaacaacaaggtaaagtttttactaatgctttacaagcttgtcttaacaattcttgttgtaccggtttccttgtttggggtattggtgataacgatagttggattggtggtgataagaaaggtttacttttcaattccaattaccaaccaaagtctcaatacactgctgtcttaaatctcttaaaatctactactgctgcttctcttggtaatggtggtggtaacactggtaatggtgg

SEQ ID NO: 22949 - DNA, 1056 bp, Neocallimastix californiae
  FAMILY NOT NAMED
agcaaaagaagctcctttccgtttcggtgttggtttaaatggtggtgctctttctacttctactactacttctaaaacaatgagagaagtcattaaatatcaatttaattcaatgacttatactaatatcatgaaacctgaatatatttttgataaagaaggatgtctcaaaaatgcagaaaatggttcagaagaaatggctttaaaatttgatgatattgtggatggtttagattttgctttaaagaataatattcatattagaggtcatgtattagtatggcataaacaaactccagattggttcttcagaaaaggatttaattctgaaaatgaatttgccgatgtcgatacgatctattatcgtttagaaagtttcattaaacaatatcttggatttattcaatttaattatccaggagtcattgatgtttgggatgttgttaatgaagcagttgaaattaatgatggcagctttgataattctacaggatggtacactagaactatgacaggagatgaagaaagtttatggtataaagtagtaggaccagattatgttaagaaaacatttgaaattgctcgtaaatatgcacttccaaatgtcaagttagtatataatgattataatactttccaaacttatccacatgataaaactcaagccatcattgatctcatagatattttaagaaaagataatttaatcgatgccattggtatgcaatcatacattggagtgaattggccaagtgttgatgaatatataagagccattgaacgtttcactgaagccggattagaaattcaaattaccgaattaaccattacagcaccaagtggcgatgattggttagaaaaacaagctcaacaatatggagaattatttgaaagaatcatggaacaaattaaaaagggagctaatatttctagtgtaacagtttttggattacaagatggatatagattctattcctctgatagtactaaaactcgtcttttagatcatgatcttcaaaagaaaccaaattacgaagctattatgaaagttttaaa

SEQ ID NO: 22950 - DNA, 834 bp, Neocallimastix californiae; identical to SEQ ID NO: 13989
  FAMILY NOT NAMED

SEQ ID NO: 22951 - DNA, 327 bp, Neocallimastix californiae
  FAMILY NOT NAMED
tggtcgtatgagaaccaatgttcgttacaaatctggtaaatttgaagttcgtgctaagatgcctattgctagtggtttagtaccagctatttattttgcttccacccctgataacaccaacggtgatcaagatgaatttgatttcgaattaattggtagtaaccgtatgcaaacaaacttattcattcatggtaatggtggtcgtgaacaaatttggaacccaccaaccgatttatcgaaggacttccacctctacacctttgaatggagctctaatgccattgtcttgaaggtggataatgaagttattcgtaccttcaataatcc

SEQ ID NO: 22952 - DNA, 276 bp, Neocallimastix californiae
  FAMILY NOT NAMED
ttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttcttaaagaatacag

SEQ ID NO: 22953 - DNA, 834 bp, Neocallimastix californiae; identical to SEQ ID NO: 13990
  FAMILY NOT NAMED

SEQ ID NO: 22954 - DNA, 981 bp, Neocallimastix californiae
  FAMILY NOT NAMED
tgatataataaatcatcaatttaatagtgtaacattaacaaacttaatgaaaccttcgtatttactagatcaaaatggaagtcaaaaaaatattatgaaaggaatacaagatccatcagtaaatttccaatcggcaatagatactttagaatattgtaaaaagaataatataaaaatgagaggacatactttagtatggcacactcaaacaccatcatggttctttaaaaaagattatgatgataaaaatgattatgttgattctgaagtaatggaattgcgtatagaaagttatataaaacaggttatgcaattcgttcaatattattatccaggcgttgtagatgtatgggatgttgttaatgaagcggttgaaattgatgaaggatactatgatgaaaaagtatcatggaaaactcgaacaaaatgtaatgaatcatccaatccttggtatgaaacaatgggtcctgattatgtaattaaagcatttagatttgctagaaaatatgcagctcctggtgttaaattaatatataatgattataatacttttatgagtgaaaagacaacagcaattattaatctcttaaaaattttaaaagaagaaaatttaattgatggaattggaatgcaatcatatcttaccccaacttttccagaacgaagtacatatgctaatgctattaagaaattcggtgaattaggaatagaagtacaaattactgaattaactataagcattgatgataaattatcagaagaagagatgtatgaaaaacaagctgaacaatataaggaggtttttgaaatatatcttaaagcgtatcataatggtattaatattggaagtgttactgtatttggtttacaagatggctacctattttataccaatgattcaacgaaaactcgtttatgggataaagatttacaaaaaaagaagaattattattcaattttggaagttttaaaagagtatta

SEQ ID NO: 22955 - DNA, 942 bp, Neocallimastix californiae
  FAMILY NOT NAMED
aaatgcatatgaactcttaaaagactactcaaagggtttcagaattggtgcagctactaacacaattcactacaacaatgctaactacgttaatgctatgaaggcattcaactatatggttgctgaaaatgcttgtaaatttgttagtattcaaggtactaaaggtaaattcaactttaatgattgtgatgctcacttaaataaggctaaacaattaggtatggatttcagaggtcacgctttaatttggcacagtatggctccaaaatggcttgaaaatgaagattccaatagtatgaaaaattctattgttaaccatattacaaatgtcttaaaacactacgaaggaaaaattgatacatgggatgtagttaatgaagctattgatgatagttctaatggtaatggctggaaaatgcgtaattccttcctttaccaaaaggttccaaatttcattgatctttctttccaaaccgctcgtaaagtttctccaaaaactaaacttttctataacgattataatactgaaggtatttggggaaagagtgaatcggtttaccaatttattgctgatttaaagaagcgtaatattcctattgatggtgttggtcttcaataccacgttagtgtccaacatcaaccacaattcaataagattaatgatttaattggacgttactgtaaattaggtgttgaagttcatattactgaattagatgtcagttgtgttgaatcctgttatgctggtgatgttgaaaagaaacaatctgatgtctttactaatgccttaaaggcttgtcttggtaattcatgttgtactggatttcttgtttggggtattggtgatccagatagttggttaggtagtgataagaagggcttacttttcaatagtaattaccaaccaaaatcacaatacacggctgtattaaatgtcttaaa

SEQ ID NO: 22956 - DNA, 693 bp, Neocallimastix californiae
  FAMILY NOT NAMED
tagtgatattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttatgaaacaatt

SEQ ID NO: 22957 - DNA, 996 bp, Anaeromyces robustus; identical to SEQ ID NO: 22948
  FAMILY NOT NAMED

SEQ ID NO: 22958 - DNA, 834 bp, Anaeromyces robustus; identical to SEQ ID NO: 13989
  FAMILY NOT NAMED

SEQ ID NO: 22959 - DNA, 966 bp, Anaeromyces robustus
  FAMILY NOT NAMED
tgatgttattcaacaagtcagaccagatttttactttggtgttgccactactaaatctttcttcgctaatccaaaatacaaagatattatgagtacttataatttacaagttggtggtaatgaatgtaagttttacactttccaaggtactgaaactttcaacacaaaaccttgtgatgacagtattgcttttgctaagaaattaggtgccaaattccgtggtcacaatcttttctggccagcttactctccatcatggttcaaaacttacagtagtgatattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttatgaaacaatt

SEQ ID NO: 22960 - DNA, 966 bp, Anaeromyces robustus
  FAMILY NOT NAMED
tggtggtaacagtaacagtggtagtactttacttagagactatgctaacggtttcagaattggtgctgctactaatactatgcattataataatcaaaactatgttaatgctatgaaatctttcaattatatggtagctgaaaatgcttgtaaactttctggtattcaacaacaaaaaggtgtttacaatttcaatgattgtgataatcattataagaaggctaaagaattaggtatggacttccgtggtcactgtcttatttggcatgcctatcaaccatcatggttccaaaatgctgatgctaacacattaaagaacgctattgttgatcacattactaaggtacttcaacattatgatggtaaaattgatgcctgggatgttgttaatgaagctattgatgatagttctaatggtaatggatggaagatgcgtaattccttcctttaccaaaaggttccaaactttattgatttagctttccaaactgctcgtaaagttgctccaaatgttaaacttttctataatgattataatactgaaggtgtttacgctaaaactgaatctgtttatcaatttattcaagatatgattaaacgtaatattccaattgatggtgttggtattcaatatcacgttgctgttaatcaacaaccatcttaccaaaagattaatgatttaattggtcgttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttcttaaagaatacag

SEQ ID NO: 22961 - DNA, 834 bp, Anaeromyces robustus; identical to SEQ ID NO: 13990
  FAMILY NOT NAMED

SEQ ID NO: 22962 - DNA, 951 bp, Anaeromyces robustus; identical to SEQ ID NO: 17631
  FAMILY NOT NAMED

SEQ ID NO: 22963 - DNA, 327 bp, Anaeromyces robustus
  FAMILY NOT NAMED
tggtcgtatgagaactaatgttcgttacaagtctggtaagtttgaagttcgtgctaagatgccaattgctagtggtttagtaccagctatttactttgcttcaactccagataatactaatggtagtcaagatgaatgggatttcgaattaattggtagtaaccgtatgcaaactaatttattcattaatggtcaaggtggtcgtgaagaagtttggaatccaccttatgatttatctagagatttccatacttatacttttgaatggacttctaattctatcgttttaaaggttgataatcaagtcgttcgtaccttcaataatcc

SEQ ID NO: 22964 - DNA, 945 bp, Anaeromyces robustus
  FAMILY NOT NAMED
taatggatttgaacttttaagagatgctgctaatggttttagaattggtgccgctacaaatacaattcattacagtaatcgtaattatattgaagctatgaagtctttcaattatatggttgctgaaaatgcttgtaaatttgttagtattcaaggtactaaaggtagatataattttgatgattgtgataatcatcttaaaaaagctcaagaattaaaaatggatttcagaggtcatgctttaatttggcattctatggctccacaatggcttgaacgtgaagattctaatactatgaaacaatctattattgatcatattactactgttttaaaacattatgaaggtaaaattgatacttgggatgttgttaatgaagctattgatgatggttctaatggtaatggttggaaattacgtaattctttcctttatcaaaaagttccaaatttcattgatattgctttccaaactgctcgtaaagtttctccaaatactaaacttttctataatgattataatacagaaggtatttgggcaaaaagtgaatctgtttatcaatttgttgctgatatgaaaaaacgtaatattccaattgatggtgttggtatacaatatcatgttggtgttaatgttcaacctcaatttgataaaattaataatttaattagtcgttattgtaaattaggtgttgaagttcatattacagaattagatgttagttgtgatgataattgtaatgatagagatggtggtgaaggtaaacaatctcaagtttatattaatgctttaaaagcttgtcttaataattcttgttgtactggtttccttgtttggggtattggtgatagtgatagttggagaggtgctgaaaataaaccattacttttcaattctaattatcaaccaaaaggacaatataatgctattttagaaactttaaa

SEQ ID NO: 22965 - DNA, 816 bp, Anaeromyces robustus
  FAMILY NOT NAMED
agaattttgtcaaaaaaataatgtaaaaatgagaggtcatactttagtttggcatactcaaactccttcttggtttttccgtactaatttccaagataatggttcatttgttaatgcttctaaaatggaaaaacgtatggaaagttatattaaacaaatgttagaatttattcaatattattatccaggtgtagttgatgtttgggatgttgttaatgaagctgttgaaattactaatggttcctacgatagttctacaggatggaatactcgtacaaaatttgatggaggtgataatctttggtataaaactatgggtgctgattacgtttttaaggctttccgttttgctcgtaaatatgctgataaaaatgttaaacttatttataatgattataatacttttatgtctcaaaaaactaatgctattagtaaccttattaaaaagttaaaagctgaaaatttagtggatggagttggtcttcaatcttacttaaatgctgattggccaaatcgtaatgattataaatctgctattcaaaaattcagttctcttggagttgaaatccaaattactgaattaactattaaaacagatggttctggtaataaatttaataatcaagctactcattatcaacaagttttccaaatttataaagatttaaagaaaagtggtgttaatattactagtgttactgttttcggtttacaagatggttacttattctacagtaatgatagtactgatactcgtttatgggatcataaccttaaaaagaaaccagtatacaacgccattatgaaggttttaaa

SEQ ID NO: 22966 - DNA, 705 bp, Anaeromyces robustus
  FAMILY NOT NAMED
ctatactggtgatggtaccacttatggtgatcctgttactggaggttactgtatgatgcctgattctgaagcttacactaaagatatgatgttcgctgctatgaatttaccacaatataacatttctgctggttgtggttcttgtcttattttagctcaagctgataaaccagacagagtcatcagagttcgtgttgttgatcgttgtggtgaatgtccaaagggtgatattgatcttagtaatactgcttggaaagctttaactggtgattttattccaagtcgtgttaaaattatttggagtattgttccatgtactgaaacctggtatgattacccaccattagttgaagaaggttctccaattaaattaaaatggaagatggcttcttctgtttactggggtggtattcaagcttataatactcgttatcctgtaacttctattgaacgttgggatggtaatgattgggttcatcttagaagagatgatatgttccattatatgtgggatactactattccaggtggtccaatgaaggttcgtgttactcaaggtgatggtgttcaagtcgttgttgatggtttaactattgatggtacttggtatgatgttgatgataattatactattggtacttctcaaacaacttatattccagaacgtatgactaagactgctactgccacttcttctccaactca

SEQ ID NO: 22967 - DNA, 1056 bp, Anaeromyces robustus; identical to SEQ ID NO: 17632
  FAMILY NOT NAMED

SEQ ID NO: 22968 - DNA, 2373 bp, Anaeromyces robustus; identical to SEQ ID NO: 14534
  FAMILY NOT NAMED

SEQ ID NO: 22969 - DNA, 780 bp, Anaeromyces robustus; identical to SEQ ID NO: 13993
  FAMILY NOT NAMED

SEQ ID NO: 22970 - DNA, 2376 bp, Anaeromyces robustus; identical to SEQ ID NO: 14535
  FAMILY NOT NAMED

SEQ ID NO: 22971 - DNA, 861 bp, Anaeromyces robustus
  FAMILY NOT NAMED
tttctcaggagttatagatggtttagaattttcagctaaaaataatcttaatattagaggacatgttttagtttggcataagcaaactccagaatggttttggagaaaagattttgatgaaactaaagaatatgtcgatcgtgaaactattttcaagcgtttagatagtttcatgaaaaattattttgatttcttaaatttcaactacccaggtgttgtagatgttgttgatgttgttaatgaagctgttgaagttcttgaaggaaaatatgataattctactggttggtacactcgtacagaatcatatgaaggtgatgaaaacatttggtataacttagttggaccagattatgttaaggaagctttccgtattgctcgtaaatatgcacttccaaccactaaattagtttataatgattatgatacttggagaactactcctcatgataaaactgaagctattattaatcttatgaaaatattaaaagctgaagatttagttgatgttattggtatggaatcttatattactccaggtgaaccaactccagaagaatatggtaaagctattgaacgttatgctgctgaaggattagaaattcaaattactgaatttactatttatgttactgatggtgatgattggttagaacaacaaaccattcattatcgtgatatgttcaaagctattatggaagcttataaaaagggagctaatattactagtttcactgttttcggtttacaagatggttatagattctatgatagtgatagtactagaactcgtttatatgaccacgatcttcaaaagaaaccaaacttccaagctattatggatatcttaaaggaatataa

SEQ ID NO: 22972 - DNA, 1836 bp, Anaeromyces robustus
  FAMILY NOT NAMED
aataggtattactttaatatctattgtaagcgctaaagtaaatttaactgaaaacaatacttcctatatattatcaaatggattagcaacttttacaattgctaaaagttctggttttattacttctatgaagtataaaaacaattctcaagaattcttaaacagatcttatattgatgctaatggaggaaaagtttatttctctgttactagttcttcagtagttataagaactgatgatttagttgaaattgtattttatgatgactattccaagcatgtaggcactggttttgctattgattgggaagtcagatatactatgagatctggtgtttccggtctttatttctctttaacacaagctcataaatctaattacgaagaagctcaatgttctgaattaagacttgttatgcgtttaaagagtgatgttttcaattggttacaagttgatgatttcactaagagagttatgccaactgctgctcaacaaaacaaatgtactactctttctccacaagaagcttgtcaattagaaacaggagaagttattcataaatatgattggtctattgatgttcttgaacataaggttcatggttttgccagtatcagtaaaaatcttggttcttggtttgttatgccaagtatggaatggaaaaatggtggtgccgttaacagagatcttgcttgtcaccaaggtggtgctgattctcttcaaattttataccttagaggttctcattatggtgctggtgatgctatattaaagagaggtgaagtttggtctaaaatgcatggtccaattcttatttacttaaatgaaggttctgatgttaatgctatttgggatgatgctaatcgtcaagctgatgctgaaaaacaattatggccatatgattttgttaaccatcaaagttatgttccaaaagctaaacgtggttccgtatctggtaaattagttattaaagatccattatatggtagtcttaaaatttctgatgcaacagttactttagttcaaccagaaagtagtacagaaccaattcatccacaacaatggcataaaatgtctcactgggttactcatgtcactggtgatttcaaaattgaaaatgtagtaccaggtacttatcaacttagagcttggtctaaaggtattgttggagaattttatactactaataccatcacagtaactagtggacaagaaacaaaacttggtgaagttaaatttaatgctccacgtattggtccaactatttttgaagttggtgtacctgatcgtactgctgaagaatatttacatggtgatcatttcaatcaatggggtctttacaataagtttgcagaagaattccctaacagtgttaacttctatattggtaaatctgactggcaatttgattggaattattgtcaagtttccattccaggaggtgctaatggtaattacaaagcttgtgaaccatggaaaattcactttaatattaataaagttccatctggaaacattcttcttagagtttcaattgctgcctcatcttcaactgcattatctgtttctgttaatggaagaaatcaatcttctgaagttaaagatcttattgatgatgcttgtattcgtcgtgatggtattcgtggtatttggagtatgaaagaatttactttcccagctagtctattaaaacaaggtgaaaactatgtttcccttcatactcgtgccattggtggttatttaacttattatagatttgatggtattatgtatgatcacattagattagaaacctctgattcttcctatccaggtgttgccattccaccagctgc

SEQ ID NO: 22973 - DNA, 951 bp, Anaeromyces robustus
  FAMILY NOT NAMED
ggtatcaaatcatgaaagagttgatttagcccttgaagcttatgctaaacataatcttaatgttgtaagagcttgggctttctgtgatgaatgtgaagatgcaacaagattagttgatttttctggtccagaggttaaacttaatagtgaaaatatggaaaaggttgattattatcttgctgcagctgctcaaagaaatattcgtgttgtattaactcttactaataactggactgattacggtggtatggatgtttgggtcaaacaattcggtggaaaatatcatgatgaattctatactaatagaaaacttattgaaggttacaaacaatacattaaagctatgattaaccgtgttaatacttataccggtcaaagatacaaggatgatccaaccattttttcatggcaacttgctaatgaagctcgttgtaataatggacctcatggtcttccagttaaagattgtaatactgatactattactaaatggatggatgaaatagctacatttattcatgaagaagatccaaatcatttggtctcttctggtattgaaggtattggtcttacaccaccggctggtgttgatccaaatacatatgtctatacttacgttgaaggtactgattatgaagccattagtgctcttgattctattgattataacactgttcatatgtacccagttggttggggtttaaaagattatgctaaggatggtgtaaaatggattcaagctcacgctgatgttgataaaaaattcaataaaccaactgttgttgaagaatggggtcttagtacatcagctgataatgtacctttagaagaacgtgatccaatttatactcaatggatggatgctgttttagctaatgataatattggtatgaatatgttctggtatgtttgtggtgaagattattatggaactgatggttatattgtaaa

SEQ ID NO: 22974 - DNA, 624 bp, Anaeromyces robustus
  FAMILY NOT NAMED
ttacagtggtgatggtactgcttatggtgatgctacttcaggtggtaattgtttattcccaaaaaaggaatattacaatgatatgatgtatgctgctcttaataacaaacaatataatcttgatatgggttgtggtctttgtgctgttgtagtttcaactagtaacccatacaaagctattagagtacgtattattgatcaatgtccagaatgtgaacacggaagtttagattttagtgataaagctttcaaagctctttccaatatggatccagctcgtattaagattacatgggctcttattccatgtgatgttgatgttaatgaatacccagctcttgttaaatcaaattcaccaattaaattccaatttaaatctggtagtactcaattctggggtgaagtagaagtctttaatactcgttatccagttgctaaagttgaattcttatctaatggtaaatatgaaagtttatacagacgtgcctataattattgggctcttaactctggtggttttggtgctggtccatatactttccgtgttactttagctgatgatactgttattgaagctaaaggagttgaaatggttattccaggtaatgatgaaggtgatgattt

SEQ ID NO: 22975 - DNA, 819 bp, Anaeromyces robustus; identical to SEQ ID NO: 13994
  FAMILY NOT NAMED

SEQ ID NO: 22976 - DNA, 1095 bp, Anaeromyces robustus
  FAMILY NOT NAMED
ttttccaggcgctgatggtggtggtaaatttgccactggtggtcgtggcggtgaagtaatttatgtcacaaatttaaatgatagtggagctggttcatttagagatgctgttagtaaaccaaatcgtattgtagtatttaaagtctctggtactattgaattgaaaagtgatgttgttgtaaaaagtaatattactattgctggtcaaacagctcctggaggtcatggtgttgttttaaagaattttaagcttggttttggtggaactaatgttatatgtcgttttattggttctagaccaggtgaaagaggttctaatgctgattatgatgcttggggtggtgctgaaggttcaaatactattgttgatcactgctctattggatgggcaaatgatgaacagtggggtttatattccaagagtgatgatttaaccgttcaatactctgtcatcggtccatctaattctttttcttaccatagtaaaggtattcatggttttggtattatgcttggacgtaaaaatgtatcttaccatcacaatttaattgctcataatgtttccagaaattttagaggtaaagttccagataaaaatacttgtgatttcactaataatgtcatatataattggggatcccaaactacatatggtactattggtcacttaaattatgttggtaacaccttgaaaaaaggaccttcaacaaaaggtggtaataattacgttagtgttgctgatagtggtacaaaaccagaaaattattccatatatttaacaggtaatagattccttaatagtaataatacaccatataatgacttttctgctaataattggagaggtattacttataaaaataattcaaagaatgaaggtaatactaaatctaatacaccatttgctatgactaatggtagtgataattcatctactattgcaaaggttgaaccggctgaacaagcttataataatgtattagcttatgctggtaatggtatcacatcagataaaagaattgctattgataaacaatgtgcagctgaaactaaaaatggtactggtaacttagtaggtgctcgtccatataatga

SEQ ID NO: 22977 - DNA, 951 bp, Anaeromyces robustus; identical to SEQ ID NO: 17633
  FAMILY NOT NAMED

SEQ ID NO: 22978 - DNA, 786 bp, Anaeromyces robustus; identical to SEQ ID NO: 13995
  FAMILY NOT NAMED

SEQ ID NO: 22979 - DNA, 975 bp, Piromyces finnis
  FAMILY NOT NAMED
aaaagttattaaatatcaatttaattcaatgacctatactaatcttatgaatccaagtgctattttagatcaacaagcttctattgataatattatgaatggtaatgaagatcctattctaaattttagtaatattgttgatggtttagattttgcctataaaaatggacttaatattcgtggtcatgctctagtatggcatactcaagttccagaatggttctttagagatggatattatagcaatacagaatttgttagtagagatgttatggagtatcgtttagatagttatattcgtaagttccttggatttgttcaatttaattatccaggaacagtagatgtttgggatgtagttaatgaagcaattgaaattacagatggtcaatatgatgaaacaactggatggtatacccgtactgctaataataaaacaccaaatccttggtatgaaatatttggacctgattatgttgcaatagcattccgtattgctcgtaaatatgcccttcctaatgtaaagttaatttataatgatcataatactttccaaatccaaccacatgataaaactcaagccattattgatcttgccaatattttacaacaagaaaacttaattgatggtattggtatgcaatcttatataggagttacttggccaaatttagatgattactttaacggtttagaaaggttaattacttctactggattagaaattcaaattactgaattaacaattactccaccaataggtgataattggttaggtgctcaagcagaacaatattatgagtacttcaatagacttttatcttacattaaaaatggttataacatttctagtgtcactgtttatggtttacaagatggctatagattctacactaaagattctaccaaaactcgtcttttagatcatgatcttaaaaagaaaccaaatttcaatgctattataaatgtattaaa

SEQ ID NO: 22980 - DNA, 2385 bp, Piromyces finnis; identical to SEQ ID NO: 14536
  FAMILY NOT NAMED

SEQ ID NO: 22981 - DNA, 2151 bp, Piromyces finnis
  FAMILY NOT NAMED
taattggtataataccaagattggtggtggtggttttgtaacaaatttaatttataatcctggagagcaaggattattatatttaagaactgatatgggaggttcttatcgttatgaccaaaataataaatcatggactccaattcaagatatttttggtggtagcgaatggtggttatttggctgtgaaagtttaggtgttgatactaaagaaccaaaccgtgtctacattgctgcgggtacctatatgagttatggtgaaaatggagccattattgcttcagatgactatggtcaaacttggaaaactcgttgggatgcaccattccactttggtgcaaatgatgatggtcgtggtcgtggtgaaagactcgctgttcatcctgaacaaaacaatattatctattttggtaccagaaagaatggtttatataaatcaacaaactatgctgaatcttttagtcaagttgcttcattcccaacggactatgatattccattcatcctttttgtaccaggaaccaaaggaaaaacaattattgttgctactgataattctaaaggaccattataccgtagtgatgatggaggttctaccttcaagcaaataagcggacaaccaaatacaggttattatcctcatcatggtgctttcagtgccgataataaatatctttatgttacttacgccaattcaattggaccaaatggtgccactcaaggtgctgtttatagaattaaacttgctgattactcctttaaggaaattacaccagtaaaaggttcttatgaaactcagcaattcggttatactggtgttcaaactagtggcactaatcctggtgtagttattgtctctactttaaatttatggtggccaagtgatgaagtttacaaaagtaacgattatggtgagacttggtctgaaggtgttgctagtcatgctgaattagacattagtgaatatccatggcttgactttggtaaagaagacggtttaaaatttggttggtggattgcttccttagctatggatccatttgatgataataatgtttcctatggtactggtgctacagtttataccaccactgattttactaatgccgataagaatgccgcaactcactgggccccaaatgtacatggttttgaagaatgtgctattaacgatattgaagcaccaccagctggacctggtaatccacaacttttaactgctcttggtgatcttggtggtttcactcaagatgatattaatgaagcagtagaaatgtggaccaacccaacctatactactggtagttccgttgaatatgcatactctaacccacaaattgtagtttcctgtggtacagataatgcggcctactcaaatgacggtggtcacacttggactccaatgaagtcactcccatatgaaaatgctaccggaggtcatattactatttctggtgatggtaaagttgttacttgggttccaaatcaatccaatgttccatactggactacagaccatggtgctacttggacaaaggtaactacctgtccacaatgtactcaaattcgtccagatggtaaaaatttaacattaatgtatggttatgattatcaaagtgtttacctcagtaaagatggtggtaaaacctatagtaaacttagttctggtttaagtgccggtcaattgaattcaccatttgatgttgaaggtcacttatggttagcctgcacctattggggtggtgttcaaatgtcaacagattatggtaaaacctttaaagaagttgatccactctttaaaactgctgattcagttggttttggtaaacctgatccaaattcaaatgctccatacacggtttatattgttggtaaatatgatggttattatggtgtctaccgttctactgatcttggtaatacctggaccttattaaatgatgataatcatcaatggggtgtttataactccaaagttatcggggatccaaacatttttggtcgtgtttatattgcaaccaatggacgtggtgttgttgttggtgatgatactagtgttgttagcaattcaaataataatacgcctcatcgtcaaaccactaccaagaaaaagaccaccacaaaaacgatatcttcctccccaacatcctc

SEQ ID NO: 22982 - DNA, 1026 bp, Piromyces finnis
  FAMILY NOT NAMED
gataaatttaacgatattattaaatttattctttttattgctggttcctacatatgcaatcctcggtggttatgtatacactgaagggacaaacttttatattgatggctacaaaatatatttttctggaacaaatacatactatttacatagttctcaaaatgaaagggtggatcttgcattagaagtatcagcaaaacataatattcaagtagttcgtgcatgggcattttgtgatcttaaggtgtgtggtgacaaacaatttgtgaaatttgaaaatggaaaggctgtatttcttgaagataatatggaagctatcgattactttatagcagcagcatcacaaagaaatatcagattagttttaggttttactaataattggactgattatggtggtatggatgaatgggttaaaggttatggtggtaaatatcatgatgatttctatactaatacagatatccgtaaggcattcaaaagctatattaaattgttaattactcgtattaatcgtcataccaatattcgttatagtgatgatcctacaatattttcttggcaattagctaatgagccaagatgcggaaatggtccttctggacttcctcaatcaggtaaatgcactcctgaggttataactgaatgggctaatgatattagttcatatattaaagaactagaccccaaccacttagtatcagtcgggtgtgaaggttttggtcttgaagctccagagggatctaaaggattatatgcatacaaatatgatgaaggtactgattttgaggctttaacagcacttccaaatattgattataatacttatcattattatcctattccatggggaatgaaagatttagtttctcatactaaagattggattgaatcacatcaagctgtaggaaaaaaattaaataaaccagtagtatttgaagaatggggtcttgaaattccaactgactgttcaaaagaagaacgtattcaatattacaaaacatggacaaagcaaatcctcgatgc

SEQ ID NO: 22983 - DNA, 1044 bp, Piromyces finnis
  FAMILY NOT NAMED
agaaggttttgttcaaactgatggtacaaattttgttgtcgatggttgtaaacgttacttttctggttcaaatacttattatttaatggtatcaaatcatgaaagagttgatttggctctcgaaacatatgctagacataaccttaatgttgttagagcatgggctttctgtgatgaatgtgaagatgcaacaagattagttgatttttctggtccagaagttacacttaacagtgaaaatatggaaaaggttgattattatcttgctgctgctgctcaaagaaacattcgtgttgttttaacccttactaataattggactgattatggtggtatggatgtttgggttaaacaattcggtggaaaatatcatgatgaattttacactaacagagatattgttaatggttacaaacaatatattaaggctatgattaatcgtgttaatacctatactggtcaatattataaggatgacccaactattttctcatggcaacttgccaatgaagcccgttgtaataatggtccacatggtcttccagtcaaaaattgtaatactgacactatcactaaatggatggatgaaattgcttctttcattcatgaagaagatccaaatcacttagtttcttctggtattgaaggtattggtcttactccaccagctggtgttgatccaaatacttatgtctactcatacattgaaggtactgattatgaagctattagtgctctcgactcaattgattacaatactgttcatatgtacccagttggttggggattaaaagattataccaaagatggtatgaaatggattcaagctcatgctgatgttgataagaaatttaataaaccaactgttgtagaagaatggggtcttagtacttctgctgataatgtaccacttgaagaacgtgatccaatttatactaaatggatggaaactgttttggaaaatgacaacattggtatgaatatgttttggtatgtttgtggagaagattattatggtactgatggttacttaatggaagaaga

SEQ ID NO: 22984 - DNA, 1860 bp, Piromyces finnis
  FAMILY NOT NAMED
gaatatattaaattatttcgttttaataggtattactttaatatctattgttagtgcaagtgttactttaactgaaaataatacttcatacattttatccaatggattagcaacatttacaattgctaaaagttcaggttttattacttcaatgaagtataaaaacaactcacaagaatttttaaatagatcttacattgatgctaacggaggaaaagtttatttttctgtaacaagttcatatgtagccactaaaaatagtgatttagttgaaattgtttttgttgatgattattccaaacatgttggtactggatttgctattgattgggaagttagatatactatgaaatcaaatgtttctggtatctatttctctttaactcaatcacacaaatctaattatgaagaagcacaatgttctgaattaagactagttatgcgtttaaagagtgacgtatttaattggttacaagttgatgactttaataaaagagttatgccaactgcttctgaacaatcaaaatgtgttactctttcaccaagtgaggcgtgtagattagaatcaggagaagtaattcataaatatgattggtctgttgatgctcttgaacacaaggtccatggttttggtagtattagtaagaatctcggttcatggtatgttattccaagtatggaatggaaaaatggtggtgctgttaatagagatcttgcgtgccatcaaggtggttctgattcacttcaaattttatactttagaggttctcactatggtgcaggtgatgcagttcttaagaaaggagaagtttggtccaaaatgcatggtccaattcttatttacttaaatgaaggatctgatgttaatgctctatgggctgatgctaatcgtcaagcagattatgaaaagcaattatggccttatgattttgtaaagagtgatagttatgttccaaagaataagcgtggttcagtttctggtaaattagttatcaatgatccattatatggtaatcttaaattaagtgatgcaactgttactttagttcaaccagaaagtagcaatgaaccaattcacccacaacaatggcacaagatgtctcattgggttactcatattactggcgatttcaagattgaaaatgttgttccaggtacttatgaattaagagcttggtgtaagggtattgttggtgaattctacaccaccaatacaattactgttactagtggtcaagaaaccagacttggtgatgttaaatttactgctccacgtattggtccaactgtctttgaagttggtattcctgatcgtactgctgaagaatatttacatggggatcactttaatcaatggggtctttacaatcaattccaagatgaattcccaaatagcgtaaacttccgtattggtgaatctgattggcaatttgattggaactattgtcaagtttcaattccaggtggtgctgatggaaagtacaaagctgctgaaccatggaaaatttatttcaatcttgacaaagtcccatcaggtaacatcctcgttagagtttctgttgctgcttcatcctcaactgctttatcagtttctgttaatggtaagaatcaaagtgctgaggttaaggatcttgttgatgatgcttgtattcgtcgtgatggtattcgtggtatttggagtatgaaggaatttacattctcatctagtttattaaaacaaggtgaaaattacatttctcttcacgctcgtgctattggtggttatttaacctattacagatttgacggtattatgtacgatcatgttagattagaagtttccgatcaatcctatccaggtgttgccattccagctactat

SEQ ID NO: 22985 - DNA, 1839 bp, Piromyces finnis
  FAMILY NOT NAMED
tatatttacggtattatttacatatatatcggcagtatttgctgctgtttctcttactgataatggaagttcatacatattaagaaatgattatgccattgttacaattgcaaagaattccggttatattacttccttaaaattaaatggaaataatcaagaatttttaaatagatcttatattgatgctaacggtggaaaagtttatttttcaccacaaagtagcaaagtaataaaaaatacatcctcacatgtagaagttgctttctatgataattataattctaattcaaaattaggacttgattgggaagttagatacactatgctctctgatacaagaggtgtttactattcattaactaatactcacaaaacaaattacccagaaacatcatatagtgaaattcgtttagtactcagattaaaggcagatattttcaatcacttacaagttgaagatgatgtataccgtgatatgccaagcgctgctgatcaaaacaaatgtgttgaaatgggaccaaaagaagcttgccaattaccaaacggagaagttattcacaaatatgattggtctgttgatatgttaaaacatcatattcatggtttctccagtaaatcaactggtttaggttgttggtttgttattccatcattagaatggaagaatggtggtgcatacaaccgtgatctttcttgtcaccaaggtggtagtgattcattacaaattatgtacatgaatggttcccactatggtggtggtgatgctaccattaaaagtggtgaatatttccaaaaggtttatggtccattcttaatttacttaaataaggctagttcagttgaagcttcttggaacgatgctaaaaacatgcttaatactgaaggtagaaaatggccatactctttcgtttcacaaccaggatatgttaaggaacgtggaaaggttacaggtactttagctattaataatccattaactaatactcgtttaccacttgaagatgctgttgttactttagttcaaccacaatcagcaaccgaaccaattccaaaccaacaatggcgtcatatgtcattctggactcacagtttatctggtgctacaccaaactttgtaatttacaacgttattccaggtacatatgaattacatgcttgggcaaagggtgttgttggtgaatttgttttagataagttagttaccgttaaagctggtgaagttgttaatcttggaaagtttacatttgttgaaaatcgtattgctccaatagtttgggaaattggtataccagatcgtactgcaatggaatataaacatggtaatcattttaaccaatggggtctttaccataaatttaagactgaattcccaaacagtgttaactattatgttggtaaatctaattatgctactgattggaattactgtcacgtttcaattcaaggtgcagatggtaaatatatgcaatctccatggaatatttacttcaacttaaataaaataccaacaggaacatctgttttacgtatttccattgctgcttcttcatattctgctctttctgttgccttaaacgatggtaaagcaactgctgaagttaaagatttagttgatgatgcttgtattcgtcgtgatggtattcgtggtatttggagtatgaaggaatttacattctcatctagtttattaaaacaaggtgaaaattacatttctcttcacgctcgtgctattggtggttatttaacctattacagatttgacggtattatgtacgatcatgttagattagaagtttccgatcaatcctatccaggtgttgccattccagctactat

SEQ ID NO: 22986 - DNA, 951 bp, Piromyces finnis; identical to SEQ ID NO: 17634
  FAMILY NOT NAMED

SEQ ID NO: 22987 - DNA, 966 bp, Piromyces finnis
  FAMILY NOT NAMED
agatgtcattcaacaagttagaccagatttttactatggtgttgccactacaaagtcattcttttctaacccaaaatacaaagatatcatttctacttacaacttacatactggtggtaatgaatgtaaattctacactattcaaggtactcaaactttcaatactaaacaatgtgatgattcaattgcttttgctaagaaattcggtgctaaattccgtggacataatcttttctggccagccaactctccagattggttcaaaaattacagtgatgatattgaagaagttaaagcttattatcttgactatgttgccaaggttttagaccattacaaagatgaagaagatatcatctactgggatgttgttaatgaatccgtcactgatgattctactatcgataagtataagttacgttatggttctgatagaagtaatgaattcaagggttgggatacttacactgaagatattttcactcttgctcgtgaacatactaatccaaatgttaaattaatttacaatgattataatgctgaaaacaacaacggtaacttcaatggtaaaactggtgctgtttacaagtatattaaggaaatgaaagaaaagggtattccaattgatggtgtaggtttacaaatgcacatttcttgtaactacactccaaactacgaacaactcactgaattaattgatatgtacaaagaaatcggtgttgaagttcatgttactgaaattgatgtcagtatgaagaattgtaaaactcatgaccaacaaagaaaattatatatggatgttttcagagcttgttttgataatgaaaactgtaaggtttttactgtttggggtgcttatgatactgaatcatggattggtgcttcaaacgttccattaccatttgatgatgatatgtatccaaaggatatctactttgatatgttagaatatgttatgaaacaatt

SEQ ID NO: 22988 - DNA, 921 bp, Piromyces finnis
  FAMILY NOT NAMED
tgctaaagactttagaattggtgttgctgctaacacaatgagattcaataatcaagcttacaatgaagccttaaaggctttcaactacatggttgctgaaaatggttgtaagttatctggtattcaacaaagacaaggtaactacgattttagtgattgtgataatcactataagaaggctaaggaattaggtatggctttccgtggtcatgctcttatctggcacgcatacatgccatcttggtttgaaaatgctaatgcttcaaccttaaagaatgccattgttgaacatgttaccaaggttcttcaacactacgaaggtaaaattgatacttgggatgttgtcaatgaagctattgatgacagttcaaatggtaacggttggaagatgcgtaactccttcctttatcaaaaggttccaaactttgttgatcttgcttttgaaactgcccgtaaggtttctccaaatactaagctcttctacaacgattacaatactgaaggtatttacggaaaaactgaatccgttttccaattcgttaaggacatgaaatctcgtggtattccaattgatggtgttggtattcaatatcacgtttctgttgacagtcaaccacaatacaacaagattgatgatttaatttctcgttactgtggtcttggtcttgaagttcacattactgaacttgatgttaagtgtggtagccaatgttcttcatctaatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaaggaaac

SEQ ID NO: 22989 - DNA, 921 bp, Piromyces finnis; identical to SEQ ID NO: 22988
  FAMILY NOT NAMED

SEQ ID NO: 22990 - DNA, 174 bp, Piromyces finnis
  FAMILY NOT NAMED
tactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaa

SEQ ID NO: 22991 - DNA, 174 bp, Piromyces finnis; identical to SEQ ID NO: 22990
  FAMILY NOT NAMED

SEQ ID NO: 22992 - DNA, 174 bp, Piromyces finnis; identical to SEQ ID NO: 22990
  FAMILY NOT NAMED

SEQ ID NO: 22993 - DNA, 636 bp, Piromyces finnis
  FAMILY NOT NAMED
ttatactggagatggtactacttatggtgatccagtaaccgggggttattgtatgatgccagattctgaagcttataccaaagatatgatgtttgctgccatgaatttaccacaatataatatttctgctggttgtggttcttgtcttattttagctcaagctgataaaccagaaagagttattagagttcgtgttgttgatcgttgtggtgaatgcccaaagggtgatattgatcttagtaacacagcttggaaagctttaactggtgattttatcccaggtcgtgtaaaaattatttggagtatcgtcccatgtactgaaacttggtacgactatccaccattagtagaagagggttctccaattaaattaaaatggaagatggcttcatctgtttactggggtggtattcaagctttcaatactcgttatccagttacatctattgaacgttgggatggtaatgattgggttcatcttaagagagatgatatgttccactatatgtgggaaggaactattccaaatactccaatgaaagttcgtgttactcaaggggatggtgttgttgttgttgttgatggtttaactattgatggttcttggtatgatgttgatgataattatactattgg

SEQ ID NO: 22994 - DNA, 2160 bp, Piromyces finnis
  FAMILY NOT NAMED
actgtcatatacatggaaaaatgctgaaattgttggtggaggtttcgttcccggtattgtatttagtgaagctgaaaaagatttagtatatgctagaacagatattggtggtttatatcgtttgaatacatcaactaaaagatgggaaaatttatccaaatgggttggagttgataactggggttatgcgggtattgatactatgtgtgctgacccagttgatgctgatagagtttatgctgcagttggtatgtatactaataactgggatccaaataatggtgctattatttcatcgacagatcgtggtgataactggtcaattactgaattgccatttaaagttggtggtaatgatccaggtcgtggtatgggagaaagaattgctgttgatccaaataataataaaattctttttttcggtgcacgcgcaggaaatggattatggaaaagtacagattatgctaaaacttggactcaagtaaagagttttactaacgtaggtaaatatgctacggatacacaatattttactgaagctattggtatttcttttgttactttcgataaatacagtggtaaaaagggttccccaaccccaaatatttatgttggtgttgctgataattctacctctactgtttatgtttctaaagatgctggtgcctcatgggttccaataccagatcaacctctacattatttcccacataaaggtaaaattactaaagatggaatgctttatattacatatactgatggctgtggtccatatgatggtcaagctggtgcaatttatcgttataacactaaaactggtgaatggaaggatattagcccacatcaagaaccatactttggttatggtggtttagctattgatgctcaagaccaaaaaacaattgtagttgctaccttaaattcttggtggccagatgccattttattccgttctacagatggtggtgatacttggtctcatatatgggaatggaatggttatccagaacgaaagtttaaatatgaaattgatccttctatttctccatggattgaggataatatgaaacaaattccggaaccaacaacaaagttaggttggatgattgagtctttggaaattgatccatttaattctgatcgtattatgtggggtactggtgctaccatttggggttccgaggatcttactaattgggataatggtaaaaaattccatattactattatggcatctggtattgaagaaacagctgttcaagatttagtttctccaccttcaggtgatgcacatttattaagtgttatgggtgaccttggtggttttagacacactgatttagatacttgcccagaagtcaatttcagatcaccaactttttcttctggtttctctattgattacgctgaaaatgttccaaatttctgggttcgtgttggtactgaaccttacattgctctttcatggggtaatggtgaatcttggtatggtgtccaagctccaggtggtgtaactgaaggtggtattgttgctgttggtgccgaaggtgatgttgtatgggctccaaagccttatgatttaggtgtcttttacggtaaagaaacttttaaatcttcaaaaggtattccaggtggtgccagaatttgttctgatcgtgtaaatggtaagattttctatggttaccttggtgatacattctatcgtagtatagatactggtgtttcttttaccaaaatgtacactggtcttccagaaatggaacctggctatgctaaaaatattaaagcagttgctggtcatgaaggtgatgtttggctcgctggaaacaaaggtggtctttatcatacagaagatggtggtgaaactttttatcaaattgatggtgtagaaatcgctaatacaattggttttggtaaggctgccgaaggttatgattatccagctttatatattactggtaaaattggaaatattaatggtattttccgttctgatgataaaggtcaaaattgggttcgtattaatgatgataacaatcaatatggtaccattaacttctgtattactggtgatccacgaatttatggtcgcgtttatgtatgtactaatggttttggtattgtctatggtgatattgatggtgattccggaactccagt

SEQ ID NO: 22995 - DNA, 624 bp, Piromyces finnis
  FAMILY NOT NAMED
ttacagtggtgatggtactgcttatggtgatgctacttcaggtggaaattgtttattcccaaaaaaagaatattataatgatatgatgtatgccgctcttaataataagcaatacaatgatgatatgggttgtggtctttgtgcagttgttgtttcaacaagcaatccatacaaagctattagagttcgtattattgaccaatgtccagaatgtgaacacggaagtttagatttcagtgataaagcattcaaagctctttcaaacaaaactccagatcgtataaagattacatgggcacttattccatgtgatgtcgatgttaatgaattcccagcacttgttaaaccaaaagctccattaaagttccaatttaaatctggttctacacaattctggggtgaagttgaagtatttaacactcgttacccagttgcaaaggttgaacttttattaaatggtaaatatcaaagtttatacagacgtgcttataattactgggctcttagttctggtggttttggtgcaggtccatacaccttccgtgttacattagccgataacactgtcattcaagcaacaaatgttgaaatggttattccagcaaatgatgaaggtgattctta

SEQ ID NO: 22996 - DNA, 1020 bp, Neocallimastix californiae
  FAMILY NOT NAMED
tgctaaatggaatgaaattaatgactttaaccaaagtgattatccaacttctgcattagataacgattggttcagacttttagaaaaatctgttgccatgccatctaataatgaatctgttggtgatttatccttcaagggtaaggttgttattattactggtgctggtggtggtctaggtcgtgcttacgctaaacattttgctaaattaggtgcttctgttgttgttaatgatttaggtgtccttttacgtggtagaggtgctaacactcaagttgctgatagtgttgttgaagaaattaagcaaatgggtggtattgctgttccgtcttatgattctgttgaagaaggtgaaaagattgttgaaaccgctattaagaactttggtcgtgttgatattattattaataatgctggtattttaagagatagatcttttggtagaatgactgatactgattggatgatgacatatagagttcacttaaagggtacttataaggttacaagagctgcttggccatacatgatgaaacaaaagtatggtagaattattaatattacttctgcggctggtctttttggtaactttggtcaatctaattatgctgctgctaaatctggtgttattggtctcactaatgcattagctttagaaggtaaagagtataatattactgtaaatagtgttgctccaaatgctggtactagaatgacagctactattatgccacaagaaatggttgaattacttaaaccagaatatactgctccacttattagtttccttactcatgaatcttgtaatgctactggtggtatctatgaagtaggtagttgttgggttgctcgtttacgttggcaacgtagtggtggtgcttcttttgctatcaataaattattatatccagaaagtatcgctactagatggcgtgatattattaactttgaagatggtcgtgatacctacccaacatctattgaggaatctactgctcaaatgcaagtaaacttaaagaa

SEQ ID NO: 22997 - DNA, 1020 bp, Neocallimastix californiae
  FAMILY NOT NAMED
tgctaaatggaatgaaattaatgattttaatcaaagtgattatccaacttctgctttagataatgattggttcagacttttagagaaatctgttgctatgccatctaataatgattctattggtgatttatccttcaagggaagagtagttattgttactggtgctggtggtggtcttggtcgtgcctatgctaagcactttgctaaattaggtgcctcagtcgttgttaatgatttaggtgtccttttacgtggtagaggtgctaacacacaagttgctgatggtgttgttgaagaaattaaaaagatgggtggtattgctgttccatcctatgattctgttgaagaaggtgaaaaaattgttgaaactgctataaagaactttggtcgtgttgatattattattaataatgctggtattttaagagatagatcttttgcaagaatgactgatactgattggatgatgacatacagagttcatttaaaaggtacctataaagttactagagctgcttggccatatatgatgaagcaaaagtatggtagaattattaatattacctctgctgccggtcttttcggtaactttggtcaatctaactatgctgctgctaaatctggtgtcatcggtctcactaatgccctagctttagaaggtaaagaacataatattactataaatagtgttgctccaaatgctggtactagaatgacagctaccattatgccacaagaaatggttgaattacttaaaccagaatacactgctccacttattagtttccttactcatgaatcttgtaatgttactggtggtatctacgaagtcggtagttgttgggttgctcgtttacgttggcaacgtagtggtggtgcttctttcgctatcaataaattattatatccagaaagtatcgctactagatggcgtgatattattaactttgaagatggtcgtgatacctatccaactaccattgaagaatctacagctcaaatgcaagttaacttaaagaa

SEQ ID NO: 22998 - DNA, 1020 bp, Anaeromyces robustus
  FAMILY NOT NAMED
tgctaagtggaatgaaattaatgactttaatcaaagtgattatccaacttctgctttagataatgattggttcagacttttagaaaaatctgttgccataccatctaataatgaatctgttggtgatttaaactttaagggtagagttgttattgtaactggtgctggtggtggtcttggtcgtgcttacgctaagcatttcgccaaattaggtgcttctgtcgttgttaacgatttaggtgtccttttacgtggtagaggtgctaacactcaagttgctgatagtgttgttgaagaaattaagaaaatgggtggtattgctgtcccaagttatgattctgttgaagaaggtgaaaagattgttgaaactgctattaaaaactttggccgtgttgatgtcattataaataatgctggtattttaagagatagatcatttgctagaattactgatactgattggatgatgacttataaagttcacttaaagggtacctataaagttactaaggctgcttggccatatatgataaaacaaaaatacggtagaattattaatattacttctgctgctggtctttttggtaactttggtcaatctaattatgctgcagctaaatctggtgttattggttttaccaatgctttagcattagaaggtaaggaacacaatattactattaacagtgttgctccaaatgctggtactagaatgacagcaactattatgccacaagaaatggttgaattacttaaaccagaatatactgctccattaattagtttccttactcatgaatcttgtactgctactggtggtatttatgaagttggtagttgttgggttgctcgtttacgttggcaacgtagtggtggtgcttctttcgccattaataaattattatatccagaaagtatcgctactagatggcgtgatattattaactttgaagatggtcgtgatacctatccaactactattgaagaatcaactgctcaaatgcaagttaatttaaagaa

SEQ ID NO: 22999 - DNA, 5523 bp, Anaeromyces robustus; identical to SEQ ID NO: 22718
  FAMILY NOT NAMED

SEQ ID NO: 23000 - DNA, 1020 bp, Piromyces finnis
  FAMILY NOT NAMED
tgccaaatggaatgaaattaacgatttcaatcaaagtgactatccaacttctgctttagataacgattggttcagactcttagaaaagtctgttgctatgccatctaacaatgaatccattggtgaattatccttcaagggtagagttgttattgttactggtgctggtggtggtcttggtcgtgcttacgccaagcactttgctaagttaggagcttctgttgttgttaacgatttaggtgtccttttacgtggtagaggtgccaatactcaagttgctgatagtgtcgttgaagaaattaagagtatgggaggtattgctgttccaagttatgactctgttgaagaaggtgaaaagattgttgaaactgccatcaaaaactttggtcgtgttgatgttatcattaacaacgctggtattttaagagatagatcctttgctagaatgaccgatactgattggatgatgacctacaaggttcacttaaagggttgttacaaggttactaaagctgcttggccatacatggttaaacaaaagtacggtagaattattaatattacatctgctgccggtcttttcggtaactttggtcaatctaactatgctgctgctaaggctggtgttattggtctcactaatactttagccttagaaggtaaggaacacaatattactgttaatagtattgctccaaatgctggtactagaatgacagctactattatgccacaagaaatggttgaattactcaagccagaatacacagccccattaattagtttccttacccatgaatcatgtacagctactggcggtatctatgaagttggtagttgctggatcgctcgtatccgttggcaacgtagtggtggtgcttctttcgccatcaacaaattattatatccagaaagcattgctaccagatggcgtgatattatcaactttgaagatggtcgtgatacctatccaactactattgaagaatctactgctcaaatgcaagtaaacttaaagaa

SEQ ID NO: 23001 - DNA, 57 bp, Neocallimastix californiae
  FASYNTHASE
ttctgccgttattaacgccggttacaatgttgaagttggttgtggtgctctttacgc

SEQ ID NO: 23002 - DNA, 66 bp, Neocallimastix californiae
  FASYNTHASE
ctaccgtggtcttgtcatgcaatcctctgtcgaaagagatgaattaaaccgttctgactacgctat

SEQ ID NO: 23003 - DNA, 60 bp, Neocallimastix californiae
  FASYNTHASE
agctgaagttaagcaaaagccaactgcctacgttttcactggtcaaggtgctcaagaagt

SEQ ID NO: 23004 - DNA, 57 bp, Neocallimastix californiae
  FASYNTHASE
tattgaagaaatgacctatgaagaagttattctacgtttaatcgaattacttttcgt

SEQ ID NO: 23005 - DNA, 63 bp, Neocallimastix californiae
  FASYNTHASE
tcgttacactcgtttaactggtcgtccacctcttcttgttggtggtatgactccaactaccgc

SEQ ID NO: 23006 - DNA, 60 bp, Neocallimastix californiae
  FASYNTHASE
gccaattgttgttgaatggactggtggacgtagtggtggtcatcactcttgtgaagattt

SEQ ID NO: 23007 - DNA, 69 bp, Neocallimastix californiae
  FASYNTHASE
aaacactaatgaagattactctcttgcctctggtgatgtaaatccaattcacactaactactactttgc

SEQ ID NO: 23008 - DNA, 66 bp, Neocallimastix californiae
  FASYNTHASE
tgctaacttggctgatcttgatgttccaattactcacggtatgtggactagtgctgctactcgtcg

SEQ ID NO: 23009 - DNA, 60 bp, Neocallimastix californiae
  FASYNTHASE
ttacatttgtgatgatgcagtttacgccggtcactctcttggtgaatacgctgctctttc

SEQ ID NO: 23010 - DNA, 75 bp, Neocallimastix californiae
  FASYNTHASE
aaaaccaccaccattcatctgtgttctcgatgaagaattccacgtttggttaaagcgtgatagtttatggcaagc

SEQ ID NO: 23011 - DNA, 72 bp, Neocallimastix californiae
  FASYNTHASE
tatgggtcaagatctctacaacaaatctgctgttgccaaggctgtttgggatagagctgatgcctacttaat

SEQ ID NO: 23012 - DNA, 57 bp, Neocallimastix californiae
  FASYNTHASE
accaggtaatcgtgatgctatccttaaggttatccaaatcgctcgtaccttcccaca

SEQ ID NO: 23013 - DNA, 69 bp, Neocallimastix californiae
  FASYNTHASE
ctcctctaacattggatactcccgtgtctccggtgatgttaatccaattcatactaacccatactttgc

SEQ ID NO: 23014 - DNA, 75 bp, Neocallimastix californiae
  FASYNTHASE
taagccaccaccattcattccaaatatggataagcaattcaagtactggttcaagaaggatagtttatggcaatc

SEQ ID NO: 23015 - DNA, 60 bp, Neocallimastix californiae
  FASYNTHASE
gccaattattatgcaatggactggtggtcgtgctggtggtcaccactctttcgaagattt

SEQ ID NO: 23016 - DNA, 66 bp, Neocallimastix californiae
  FASYNTHASE
tgctcaattagctgatcttccaggtaacattactcacggtatgtggactagtgcctctactcgtaa

SEQ ID NO: 23017 - DNA, 60 bp, Neocallimastix californiae
  FASYNTHASE
tttcattcaacaaaacagtgcttttgctggtcatagtttaggtgaatatgctgccttaac

SEQ ID NO: 23018 - DNA, 60 bp, Neocallimastix californiae
  FASYNTHASE
tgctgaagttgaacaacctattactgcttatgtcttcactggtcaaggtgctcaagaagt

SEQ ID NO: 23019 - DNA, 57 bp, Neocallimastix californiae
  FASYNTHASE
tcttaaggatatgacttattatgaagttttacgtcgtatgcttgaacttatgtatcc

SEQ ID NO: 23020 - DNA, 66 bp, Neocallimastix californiae
  FASYNTHASE
ctatcgtggtatgactatgcaaagagccgttcaacgtgattctaagggtcgttccgattatgctat

SEQ ID NO: 23021 - DNA, 72 bp, Neocallimastix californiae
  FASYNTHASE
tatgggtatggacttgtatgaaaagtcaccagtagctagagaaatttgggatcgtgctgatgctcacttgat

SEQ ID NO: 23022 - DNA, 57 bp, Neocallimastix californiae
  FASYNTHASE
accaggtagtgtatctgctattcaacaagttattgctattgctaagcaaaatccaga

SEQ ID NO: 23023 - DNA, 60 bp, Neocallimastix californiae; identical to SEQ ID NO: 23015
  FASYNTHASE

SEQ ID NO: 23024 - DNA, 72 bp, Neocallimastix californiae; identical to SEQ ID NO: 23021
  FASYNTHASE

SEQ ID NO: 23025 - DNA, 75 bp, Neocallimastix californiae; identical to SEQ ID NO: 23014
  FASYNTHASE

SEQ ID NO: 23026 - DNA, 60 bp, Neocallimastix californiae; identical to SEQ ID NO: 23017
  FASYNTHASE

SEQ ID NO: 23027 - DNA, 66 bp, Neocallimastix californiae; identical to SEQ ID NO: 23016
  FASYNTHASE

SEQ ID NO: 23028 - DNA, 60 bp, Neocallimastix californiae; identical to SEQ ID NO: 23018
  FASYNTHASE

SEQ ID NO: 23029 - DNA, 57 bp, Neocallimastix californiae
  FASYNTHASE
tagtgcttgtattaatgctggttatcatattgaattggctggtggtggtcaacactc

SEQ ID NO: 23030 - DNA, 57 bp, Neocallimastix californiae; identical to SEQ ID NO: 23022
  FASYNTHASE

SEQ ID NO: 23031 - DNA, 66 bp, Neocallimastix californiae; identical to SEQ ID NO: 23020
  FASYNTHASE

SEQ ID NO: 23032 - DNA, 63 bp, Neocallimastix californiae
  FASYNTHASE
tcgtttcagtcgtttacttggtaaaccaccacttatggttggtggtatgactccaactactgc

SEQ ID NO: 23033 - DNA, 57 bp, Neocallimastix californiae; identical to SEQ ID NO: 23019
  FASYNTHASE

SEQ ID NO: 23034 - DNA, 69 bp, Neocallimastix californiae; identical to SEQ ID NO: 23013
  FASYNTHASE

SEQ ID NO: 23035 - DNA, 72 bp, Neocallimastix californiae
  FASYNTHASE
tatgggtatggatttgtatgaaaagtctccagttgcaagagaaatttgggatcgtgcggatgctcacttaat

SEQ ID NO: 23036 - DNA, 60 bp, Neocallimastix californiae
  FASYNTHASE
gccaattattatgcaatggactggtggtcgtgctggtggtcaccactcttttgaagattt

SEQ ID NO: 23037 - DNA, 63 bp, Neocallimastix californiae
  FASYNTHASE
ccgtttcagtcgtttactcggaaagccaccacttatggtaggtggaatgacgccaactactgc

SEQ ID NO: 23038 - DNA, 57 bp, Neocallimastix californiae
  FASYNTHASE
tcttaaggatatgacttattatgaagttttacgtcgtatgcttgaactcatgtatcc

SEQ ID NO: 23039 - DNA, 57 bp, Neocallimastix californiae
  FASYNTHASE
tagtgcatgtatcaatgcaggttatcatattgaattagctggtggtggtcaacactc

SEQ ID NO: 23040 - DNA, 66 bp, Neocallimastix californiae
  FASYNTHASE
tgctcaattagctgatcttccaggtaacattactcacggtatgtggactagtgcttccactcgtaa

SEQ ID NO: 23041 - DNA, 60 bp, Neocallimastix californiae
  FASYNTHASE
tgctgaggtggaacaaccaattactgcctatgttttcactggtcaaggtgctcaagaagt

SEQ ID NO: 23042 - DNA, 60 bp, Neocallimastix californiae
  FASYNTHASE
tttcatccaacaaaatagtgctttcgctggtcacagtttaggtgaatatgccgccttaac

SEQ ID NO: 23043 - DNA, 75 bp, Neocallimastix californiae
  FASYNTHASE
taaaccaccaccattcattccaaacatggacaaacaattcaaatactggtttaagaaggatagtttatggcaatc

SEQ ID NO: 23044 - DNA, 57 bp, Neocallimastix californiae
  FASYNTHASE
gccaggtagtgtatctgctattcaacaagttattgctattgctaagcaaaacccaga

SEQ ID NO: 23045 - DNA, 69 bp, Neocallimastix californiae
  FASYNTHASE
ctcttccaacttaggatactctcgtgtttccggtgatgttaacccaatacacactaatccatactttgc

SEQ ID NO: 23046 - DNA, 66 bp, Neocallimastix californiae
  FASYNTHASE
ctatcgtggtatgaccatgcagagagctgttcaacgtgattccaagggtcgttctgattatgctat

SEQ ID NO: 23047 - DNA, 60 bp, Neocallimastix californiae
  FASYNTHASE
gccaattgttgttgaatggactggtggacgtagtggtggtcaccactcttgtgaggattt

SEQ ID NO: 23048 - DNA, 66 bp, Neocallimastix californiae
  FASYNTHASE
tgctaacttggctgatcttgatgttccaattactcacggtatgtggactagtgccgctactcgtcg

SEQ ID NO: 23049 - DNA, 72 bp, Neocallimastix californiae
  FASYNTHASE
tatgggtcaagaactctacaacaaatctgctgttgccaaggctgtttgggatagagctgatgcctacttaat

SEQ ID NO: 23050 - DNA, 60 bp, Neocallimastix californiae
  FASYNTHASE
agccgaagttaagcaaaagccaactgcctacgttttcactggtcaaggtgctcaagaagt

SEQ ID NO: 23051 - DNA, 66 bp, Neocallimastix californiae
  FASYNTHASE
ctaccgtggtcttgttatgcaatcctctgtcgaaagagatgaattaaaccgttctgactacgctat

SEQ ID NO: 23052 - DNA, 57 bp, Neocallimastix californiae
  FASYNTHASE
ttctgctgttattaatgccggttacaatgttgaagttggttgtggtgctctttacgc

SEQ ID NO: 23053 - DNA, 75 bp, Neocallimastix californiae
  FASYNTHASE
aaaaccaccaccattcatctgtgttctcgatgatgaattccacgtttggttaaagcgtgatagtttatggcaagc

SEQ ID NO: 23054 - DNA, 69 bp, Neocallimastix californiae
  FASYNTHASE
aaacactaacgaagattactctcttgcctctggtgatgttaatccaattcacaccaactactactttgc

SEQ ID NO: 23055 - DNA, 57 bp, Neocallimastix californiae
  FASYNTHASE
tattgaagaaatgacctacgaagaagttattctccgtttaattgaattacttttcgt

SEQ ID NO: 23056 - DNA, 57 bp, Neocallimastix californiae
  FASYNTHASE
gccaggtaaccgtgatgctatccttaaggttattcaaatcgctcgtaccttcccaca

SEQ ID NO: 23057 - DNA, 63 bp, Neocallimastix californiae
  FASYNTHASE
tcgttacactcgtttaactggtcgtccacctcttcttgttggtggtatgactccaactactgc

SEQ ID NO: 23058 - DNA, 60 bp, Neocallimastix californiae
  FASYNTHASE
ttacatctgtgatgatgctgtctatgctggtcactctcttggtgaatatgccgctctttc

SEQ ID NO: 23059 - DNA, 63 bp, Anaeromyces robustus
  FASYNTHASE
tcgttacactcgtcttactggtcgtccacctcttttagttggtggtatgactccaactacagc

SEQ ID NO: 23060 - DNA, 75 bp, Anaeromyces robustus
  FASYNTHASE
aaaaccaccaccattcatttgtgttcttgatgaagaattccacgtttggttaaagcgtgatagtttatggcaagc

SEQ ID NO: 23061 - DNA, 60 bp, Anaeromyces robustus
  FASYNTHASE
gccaatggttgttgaatggactggtggacgtagtggtggtcatcactcttgtgaagactt

SEQ ID NO: 23062 - DNA, 57 bp, Anaeromyces robustus
  FASYNTHASE
accaggtaatcgtgatgctattatgaaggttattcaaattgctcgtaccttcccaga

SEQ ID NO: 23063 - DNA, 69 bp, Anaeromyces robustus
  FASYNTHASE
aaataccaatgaagattattctcttgcctctggtgatgttaatccaattcacaccaactattactttgc

SEQ ID NO: 23064 - DNA, 60 bp, Anaeromyces robustus
  FASYNTHASE
agctgaagttaaacaaaagccaactgcttatgtctttactggtcaaggtgctcaagaagt

SEQ ID NO: 23065 - DNA, 57 bp, Anaeromyces robustus
  FASYNTHASE
ttccgctgttattaatgctggttataatgttgaaattggttgtggtgctctttacgc

SEQ ID NO: 23066 - DNA, 57 bp, Anaeromyces robustus
  FASYNTHASE
tattgaagaaatgacctatgctgaagttattttacgtttaattgaattacttttcgt

SEQ ID NO: 23067 - DNA, 72 bp, Anaeromyces robustus
  FASYNTHASE
tatgggacaagaattatataataaatcggctgtcgctaaatccgtttgggatagagctgatgcctatttaat

SEQ ID NO: 23068 - DNA, 60 bp, Anaeromyces robustus
  FASYNTHASE
ttacatttgtgatgatgccgtttatgctggtcactctcttggtgaatatgctgctcttag

SEQ ID NO: 23069 - DNA, 66 bp, Anaeromyces robustus
  FASYNTHASE
tgctaatttagctgatcttgatgttccaattactcatggtatgtggactagtgctgctacccgtcg

SEQ ID NO: 23070 - DNA, 66 bp, Anaeromyces robustus
  FASYNTHASE
ctaccgtggtcttgttatgcaatcctctgtagaaagagatgctcttaaccgttctgattatgctat

SEQ ID NO: 23071 - DNA, 63 bp, Anaeromyces robustus
  FASYNTHASE
tcgtttcagtcgtttacttggtaaacctccacttatggttggtggtatgactccaactactgc

SEQ ID NO: 23072 - DNA, 66 bp, Anaeromyces robustus
  FASYNTHASE
tgctcaattagctgatcttccaggtaacattactcatggtatgtggactagtgcttctactcgtaa

SEQ ID NO: 23073 - DNA, 66 bp, Anaeromyces robustus
  FASYNTHASE
ctatcgtggtatgactatgcaaagagctgtccaacgtgattctaagggacgttccgattatgctat

SEQ ID NO: 23074 - DNA, 75 bp, Anaeromyces robustus
  FASYNTHASE
taagccaccaccattcattccaaatatggacaagtctttcaaatattggtttaagaaggatagtttatggcaatc

SEQ ID NO: 23075 - DNA, 57 bp, Anaeromyces robustus
  FASYNTHASE
tagtgcttgtattaatgctggatatcatattgaattagctggtggtggtcaacactc

SEQ ID NO: 23076 - DNA, 69 bp, Anaeromyces robustus
  FASYNTHASE
ctcctctaaccttggttattcacgtgtttctggtgatgtcaatccaattcatactaatccatactttgc

SEQ ID NO: 23077 - DNA, 57 bp, Anaeromyces robustus
  FASYNTHASE
accaggtagtgttagtgctattaaacaagttattgctattgccagacaaaatccaga

SEQ ID NO: 23078 - DNA, 60 bp, Anaeromyces robustus
  FASYNTHASE
tgctgaagttgaacaaccaattactgcttatgtctttactggtcaaggtgctcaagaagt

SEQ ID NO: 23079 - DNA, 60 bp, Anaeromyces robustus
  FASYNTHASE
gccaattattatgcaatggactggtggtcgtgctggtggtcaccactcctttgaagattt

SEQ ID NO: 23080 - DNA, 57 bp, Anaeromyces robustus
  FASYNTHASE
tcttaaagatatgacttactatgaagttttacgtcgtatgcttgaattaatgtatcc

SEQ ID NO: 23081 - DNA, 72 bp, Anaeromyces robustus
  FASYNTHASE
tatgggtatggacttgtatgaaaaatctgctgttgctagagaaatttgggatcgtgctgatgctcacttaat

SEQ ID NO: 23082 - DNA, 60 bp, Anaeromyces robustus
  FASYNTHASE
tttcattcaacaaaatagtgctttcgctggtcacagtttaggtgaatatgctgccttaac

SEQ ID NO: 23083 - DNA, 63 bp, Piromyces finnis
  FASYNTHASE
tcgtttcagtcgtttaattggtaaaccaccacttatggttggtggtatgactccaactacagc

SEQ ID NO: 23084 - DNA, 66 bp, Piromyces finnis
  FASYNTHASE
tgctcaattagctgatcttcctggtaatattactcatggtatgtggactagtgcctctactcgtaa

SEQ ID NO: 23085 - DNA, 57 bp, Piromyces finnis
  FASYNTHASE
ccttaaggatatgacctactacgaagttttacgtcgtatgcttgaacttatgtatcc

SEQ ID NO: 23086 - DNA, 72 bp, Piromyces finnis
  FASYNTHASE
tatgggtatggacttatatgaaaaatccccagttgctagagaaatttgggatcgtgctgataagcatttaat

SEQ ID NO: 23087 - DNA, 60 bp, Piromyces finnis
  FASYNTHASE
ttacattcaacaaaacagtgcttttgctggtcacagtttaggtgaatatgccgctttaac

SEQ ID NO: 23088 - DNA, 57 bp, Piromyces finnis
  FASYNTHASE
cggtgcttgtataaacgctggataccacattgaattagctggtggtggtcaacactc

SEQ ID NO: 23089 - DNA, 57 bp, Piromyces finnis
  FASYNTHASE
gccaggaagtgtttctgctatccaacaagttattgctattgctaaacaaaatccaga

SEQ ID NO: 23090 - DNA, 75 bp, Piromyces finnis
  FASYNTHASE
taagccaccaccatatattccaattatggacaagtcattcaaatattggtttaagaaggatagtttatggcaatc

SEQ ID NO: 23091 - DNA, 60 bp, Piromyces finnis
  FASYNTHASE
tgctgaagttgaacaaccaattactgcttatgtcttcactggtcaaggtgctcaagaagt

SEQ ID NO: 23092 - DNA, 66 bp, Piromyces finnis
  FASYNTHASE
ctatcgtggtatgactatgcaaagagctgtccaacgtgattctaagggacgttctgactatgctat

SEQ ID NO: 23093 - DNA, 69 bp, Piromyces finnis
  FASYNTHASE
ctcctctaaccttggatactctcgtgtatcaggtgatgttaacccaatccacactaatccatactttgc

SEQ ID NO: 23094 - DNA, 60 bp, Piromyces finnis
  FASYNTHASE
gccaataattatgcaatggactggtggtcgtgctggtggtcaccactctttcgaagattt

SEQ ID NO: 23095 - DNA, 63 bp, Piromyces finnis; identical to SEQ ID NO: 23083
  FASYNTHASE

SEQ ID NO: 23096 - DNA, 66 bp, Piromyces finnis; identical to SEQ ID NO: 23084
  FASYNTHASE

SEQ ID NO: 23097 - DNA, 57 bp, Piromyces finnis; identical to SEQ ID NO: 23085
  FASYNTHASE

SEQ ID NO: 23098 - DNA, 72 bp, Piromyces finnis; identical to SEQ ID NO: 23086
  FASYNTHASE

SEQ ID NO: 23099 - DNA, 60 bp, Piromyces finnis; identical to SEQ ID NO: 23087
  FASYNTHASE

SEQ ID NO: 23100 - DNA, 57 bp, Piromyces finnis; identical to SEQ ID NO: 23088
  FASYNTHASE

SEQ ID NO: 23101 - DNA, 57 bp, Piromyces finnis; identical to SEQ ID NO: 23089
  FASYNTHASE

SEQ ID NO: 23102 - DNA, 75 bp, Piromyces finnis; identical to SEQ ID NO: 23090
  FASYNTHASE

SEQ ID NO: 23103 - DNA, 60 bp, Piromyces finnis; identical to SEQ ID NO: 23091
  FASYNTHASE

SEQ ID NO: 23104 - DNA, 66 bp, Piromyces finnis; identical to SEQ ID NO: 23092
  FASYNTHASE

SEQ ID NO: 23105 - DNA, 69 bp, Piromyces finnis; identical to SEQ ID NO: 23093
  FASYNTHASE

SEQ ID NO: 23106 - DNA, 60 bp, Piromyces finnis; identical to SEQ ID NO: 23094
  FASYNTHASE

SEQ ID NO: 23107 - DNA, 63 bp, Piromyces finnis; identical to SEQ ID NO: 23083
  FASYNTHASE

SEQ ID NO: 23108 - DNA, 66 bp, Piromyces finnis; identical to SEQ ID NO: 23084
  FASYNTHASE

SEQ ID NO: 23109 - DNA, 57 bp, Piromyces finnis; identical to SEQ ID NO: 23085
  FASYNTHASE

SEQ ID NO: 23110 - DNA, 72 bp, Piromyces finnis; identical to SEQ ID NO: 23086
  FASYNTHASE

SEQ ID NO: 23111 - DNA, 60 bp, Piromyces finnis; identical to SEQ ID NO: 23087
  FASYNTHASE

SEQ ID NO: 23112 - DNA, 57 bp, Piromyces finnis; identical to SEQ ID NO: 23088
  FASYNTHASE

SEQ ID NO: 23113 - DNA, 57 bp, Piromyces finnis; identical to SEQ ID NO: 23089
  FASYNTHASE

SEQ ID NO: 23114 - DNA, 75 bp, Piromyces finnis; identical to SEQ ID NO: 23090
  FASYNTHASE

SEQ ID NO: 23115 - DNA, 60 bp, Piromyces finnis; identical to SEQ ID NO: 23091
  FASYNTHASE

SEQ ID NO: 23116 - DNA, 66 bp, Piromyces finnis; identical to SEQ ID NO: 23092
  FASYNTHASE

SEQ ID NO: 23117 - DNA, 69 bp, Piromyces finnis; identical to SEQ ID NO: 23093
  FASYNTHASE

SEQ ID NO: 23118 - DNA, 60 bp, Piromyces finnis; identical to SEQ ID NO: 23094
  FASYNTHASE

SEQ ID NO: 23119 - DNA, 63 bp, Piromyces finnis; identical to SEQ ID NO: 23083
  FASYNTHASE

SEQ ID NO: 23120 - DNA, 66 bp, Piromyces finnis; identical to SEQ ID NO: 23084
  FASYNTHASE

SEQ ID NO: 23121 - DNA, 57 bp, Piromyces finnis; identical to SEQ ID NO: 23085
  FASYNTHASE

SEQ ID NO: 23122 - DNA, 72 bp, Piromyces finnis; identical to SEQ ID NO: 23086
  FASYNTHASE

SEQ ID NO: 23123 - DNA, 60 bp, Piromyces finnis; identical to SEQ ID NO: 23087
  FASYNTHASE

SEQ ID NO: 23124 - DNA, 57 bp, Piromyces finnis; identical to SEQ ID NO: 23088
  FASYNTHASE

SEQ ID NO: 23125 - DNA, 57 bp, Piromyces finnis; identical to SEQ ID NO: 23089
  FASYNTHASE

SEQ ID NO: 23126 - DNA, 75 bp, Piromyces finnis; identical to SEQ ID NO: 23090
  FASYNTHASE

SEQ ID NO: 23127 - DNA, 60 bp, Piromyces finnis; identical to SEQ ID NO: 23091
  FASYNTHASE

SEQ ID NO: 23128 - DNA, 66 bp, Piromyces finnis; identical to SEQ ID NO: 23092
  FASYNTHASE

SEQ ID NO: 23129 - DNA, 69 bp, Piromyces finnis; identical to SEQ ID NO: 23093
  FASYNTHASE

SEQ ID NO: 23130 - DNA, 60 bp, Piromyces finnis; identical to SEQ ID NO: 23094
  FASYNTHASE

SEQ ID NO: 23131 - DNA, 10819 bp, Neocallimastix californiae
  FATTY ACID SYNTHASE SUBUNIT BETA
tgttccagaagaaaactggtcatgtgctgaacaaattgcttatgattttaattcaaccttcaaaaatacatttgttgttgatgatgaagatgttgaaaagaagaacactttaaacggtttctggatttatgttcactttatggaatttgctactcgttaccaagctgacaacaagactttattaactcaaaaggatattactcatttattaattaacttatttattgatttcagtattcgtttccttaaaggtaatgatattcacattagaactcgtcattttgaacatgaattccgtattcaagttattcaacacttctacactgtcttcgactatttacaaaaggatgaagaagctgctaatgctattgctaacttcttaccagttgaaccagctttagctaaggctgttcgtgctggtgatgctcttgctcttgctgttttcggtggtcaaggttacccaggttttaatgaaattcttcaagcttatactatgtatggtgccatcgttcgtgactacattgctgaactttccaccattttaaaggaattagcttctaagccagagttccaacgtacctacaaacaaggtcttgatattttaaaatggttacgtaacccagaatctcttccagaagatgcttacttagattctgctccagtttccttcccattaattggtattgttcaattagttcaatacttaattcttttccgtaccttccgtaaaactccagattgggctcgtcatttattcgctggtactactggtcactcccaaggtttagttacctctgttgttattgcttcatctggtaccgaagaagaatacttggaaaactctaagaaggctgtttccttattattcttgattggtgctcgttcccaacaaatttttgctattactccattatctccagaaactcttcaagaaattgctgataatggtgatgaaaatgacatgccaacttgtatgctttccattaacggtttaccagaagctaccgttcgtcaagctgttaacgatttaaacaaattcattgaagatccagctcgtaaggttaccatttctcttattaatggtcttcgtatgatcgttgttaccggtgctccagaatctcttcaaaatcttaagatgagtcttaagaagattcaagctggtccaaatgaagatcaatctcgtattccattctctaagagaaagcaaatctttaccatgaagttcctttctgttactattccagctcacaatgaaatcttaaaggaagctgctgaattagttgttgaagatgctgccaagttaaacattacattcccaactaagaacttagctattccagtctaccgtactgataatggtgttgatatgaaggaagaatctgatattactgatgttgttgaacctgttgtcaaccaaatttgtatcttaccagtcgattgggttaaggccactaatgttccaggattaactcacgttttagatttcggacctggtggtgcctctggtattggttctcttatccaaaagaacaaggaaggtactggtgttcaagttattctttccggtactcttgctagtactaacccagacttaaagtgtaagatgtacgcttacactactgaacttgatgaccttccatacggtattaactgggctaaggaatttgctccaaagcttattagaaatgctgatggtgaactcttaatggatactcgttacactcgtttaactggtcgtccacctcttcttgttggtggtatgactccaactaccgctaacccacaatttgtttctgccgttattaacgccggttacaatgttgaagttggttgtggtgctctttacgcccctcacgttttagataaatgtattaaggatattgttgaaagaattccagatggtgaaggtatcctctgtaacattgttttccttaaccaacgtctttgggccttccaattcccaggtgtcttagatatgcgtaagaaccgtggtattcgtattgaaggtattaccattgctgctggtgtcccatctcttgaatactgtaataagatgatcccacaacttattgatgccggtattccatacattggtttcaaaccaggtaatcgtgatgctatccttaaggttatccaaatcgctcgtaccttcccacaaatgccaattgttgttgaatggactggtggacgtagtggtggtcatcactcttgtgaagatttctatgccccaattcttgaaacctacgctgctttacgtaagcaatccaacattgttgtcgttgttggttccggttttggtgatgatgtcggtactcttccatacattactggtgactggagtattgaattaggttatccaccaatgccatttgatggtttattagttggttctcgtgtctgtgttgctaaggaagctcttaccagtgatggtattaaggaagttattgtcaatactccaggtattgaagatcaatcccaatgggaaaagtcctacgatcaaccagttggtggtgtcgttaccgttgaatctgaatatggtgaaccaattcacaagattgctactcgtggtgttatgttctggaaggaattagataagaccatcttctccattcacgatccaaagaagagattagaaaagcttcttgaaaagaaggattacatcattgaacgtcttaacaaggacttccaaaaggtttggttcggtaagaagaatggtaagccatgtgatattgaagaaatgacctatgaagaagttattctacgtttaatcgaattacttttcgttcaaaagcgtaagcaatggcttgatgttagtcacttaaagaccacctatgactttattaatcgtactgaagaacgttttgttcaaaacagttctcaagatgccttcctttccagcatcgaagatctcgatgttgaagatccagtagctctcatgaaggaattctttgatactcgtgctccaggagctcgtactgaattattagctactgaagatgttcaatactttattggtttgacacgtaacaaggacagaaaaccaccaccattcatctgtgttctcgatgaagaattccacgtttggttaaagcgtgatagtttatggcaagctgaagatttagatgccgttgtcgaccaagacccacaacgtgttgccattttacaaggtccagtcgccattcgtcactctaagattgctaatcaacctgttaaggaaatcttggatggtatcatcaagtctcacattaagtccattgaagctcgttactacgctaaccgtgctgttccaaatgttgaatacctcggtggttctccaattccagctagcgtttctgacgttccagctaacgtaaaggttgaaaaggaaggtaacaccatgatctacactcttccagctcaagaagatcaattacctgctgataaggaatggatcgaattcatggctggtccaaagtatggttggttgagagctttattatgtacgccaactattgctcgtaacaagtctatcactcacaaccgtttcatgcgtgtcttcaagccacgtaccagtcaaattgttaagattttccacaacgatgaaggtgacattaccaagattgaaatctttggttggaaccgtagtatggaacttccagctcttgaagctgaaattgatagccaacgtatcattactgttggtttacgtgaatggggtgttccaggtgttgctggtgctgaagttatgaagcttctcttccgttacactccaaatcaaggttccactccaattcatgaagtcatggaaggtcgtaacagacgtattgctgaattctactacaacttatggtatggtccagaagattctggtgatggttggggtgatttaacttccatctacaaatgtaagaagcgtgtcaccgaagaagatgtgaagttcttctctgatgttacccgttacactcatccatccaacaaggttgttccatccatggactttatcattgttacctcctgggtttctgtcttcaagactatctttgccaaggaatttgatgctgatatcacacgtttagtccacatgaacaacggttatgaagtcattgatccacgtccattacgtattggtgaagttgttgatactcgttccatcatttctgctgttactaaccttgactctggtaagttaattgaggttactggtcatgtcttcagagaaggtaaggaatacgttaaggttacctctagcttcttatgtcgtggtaagtttgatgattaccacatgaccttcaacatccgtgatgaaccagaatacattcttgaagttaaggatgataagattcttaacgctctcatgacccgtaagtacatctccttcaccgaaccagaaaagattcaacttggtgtaaagttagtcttcagattaaagaccgaaaagcgttttgctacgaagaatacttacagcagtattactactaagggtaagatctacattaataatagtgccgtccacggattcaacatggaagaagttggtcaattcaactacgattctactacagatgaaaagttggaaggtaagagtgaaactcttggtaatccagctatcgaattcattaagaagtacgctaaggctaatgatcgtaagatctactttgaaaacggtggttacaacattcttccaaagggtgtcagtcttcttcaacgtgctccaaacactaatgaagattactctcttgcctctggtgatgtaaatccaattcacactaactactactttgctaacttggctgatcttgatgttccaattactcacggtatgtggactagtgctgctactcgtcgttatgttgaaacctatgccgctgataatgatgctgaacgtgtcgtttcctacaaggttaactttataggtatggtttctccaaaggatgaacttcgtaccagccttactcatgttggtatgcacaatggtagaaagatcattaaggtttccgtcaaggacttacgtactaacgaaaccgttatggaaggtgaagctgaagttaagcaaaagccaactgcctacgttttcactggtcaaggtgctcaagaagttggtatgggtcaagatctctacaacaaatctgctgttgccaaggctgtttgggatagagctgatgcctacttaatgaagaagtacggttactctatcttggaaattgttcgtactaatccaaagtcccttaccgtttactttggcggtgaagatggtgaaaagattcgtgaaaactatatcaatatgacttgtgaaattattgattctaatggaaaggttcaaaccaaacgtatgttcccagaaattgatgaaaacaccctctactatgaatacaaatccccaactggtttgttaaatgctactcaattcactcaaccagcaattacccttactgaaaaggctgcctttgaagatatgtatgaaaagggttacatttgtgatgatgcagtttacgccggtcactctcttggtgaatacgctgctctttcctgtgttgctaacaccttaagtattgaaagtatggctgaaattgtcttctaccgtggtcttgtcatgcaatcctctgtcgaaagagatgaattaaaccgttctgactacgctatgtgtgccgttaatccagttcgtgtccatccatacttctcattcgatttattagttgaagttgtaaagaagattaacgccgaacatggtggtctcttggaaattgtaaactacaatgttgaaaactatcaatacgttgttaccggtgacttaacctctcttgaagctcttaagaacttattaactaatcttcgtgctgaagctaagaagttcatcaccttatacaaggaagatgctactcaagctatggaacttttaaacgaaaaggttcgtacctacgttaaattagctgaagaacgtaaggctaaggaaggtttcttcaatattgaaagaggtgctgctactattccacttcgtggtattgatgttccattccactccagttacttactttggggtgttccaaccttccgtgaattacttcaccaacgtgtccgtcgtgaagatgttgatgttaaatgtcttgttggtcgttacattccaaacttgatgggtgaaccattctctgttgaaaaggattatgctattcgtcttcaaaagcgtactaactctgcctacttggaaaagattattgaagaatgggatcaacacttgtttgaaattccatacattattatggttgaattattatcttatcaattagcttctgctgttcaatggattaagactcaagaattcttattcagttctcaaaagaagggtggtgctgatattgaacgtcttattgaatttggtccaactccaactttagttggtatggctaaacgtactcttggtatgaaatatgttaaatctgatcttgctcttggtaaaaaacgtcaactcttatcttatgctaagaatacaaccgatatctattacgaatatgatgatatggaatttgaagaagaagaagccgctgctccagttgaagaagctccaaaggctgctccagctccaactccagctccagctccagctccagttccagttgccgctccagccccagttgctgctgctccagctgcttctgttgccgatgctccagttactgctactgaaattttacgtgctattttagctcaaaagttaaagaaatctattagtgaagttccattaaataaatctattaaggaattatccggtggtcgtagtactattcaaaatgaagtttctggtgatttacatactgaatttggtggtaattctattccattaaaggctgaagaacttgctcttgaagaacttggtaaacaaatttcttctactttcaatggtcaattaggtaaatacactactcaaatgattaatcgtatgctttctggaaagatgccagcaggtttctctgcctctgctgttaagacttacttggctaatacctatggtcttggtaagggtcgtactgatggtgtattattagttgctattacaatggaaccatcctctcgtttaggttctgaagctgatgctcaaggatggttagataatgtcgtcagtgcttactctgctgtttctggtgttgcccttagtaagggtagtgctgctccagctgctgctgctgttgctgctccagttatgccagttgctatgccagttgctgctgccgctggtccagctgctgctgttgctgacgctcctatctcaccaaatgaaattattcgtgtcatgttggctcaaaaattgaaaaaatctattaatgaaattccattatcaaagtctattaaggaattatctggtggtcgtagtaccgttcaaaatgaagtttctggtgatttacatactgaatttggtggtaattctattccattaaaggctgaagaacttgccattactgaattaggtggtgctattggtgctaatcacagtggtaaattaggtaaatacacttctactatggttaatcgtatgcttagtggtaagatgccagctggtttctctgcttctaaggctaaggattaccttaagacaagttatggtttaggagaaagaagaaccgatgccgttttactttacagtaccactattgaaccaacttctcgtttaggttccgaagctgatgctcaagcttggttagataaggctgtcgatctctactctggtgctaattctcttggtcttgctaagggtggtgccggtggtgccgttgctgctgctgttccaggtgttgctgctatgggtatggtcaacagtgccgaagttactgccttaaagatgaaacaagattcacttattcgtactcaattagaaaactatgccaagtacctcggtattgatttacgtgaagatcaaaagaaattagtagcctcttctgaatccactgctaagcttcaatctgatcttgatttatggttcgatgaacatggtgaagattacgccaatggtattaagccaatgttcactagtaagaaggctcgtacctacgattctagctggaactggggttaccaagacttctggttcatggtttatgatattcttgctggtgaaaagaaggatgctgatgctcttattgcttccgatgtcttcagaaccatggtgaatcgtgctaatgcttccttagaacaacaagttgaatttgttcaccgtaaggtcgttgctgatcaaaaggatgctgaaattaaggctactcttgaaaaggttactggtgctctcttagaagccatcaaggcctcctctggtaagcccgtcttcaagttcaatggtccattccaagctccacatgctcttgttgatgaagaaggtaaattggtttacaaggaaattccacgtaagggtattaacagtgctgttgattacgttaaggaaatgcaagaaggtgctatgcaaactattggttctactaccaagaagattccattcctctttgttcgtgatcaagccgccaacggtgttgacaacgttgatgaagctatgtccaagatttacttgaacgaactcaagaagattgccgaagaaggtatctcctttactggtaagcatgttcttatcactggttgtggtagaaactcaattggtgaatgtgttcttaagtacctcttagctggtggtgctaaggttgttgctactacctctagctaccgtcgtgctaccatggaacactttagaagtgtatatgaacaagttggtactaagggttccactttagttgttgttccattcaaccaaggttctaagaaggatgtcaatgatctcattgaattcatctactctaaggatagtcgtgtcaacggtctcggttgggatcttgacttggttattccattcgctgctatctctgaaaatggtcgtgatattagtgacttggatggtaagagtgaattagctcaccgtattatgatgaccaatgttattcgtattcttggtgctgttcgtactcaaaagatgaaggttggttcacttgtctctgctcaagttatccttccattatctcctaaccacggtacttttggtggtgatggtttatacggtgaatctaagattggtttggagaacctcttaaaccgttggagatctgaaacctggtctaagtacctttctatcactggtgcctgcatcggttggacgagaggtaccggtttaatgaacagtaacaaccttatctctgaaggtattgaaagccaaggtacctgccgtactttcactaccactgaaatggccttcaacttgattggtcttgtttctgatgttatggtctccctttctcgtaagagtccaatctacgctgatcttaacggtggtatgcaatatatggctgatatgaacgttgcccttcgtcacattcgtgaaaagatgaccgatgaatctgaaaagaagagaatggtcattgatgaagaaaaggctcatgctgatattgttggtgccaacaaggttgaaagcaagagacatgttgaaccacgttccaacattcgtattcaattcccagaattaaagagtcgtgaagaattaaaggatatggaataccttcgtgacttattagatcttgaccgtgtcgttgttgttaccggttacggtgaagttggtccatacggtaacactcgtactcgttgggaaatggaagctgatggtaagttctctcttgaaggttgtgttgaattagcctggattatgggattcatcaaacatgttacctataagcaaatgccagatggtaccttatactctggttgggttgatgctaagtctggtgctccaatcaaggatattgatattaaggctacctacgaaaaggatattcttgcccacactggtattcgtctcattgaaccagaactcttcaacggttacaacccagaaaagaagaagttccttcaagaagttatggttgacactgatcttccaccattcgaagctagtaaggaagaagctgaaaccttcaagcgtcaacacgaagataaggttgaaatctatgaagttggtgatggtcgttacatggttcgtatccttaagggtgcttccatctacgttgctaaggcccttcaatttgaccgtttagtttctggtcaattaccaaccggttgggatccagctcgttacggtattccaaaagatatcattgaacaagttgatatcattacctgctactgtattgtctctgctgttgaagccttagttagtgctggtattactgatccatacgaattctacgaatacgtccacgtttctgaagttggaaatgcctgtggttctggtgttggtgctgaacttgccaaccgtgctatcttcaaggaccgtttccttgacaagccacttcaaagtgatattcttcaagaaaccttcgttaataccatgagtgcctggattaacttattattactttcttcctctggtccaattcgtaccccagttggtgcctgtgcctctgccgttgaatctgttgatatcggtattgatactattttatctggtaaggctaaggttgtctttgtcggtggttatgatgacttccaagaagaaggttcctatgaattcgctcaaatgaaggctacctctaactctcgtgaagaaatggctcaaggtcgtgaaccaaatgaaatgtctagaccaactgcctcctctcgtggtggtttcatggaagctcaaggtgttggtacacaagttttaatgccagctagccttgctcttaagatgggtgttccaatctacggtattgttgctcacagtgctactgctaccgataaggaaggtagatctgttccagctccaggtcaaggtatcttaaccact

SEQ ID NO: 23132 - DNA, 9951 bp, Neocallimastix californiae
  FATTY ACID SYNTHASE SUBUNIT BETA
ctctactcaaatgattcgtgatcgtattaagaagattatgtcaaaggttccttctggtgaaggtattactatgaatattatgttcttaaatgccttccaatggggtttccaatatccattagttcaagaaatgagaaaggaaggtgttccacttgatggtttatgtattgctgctggtgttccaagtcttgatgttgctaatgaaattcttggtaatttaaaggcctgtggaattaaacatgttgctttcaaaccaggtagtgtatctgctattcaacaagttattgctattgctaagcaaaatccagatatgccaattattatgcaatggactggtggtcgtgctggtggtcaccactctttcgaagatttccatcaaccaattattgatacttatgcttctattcgtcgtcaaccaaatattattattgttgttggtagtggttttggtgatgctgaaggtacccttccatacttaactggtgaatgggctcgtaagtttggttatccaccaatgccatttgatggtattttattcggtagtagaattttagttgctgctgaagctggtaccagtgaagaagttaagaagttattagttaaatctgaaggtattgaaaatgaaaaggaatgggaaaacacctacaagggtccaactggtggtgttattactgttaagtctgaattaggcgaaccaattcacaagttagctactcgtggtgtcttgttatggaaggaattagatgaaactattttcaatcttccaccagaaaagcaattaccagctttacttgctcgtaaggaatatatcgttcaccgtctcaataaggattaccaaaaggtctggttcccaaagaagtacgatgccgaagatccagaaaaggttgttgatcttaaggatatgacttattatgaagttttacgtcgtatgcttgaacttatgtatccaaatggtcaatggattgatgtttccttaagaatgatttatggtgatttcttccaccgtgttgaagaacgtttctataaggcttctgaaggaaaagaatttgtttccttccttcaatcctatgaacaattagaagaagatccagttggtttattagaaaaattcatggaagaaagagttccagaagctagggttcaattaataaacagtgatgatttaatgtacttcttgaacatctgtagtagacgtgatattaagccaccaccattcattccaaatatggataagcaattcaagtactggttcaagaaggatagtttatggcaatcagaacacttagaagctgttgttggtcaagatccaggtcgtgtttgtgttcttcaaggtccagttgctgttagacattctactaaggctaatgaaccaattagctcaattcttgataccattaatcaagaacacattaaacaattgaaggctcgttactaccaaaacagtgatactgttattccagttgttgactactttggtggtgctgaaattcgtgatgttcgtagaaagattcgcggtgtttctattaagagtgttaagaatgataacatcgttaaaactatgtttgaagttactgccgaaaataatgaagatcttccagatgaaaatgactggtatgatttattagctggacaatactatacctggttacgtgctctcttagcttcaaaggtctttgtcaaggatgatgatggttattatcaggataattgtgttagacgtattcttcgtccaaaaccacatcacattgttgaaattagatcaattaatgataatattgaatcgcttagcatgtttaataagcaaggtggaaatgaagtggttaagattaccattgatgataagaaactcattactgttttaatgaacgaatactccttaaacactaaacttgttcaacttccactcttattccaatacaaaccagaacaaggttatgctccaatccatgaagttatggaaggtagaaatgaacgtattaagcgtttctactacgatttatggtttggccttgacaatggtaagtacacttttgaagatgattacaaccatgatccaagagaaccatttgtcagtgttagtgaaccaattactagacaacaaattaccgatttcgtcaacattattggtaatcgtgctgaatcttacactgaccgtggtcaaaaggtcttatttgctccaatggatttcgctattgttgttggttggcagagtattatccgtgctatcttcccaaaattcatcaatgccgatttattaaagttggttcatttaactaacggattccgtatgattgataatgaatctggtttaaaggaaggtgatattgttaagactgaatctcgtattattagtgttattaatgatgaaactggtaagattgttgaagttaagggtgtcttaaagcgtgatgaaaagccatttatggaagttatttctaagttcttctaccgtggtgtcttttccgattacgattctaccttcaagaatgttgaagaaaaggcttatcatgttaccttaaagaataagaaggatgttcatattcttgaatctcttgattggttcaagatgaccactgatgacgaacaattggctcttactcaaggtgatcaattactctttgaattgaatagtgaatacactttcaagacaagtgatgtttacagtagggtgaagactttcggtactgttaaaaagttattatctactaaggtttatgttgatgttgccaaggttgactatttatatgataaaccagatggttcttgtggtaacccagttattgactttttagaaagaaatggtaaggttcaagatactccagtctactttgaaaatggtggttacagtattatgccaaagggtaagggaatttctagtgttgttaacactcactcctctaacattggatactcccgtgtctccggtgatgttaatccaattcatactaacccatactttgctcaattagctgatcttccaggtaacattactcacggtatgtggactagtgcctctactcgtaagtttgttgaaacctttgctgctgaaaaccatccacatcgtgttacctcttatgaagttaaattcttagatatggtcttcccaggtgatcgtttagaaaccaagcttttccatactggtatggctaatggtaagaaaattattcaatgtaagacgatcaaccaagatggtaaggtggttcttgaaggtactgctgaagttgaacaacctattactgcttatgtcttcactggtcaaggtgctcaagaagtaggtatgggtatggacttgtatgaaaagtcaccagtagctagagaaatttgggatcgtgctgatgctcacttgatggaaaattatggtttctctattattgatattgttaagaataatccaactgaaattactatctactttggtaatgttaagggtcaacaaattcgtaagaattatcaacagatgacttatgaacatgttaattctgatggtgttgttgaaagtctttcactcttcccagaaattgatgacgacagtgtttcctacaccttccgtcacattggaggtttattatcggctactcaattcacacaaccatcccttgttttaatggaaaaggctgcttttgaagaaatgagatctcgtggtttcattcaacaaaacagtgcttttgctggtcatagtttaggtgaatatgctgccttaactgctattggtgatgtcttaagtattgaaacgttggttgatgtcgttttctatcgtggtatgactatgcaaagagccgttcaacgtgattctaagggtcgttccgattatgctatgtgcgccgttaatccaactcgtgttagccgtactttcaacgaaagtgccttacaatatcttgttgctaacattaagaaggttactgaaggtttaattgaaattgtaaactacaatgttgataactggcaatatgttgtttctggtgatcttatttccttacaagttcttactcttgtcttaaactacttaaaggctgaaaagattgatttaactgttttattgaacactctttctgttgaagaagttcaaaagcaagttaatgaaattattagtacttcctttgaaaaggctaaggaacaaaagaaaaagcatggctatattaaattagaacgtggtgctgcttctattccattacgtggtattgatgttccattccactctagtttcttattaagaggtgttgctccattccgtcaatacttgatgagtaagtttgatccaaacttgattgacgttaaccgtttaatcggtaattatattccaaacttaactgctgaaccattctctcttaagaaggaattcattgaaaatatttatgctaaaactaattcttctcgtattaagaatgtcttaaagggttggactgatgataaatacgcttctccacgtcttcaacaaaaattgggttacattcttttaattgaattattagcttaccaatttgctagtgctgtcagatggattgaaactcaagatagattattcgttgatattggtgttgaacgtttaattgaaattggtccaggtccaacactttctggtatggctcaaaagaccttaaagtttaagtatgaatactatgatgatgctaccagttatcgtcgtgaaattctttcttactctaagaactataaggaaatcttttatgactttgaagatgaatctgatccagaagtttctgaagaaccttctgctcctgccgctccagttgctgccgctgcagttccagttccagctccagctccagttccagttgctgctccagttgttgctgctggtagtgttgctgatgaagatattcaagttaaacatttaattaacattcttattgctcaaaagttaaagaagaaggctaatgaagttccaatgactagtactattaaggaattagttggtggtaagtctactcttcaaaatgaagttttaggtgatttacaaaaggaattcggaagcagtaatgttccagataagtctgaagaattaccattaaatgaattagctagtcaaattggtactggttctgttgctctcggtaaatacagtcaaactttagttaataaacttattagtgctaagatggctgctggtttcactaaatctaaaattagtggttatctttctcaaaagtacggtttaggtccaaagagaactgatgccttattattattcggtttaacggatgaaccatccgctcgtttcggtagtgaagatgaagctaaggcttggttagataagattgccactggttattctgcttttgttggtgttggtctttcttctggtgctccagctgctgttgctccaatggctatggctgtagccgctgctccagttgctgctggtgctgctagtgttgctgatgaagatattcaagttaagcacttaattaacattcttattgctcaaaagttaaagaagaaggctaatgaagttccaatgactagtactattaaggaattagttggtggtaagtctactcttcaaaatgaagttttaggtgacttacaaaaggaattcggaagtaataatgttccagataagtctgaagaattaccattaaatgaattagctagtcaaattggttctggttcggttgctctcggtaaatacagtcaaactttggttaacaaacttgttagtgctaagatggctgctggtttcacaaaatctaagattcaagaatatctttctcaaaagtacggtttaggtccaaagagaactgatgccttattattattcggtttaacggatgaaccatccgctcgtttcggtagtgatgttgaagctaaggcttggttagataagattgctccaatgtacttcagttttgttggtgtttctgctggtgctgctccagctgctggtgcggctgccggtgtcccaatgatggcagctccagttaatgctggtgctattgctgaagctactagaaagtatgatcaattgattaaggaacaacttgatattttcttaaactatcttgatattgatccacgtgaaggtttcaatctctatgaagatgaattaaataatgctgctaagttacgtgctgaacttgacctctggatgaatgaacatggtgatgaatatgctcaaggtattaagccaatctttgatccattaaaggttagaaagtacgattcctactggaattgggtccatcaagaatcattaattctttactacgatatcttgtatggtagattagctgttgttgacagaaaggttaccagtcaatgtattcatgttatgaacagagctgatccacatcttattgatcactatgcctatagaattagtgttactgatccaaagaagggtccaacctatgaattagctaaggaatttgctcaaattcttatggaaaactgtactgaagcgatgagtgaaaatccagtttacaaggatgttgatattccaactatgccacaaactacggttactgaaagtggtgaaattaagtatgctgaagttccacgtccaggaattagaaagatggaatcttacattaagttaatgcaagctggtagtagaattactagaattccaacaaagcattctaaccgttctattcgtttcactggtggtaacaataagaccagagtcaagtctaagaaggttccattcctcttccttaaggatccaaaaaccggagaatatgatgaaaagttaaccaaggtctactacaagtctctttacgccatggctaatgatggtattagctttaagaacaagtatgttttaatcactggttgtggtcgtaactccattggttcccaaattattaagggattattaaatggtggtgctaagattattgctactacttccagattcagtaaggcaaccatgcaatactaccgtcaactctatgaagatcatggttctaagggatcttgcttaattgttgttccattcaatgccgcttctgttgaagatgttaatcgcttaatcgattacatttactctaaggatccaaagaatggtttaggatgggatcttgattacgttattccattcgctgccatctccgaaaatggtagaactttagaaaacattgacagtagaagtgaattagctcatagaattatgcttactaacttattaagaatgttaggtaagattgttagccagaaggaggctcacaagtatgatactcgtccagctcaatgtattcttccaatgtctccaaaccatggtaccttcggtggtgatggtctctactctgaatccaagattgctcttgaaaccctcttcaaccgttggcattcagaaggatggggaggttaccttaccgttgctggtgccgtcattggttggaccagaggtactggtttaatgaatagtaataaccttgttgctgaaggtattgaaatgtttggtgttcacactttcagtactcatgaaatggccttcaaccttattggtttaatgcacagtgacatttgtaagctctgtcttaagaacccagtctttgctgatcttaatggtggtcttcaattcattgataacttgaatagtaacattaacatgattcgtaccatcttaaatgaaacctctgaaattagacgttctattaagaacgaaaaggaattggagaagaacattactctcggtaagcttcttgaaaaggaaaagaaattggtattgaagccacgtgctaacttaaagttctccttcccaaaggtcaagccatttgaagaattaaagaagttagattacttacgtggtatgatcgatttagatcgtactgttgttgttactggttatggtgaagttggtccatacggtaactcacgtactcgttgggaaatggaagcctatggtaaattctctcttgaaggttgtattgaaatggcctggattatgggtatgatcaagtatgctaagaacaagaagacaaagaatggtaaactctattctggatgggttgatgctgaaaccggtgaaccagttcaagattacgaagttaaggcaaagtacgaacaaagaatcttagaacacactggtatccgtttcatcgaaccagaactctttgatggctatgatccaaataaaaagaacttctaccaagaagttgctatcgatcatgacttaccaggattcgaatgtagtaaggatgaagccgaacaattcaagaagaagcatggagatcgtgttgatatctttgaaaatggtgaatctggtcaatggattgttaagattaagaagggatctaccatttacattccaaaggctcttcaatttgatagaactgttgctggtcaaattccaactggttggaagccagaaacctatggtattccaaagagtattattgatcaagttgatccaattaccctttatgttattgttgctactgttgaagctttagttagctctggtattactgatccatacgaattttacgaatatgttcatgtttctgaagttggaaactgttctggtggtggtgttggtggtatggtatccaaccgtaagcaatactttgaacgtctctttgaaaagccagttcaaaatgatattcttcaagaatgcttcatcaacactatgccagcttggattaatttattattactttcttcttctggtccaattaagacaccagttggtgcttgtgctactgccgttgaatctgttgaaattggtttagaaactatcttaagtggaaaggctaagattgttattgttggtggttacgatgacttccaagaagaaggttcctatgaatttgctaacatgaaggctaccagtaactccttagaagaattagctcatggacgtgatccatctgaaatgtctcgtccagctactactactagaggtggtttcatggaatctcaaggtgccggtcatgaaattttgatgacagcttctcttgctattaagatgggtgttccaatctacggtattattgctcatacttccactgctacggataaggaaggacgttctgttccagctccaggtcaaggtatcttaactactgctcgtgaagctcatgccacctacaacccattattagactttaagtaccgtgctcgtcaattgaaattccgtcgtaagcaaattaagttatggattgaaaatgaattagaattattaagagaagaagtggatgctaaggaaaataaggatgatgaacagttcacaaagtatattaaggaaagaactgcttacattaacaaggaagctaagcgtcaagaaaaggaagctcttcgtacctatggtaatgaattctacaagaatgatccaacaatttctccattaagaggtgctcttgccgttttcggcttaactattgatgatattgaggcattatctttccatggtactggtacaaaggctaatgatactaatgaatccgaagtcattaacaagcaattcaaacatcttggtcgtagtaagggtaatgtttgtccagccatcatgcaaaagtacttaactggtcatccaaagggtgctgccgcttcttggatgcttaacggtatgcttcaagtcatcgaaactggtatcattccaggtaaccgtaatgccgataatattgaagaaaagcttcgtaaattcgaatacatctacttcccatctcgttccattcatacagatggtattaaggctggtttattaaagtctttcggtttcggtcaagttggtggtgaagttttagttatttctccagattacgttttatctagtcttacaaaggaagaatatgacgtctactgtaagaagagagaagttcgtcaacaagctatgtatagatacttacatgaatctatgactgaaaatgctgactttgttcaagttaaggatcatccaccatacgatgatacaaacgaatctagtgtctacttagatccattagctagagcttcctatgataagaaggaaggtacttggaagttcagtggtaa

SEQ ID NO: 23133 - DNA, 7233 bp, Neocallimastix californiae
  FATTY ACID SYNTHASE SUBUNIT BETA
cattccatttgatcaatggtctgttgcagaagaagttcgtgaacaatatcatatgcgtcaaaattctactcttgaaactggtgatactaatattccacaagaacaaagagaaattgaactttttattgacttcttggaattttgttctgcttatgcttatggtcaaggtcaaggtcaaggccaagaaatagttactcaatatagtgaatatgaatctgtcgttgctgctactgatgattcccaaggtttattaaaatttattacatgtgttttctctgaatattgtaatcgttattgcaaaactaataatattcatgttactactgcttcttacccaaagaaattaagacttcatgccattcaaacttattataaaattcttgatcttttagttactgctaatactaataataatactgttgaatctgctttaattgaaaaggaaaattctagatcaaagaagtcagctttattccaagctgttgctaaacataaggcatctatctttgccgtttttggtggtcaaggtagtgaagattactttaatgaaattaaggaaatttacagtacctatgaagttatcattaaatcttatttagaaagaatgtcttgcatgttagaagaattagcttcaaagccagaacttttacaattctttccaaagggtttacatgttttaaaatggttagaagaaccagaaactttaccagatactaaatatttagttaatgctccaatttctttaccattagttggtctttgtcaacttttacattactctgttttatataaaattttaggaaaaactccagatgaaatgagaagatgttttgttggtaccactggtcactcccaaggtattatttcatctgttgttgtttcatcctctggaactgaagaagaatttattgaaaattctcaaaaggctttatctttattattctggattggtgttagatctcaaatggcttatccagaaaccactattaacccaaagattcttcaagattcacttaataatgatgaaggtgaaccaactccaatgatttctttcgctaatttcccagttaataagatcgttgaacatattaaggctactaaccaacatctaccagaagatagaaagattcacatttctttatacaatggtccacgtagtattgtttgttctggtcatccacaaagtttatatggtttaaatgttactcttcgtaaattaagagctcaaccaaatattgatcaaaacagaattccatacagtcaaagaaagattcgtttcagtagtcgtttccttccaatttctgttccattccattgtgattacttaaaggatgttaatgatattattatgaaggatgttgaacgtgatcatttaattcttggtaagggtgaattagttattccaattttatctactgagactggtgaagatttaagaggtcatccacaatttacttatgaattaattaaacaaatttgtactttacctgttcattgggaaaaggctacctctgttactaatgctactcatgtattagaatttggtccttctggtgctggtgttggtttattaacccacagaaataagattggtaccggtattcaaattattcttgctaacagtttagaatctactgaaaaagaagttttaagtaaggattctttattcaatagagatccatcttctgttaagtactctatgaattgggaaaaattattcgcaccaaaattagttaaatctgctaataatggtaagatttacgttgaaactcgtttcagtcgtttacttggtaaaccaccacttatggttggtggtatgactccaactactgctaatgaaaaccttgttagtgcttgtattaatgctggttatcatattgaattggctggtggtggtcaacactctactcaaatgattcgtgatcgtattaagaagattatgtcaaaggttccttctggtgaaggtattactatgaatattatgttcttaaatgccttccaatggggtttccaatatccattagttcaagaaatgagaaaggaaggtgttccacttgatggtttatgtattgctgctggtgttccaagtcttgatgttgctaatgaaattcttggtaatttaaaggcctgtggaattaaacatgttgctttcaaaccaggtagtgtatctgctattcaacaagttattgctattgctaagcaaaatccagatatgccaattattatgcaatggactggtggtcgtgctggtggtcaccactctttcgaagatttccatcaaccaattattgatacttatgcttctattcgtcgtcaaccaaatattattattgttgttggtagtggttttggtgatgctgaaggtacccttccatacttaactggtgaatgggctcgtaagtttggttatccaccaatgccatttgatggtattttattcggtagtagaattttagttgctgctgaagctggtaccagtgaagaagttaagaagttattagttaaatctgaaggtattgaaaatgaaaaggaatgggaaaacacctacaagggtccaactggtggtgttattactgttaagtctgaattaggcgaaccaattcacaagttagctactcgtggtgtcttgttatggaaggaattagatgaaactattttcaatcttccaccagaaaagcaattaccagctttacttgctcgtaaggaatatatcgttcaccgtctcaataaggattaccaaaaggtctggttcccaaagaagtacgatgccgaagatccagaaaaggttgttgatcttaaggatatgacttattatgaagttttacgtcgtatgcttgaacttatgtatccaaatggtcaatggattgatgtttccttaagaatgatttatggtgatttcttccaccgtgttgaagaacgtttctataaggcttctgaaggaaaagaatttgtttccttccttcaatcctatgaacaattagaagaagatccagttggtttattagaaaaattcatggaagaaagagttccagaagctagggttcaattaataaacagtgatgatttaatgtacttcttgaacatctgtagtagacgtgatattaagccaccaccattcattccaaatatggataagcaattcaagtactggttcaagaaggatagtttatggcaatcagaacacttagaagctgttgttggtcaagatccaggtcgtgtttgtgttcttcaaggtccagttgctgttagacattctactaaggctaatgaaccaattagctcaattcttgataccattaatcaagaacacattaaacaattgaaggctcgttactaccaaaacagtgatactgttattccagttgttgactactttggtggtgctgaaattcgtgatgttcgtagaaagattcgcggtgtttctattaagagtgttaagaatgataacatcgttaaaactatgtttgaagttactgccgaaaataatgaagatcttccagatgaaaatgactggtatgatttattagctggacaatactatacctggttacgtgctctcttagcttcaaaggtctttgtcaaggatgatgatggttattatcaggataattgtgttagacgtattcttcgtccaaaaccacatcacattgttgaaattagatcaattaatgataatattgaatcgcttagcatgtttaataagcaaggtggaaatgaagtggttaagattaccattgatgataagaaactcattactgttttaatgaacgaatactccttaaacactaaacttgttcaacttccactcttattccaatacaaaccagaacaaggttatgctccaatccatgaagttatggaaggtagaaatgaacgtattaagcgtttctactacgatttatggtttggccttgacaatggtaagtacacttttgaagatgattacaaccatgatccaagagaaccatttgtcagtgttagtgaaccaattactagacaacaaattaccgatttcgtcaacattattggtaatcgtgctgaatcttacactgaccgtggtcaaaaggtcttatttgctccaatggatttcgctattgttgttggttggcagagtattatccgtgctatcttcccaaaattcatcaatgccgatttattaaagttggttcatttaactaacggattccgtatgattgataatgaatctggtttaaaggaaggtgatattgttaagactgaatctcgtattattagtgttattaatgatgaaactggtaagattgttgaagttaagggtgtcttaaagcgtgatgaaaagccatttatggaagttatttctaagttcttctaccgtggtgtcttttccgattacgattctaccttcaagaatgttgaagaaaaggcttatcatgttaccttaaagaataagaaggatgttcatattcttgaatctcttgattggttcaagatgaccactgatgacgaacaattggctcttactcaaggtgatcaattactctttgaattgaatagtgaatacactttcaagacaagtgatgtttacagtagggtgaagactttcggtactgttaaaaagttattatctactaaggtttatgttgatgttgccaaggttgactatttatatgataaaccagatggttcttgtggtaacccagttattgactttttagaaagaaatggtaaggttcaagatactccagtctactttgaaaatggtggttacagtattatgccaaagggtaagggaatttctagtgttgttaacactcactcctctaacattggatactcccgtgtctccggtgatgttaatccaattcatactaacccatactttgctcaattagctgatcttccaggtaacattactcacggtatgtggactagtgcctctactcgtaagtttgttgaaacctttgctgctgaaaaccatccacatcgtgttacctcttatgaagttaaattcttagatatggtcttcccaggtgatcgtttagaaaccaagcttttccatactggtatggctaatggtaagaaaattattcaatgtaagacgatcaaccaagatggtaaggtggttcttgaaggtactgctgaagttgaacaacctattactgcttatgtcttcactggtcaaggtgctcaagaagtaggtatgggtatggacttgtatgaaaagtcaccagtagctagagaaatttgggatcgtgctgatgctcacttgatggaaaattatggtttctctattattgatattgttaagaataatccaactgaaattactatctactttggtaatgttaagggtcaacaaattcgtaagaattatcaacagatgacttatgaacatgttaattctgatggtgttgttgaaagtctttcactcttcccagaaattgatgacgacagtgtttcctacaccttccgtcacattggaggtttattatcggctactcaattcacacaaccatcccttgttttaatggaaaaggctgcttttgaagaaatgagatctcgtggtttcattcaacaaaacagtgcttttgctggtcatagtttaggtgaatatgctgccttaactgctattggtgatgtcttaagtattgaaacgttggttgatgtcgttttctatcgtggtatgactatgcaaagagccgttcaacgtgattctaagggtcgttccgattatgctatgtgcgccgttaatccaactcgtgttagccgtactttcaacgaaagtgccttacaatatcttgttgctaacattaagaaggttactgaaggtttaattgaaattgtaaactacaatgttgataactggcaatatgttgtttctggtgatcttatttccttacaagttcttactcttgtcttaaactacttaaaggctgaaaagattgatttaactgttttattgaacactctttctgttgaagaagttcaaaagcaagttaatgaaattattagtacttcctttgaaaaggctaaggaacaaaagaaaaagcatggctatattaaattagaacgtggtgctgcttctattccattacgtggtattgatgttccattccactctagtttcttattaagaggtgttgctccattccgtcaatacttgatgagtaagtttgatccaaacttgattgacgttaaccgtttaatcggtaattatattccaaacttaactgctgaaccattctctcttaagaaggaattcattgaaaatatttatgctaaaactaattcttctcgtattaagaatgtcttaaagggttggactgatgataaatacgcttctccacgtcttcaacaaaaattgggttacattcttttaattgaattattagcttaccaatttgctagtgctgtcagatggattgaaactcaagatagattattcgttgatattggtgttgaacgtttaattgaaattggtccaggtccaacactttctggtatggctcaaaagaccttaaagtttaagtatgaatactatgatgatgctaccagttatcgtcgtgaaattctttcttactctaagaactataaggaaatcttttatgactttgaagatgaatctgatccagaagtttctgaagaaacttctgctcctgccgctccagttgctgccgctgcagttccagttccagctccagctccagttccagttgctgctccagttgttgctgctggtagtgttgctgatgaagatattcaagttaaacatttaattaacattcttattgctcaaaagttaaagaagaaggctaatgaagttccaatgactagtactattaaggaattagttggtggtaagtctactcttcaaaatgaagttttaggtgatttacaaaaggaattcggaagcagtaatgttccagataagtctgaagaattaccattaaatgaattagctagtcaaattggtactggttctgttgctctcggtaaatacagtcaaactttagttaataaacttattagtgctaagatggctgctggtttcactaaatctaaaattagtggttatctttctcaaaagtacggtttaggtccaaagagaactgatgccttattattattcggtttaacggatgaaccatccgctcgtttcggtagtgaagatgaagctaaggcttggttagataagattgccactggttattctgcttttgttggtgttggtctttcttctggtgctccagctgc

SEQ ID NO: 23134 - DNA, 11871 bp, Neocallimastix californiae
  FATTY ACID SYNTHASE SUBUNIT BETA
cattccatttgaccaatggtctgttgcagaagaagttcgtgaacaatatcatatgcgtcaaaattcttccatagaaactggtgatactagtataccacaagaacaaagagaacttgaactctttattgactttttagaattttcctccgcttatgcatatggccaaggtcaaggtcaagaagttgttactcaatatagtgaatatgaatctgttgttgctgctactgatgattcacaaggtttattaaaatttattacttgtgttttctcagaattttgtaatagttattgtaaaactaataatattcatgttactaccgcttcttatccaaagaagttaagacttcatgctattcaaatatactataagattcttgatcttttagttactgctaatactaataataatactattgaatctgctttaattgaaaaagaaaaatctagatccaagaagtctgctttattacaagctgttactaagcataaggcttctatctttgccgtttttggtggtcaaggtagtgaagattattttaatgaaattaaagaaatttacagtacctatgaagttatcattaagtcatatttagaaagaatgtcttgtatgttagaagaattagcttctaaaccagaacttttacaattcttcccaaaaggtttacatgttttaaaatggttagaagaaccagaaactttacctgatactaaatatttaattaatgctccaatttctttaccattagttggtctttgtcaacttttacattactctgttttatataaatctttaggcaaaactccagatgaaatgagaagatgttttgttggtactactggtcactcacaaggtattatttcatctgttgttgtttcatcttctgggactgaagaagaatttattgataattctgaaaaggctttatctttattattctggattggtgttagatctcaaatggcttatccagaaactacaattaacccaaaaattcttcaagattctcttaataatgatgaaggtgaaccaactccaatgatttcctttgccaatcttccagttaataagatagttgaacatattaaagctactaatcaacatcttccagaagatagaaaaattcatatatctttatataatggtccacgtagtattgtttgttctggtcacccacaaagtttatatggtttgaatgttactcttcgtaagttaaaggctcaagcaaatattgatcaaaacagaatcccttacagtcaaagaaagattcgtttcagtagccgtttccttccaatttctgttccattccattgtgattacttaaaggatgttaatgatattgttatgaaggatgttgaacgtgataacttaacccttggtaagggtgaattagctatcccaattttatctactgaaactggtgaagatttaagaggtcatccacagtttacttatgaattaattaagcaaatttgtactttaccagtttactgggaaaaggctacttctattactaatgctactcatatcttagaatttggtccatctggtgctggtgtcggtttattaactcacagaaacaaggttggtactggtattcaaattattcttgctaacagtttagaatcttcggaaaaggaagttttaagtaaagattctttatataatagagatccatcttctattaagtattctatgaattgggaaaaattattcgcaccaaagttggtaaaatctgctaataatggaaaaatttacgttgaaacccgtttcagtcgtttactcggaaagccaccacttatggtaggtggaatgacgccaactactgcaaatgaaaatcttgttagtgcatgtatcaatgcaggttatcatattgaattagctggtggtggtcaacactccactcaaatgattcgtgaccgtattaagaagattatgtcaaaagttccttctggtgaaggtattaccatgaatattatgttcttaaatgccttccaatggggtttccaatatccattagttcaagaaatgagaaaggaaggtattccacttgatggcttatgtattgctgctggtgttccaagtcttgatgttgctaatgaaattctcggtaatttaaaggcctgtggtataaaacatgttgccttcaagccaggtagtgtatctgctattcaacaagttattgctattgctaagcaaaacccagatatgccaattattatgcaatggactggtggtcgtgctggtggtcaccactcttttgaagatttccatcaaccaatcattgatacttatgcttctattcgtcgtcaaccaaacattattatcgttgttggtagtggtttcggtgatgctgaaggtacccttccatacttaactggtgaatgggctagtaaattcggttatccaccaatgccatttgatggtattttattcggtagtagaatcttagttgctgctgaagctggtactagtgaggaagttaagaagttattagttgaatctgaaggtattgaaaatgaaaaggaatgggaaaacacttataagggtccaactggtggtgttgttactgtaaaatctgaattaggagaaccaattcataagttagctactcgtggtgtcttattatggaaagaattggatgaaaccatctttaaccttccaccagaaaagcaattaccagctttacttgctcgtaaagaatacattgttcaccgtctcaataaggattaccaaaaggtttggttcccaaagaagtatgatgctgaagatccagaaaaggttgttgatcttaaggatatgacttattatgaagttttacgtcgtatgcttgaactcatgtatccaaatggtcaatggattgatgtttccttgagaatgatttatggtgatttcttccatcgtgttgaagaacgtttctataaggcttctgaaggaaaagaatttgtttccttccttcaatcctatgaacaattagaagaagatccagttggtttattagaaaaattcatggaagaaagagttccagaagctaaagttcaattaatcaacagtgatgatttaatgtacttcttgaacatttgcagtagacgtgatattaaaccaccaccattcattccaaacatggacaaacaattcaaatactggtttaagaaggatagtttatggcaatctgaacacttggaagctgttgttggtcaagacccaggtcgtgtctgtgttcttcaaggtccagttgctgttagacactctactaaggctaatgaaccaataagctcaattcttgataccattaatcaagaacacattaaacaattaaaggctcgttactatcaaaacaatgatactcttgttccagttgtggactactttgggggtgcagaaattcgtgatgttcgtagaaagattcgtaatgtttccattaagagcattaagaatgataacatcttctccaccatgtttgaaattactgctgaaaataatgaagatcttccagatgagaatgactggttcgatttattagctggacaatactacacatggttacatgcactcttagcctcaaaggtctttgttaaggatgatgatggttactatcaagataactgtgttagacgtattcttcgtccaaaaccacaacatatcgttgaaattagaaccgttaacgataagattgaatccctcagtatgtttaataagcaaggcggtaaggaagtcgttaagattaccattgatgatgataagaagattattacagttttaatgaatgaatattccttaaatactaaactcgttcaacttccactcctattccaatataaaccagaacaaggctatgctccaattcatgaaattatggaaggtagaaatgaacgtattaagcgtttctactatgatttatggttcggtcttgacaatggtaaatacacttttgaagaagattacaaccataatccaaaggaaccattcgtcagtgttagcgaacccattaccagacaacaaattaccgatttcgttaatattattggtaatcgtgctgaatcctacactgaccgtggtcagaaggttttatttgcaccaatggatttcgctatcgttgttggttggcaaagtattatccgtgctatcttcccaaaattcatcaatgccgatttattaaaattggttcacttatctaacggtttccgtatgattgataatgaattaggattaaaggaaggtgatgtcgttaagactgaatctcgtattattagtgttgtcaatgatgaaactggtaagattgttgaagttaagggtgtcttaaagcgtgatgaaaagccattcatggaagttatttctaagttcttctatcgtggtatctttaccgattatgattctactttcaagaatgttaaagaaaagacttatcatgttaccttaaagaataagaaggatgttcatattcttgaatctcttgattggttcaagatgactacggatgacaaacagttgtctcttactcaaggtgatcaattgctctttgaattgaatagtgaatacactttcaaaacaagtgatatttaccgtaaggtgaagactttcggtacaattaagaagttattatcaaccaaggtttatgttgatattgctaaggtggattacttatatgaggaaccagatggttcttgtggtaacccagttatcgactttttagaaagaaatggtaaaattcaagatactccagtttactttgaaaatggtggttacagtattatgccaaagggtaagggtttatcaagtgttgttaacactcactcttccaacttaggatactctcgtgtttccggtgatgttaacccaatacacactaatccatactttgctcaattagctgatcttccaggtaacattactcacggtatgtggactagtgcttccactcgtaagtttgttgaaacctttgctgctgaaaaccatcctcaccgtgtaacttcctatgaagttaaattcttagatatggtattcccaggtgatcgtttagaaactaagctcttccatactggtatggctaacggtaaaaaaattattcaatgtaagacgatcaaccaagacggtaaggttattcttgaaggtactgctgaggtggaacaaccaattactgcctatgttttcactggtcaaggtgctcaagaagttggtatgggtatggatttgtatgaaaagtctccagttgcaagagaaatttgggatcgtgcggatgctcacttaatggaaagctatggtttctccatcattgatattgtcaagaataacccaaccgagattactatttactttggtaatgttaagggtcaacaaattcgtaagaactatcaacaaatgacttatgagcatgttaatgctgatggtgttattgaaagtctttcactcttcccagaaattgatgatgacagtgattcttatactttccatcacattggaggtttattatcggcaactcaattcactcaaccatcgcttgttttgatggaaaaggcagctttcgaagaaatgagaactcgtggtttcatccaacaaaatagtgctttcgctggtcacagtttaggtgaatatgccgccttaactgctattggtgatgtcttaagtattgaaaccttagtggatgtcgtcttctatcgtggtatgaccatgcagagagctgttcaacgtgattccaagggtcgttctgattatgctatgtgtgccgtcaacccaacgcgtgttagccgtactttcaatgaaagtgctttacaataccttgttgccaacattaagaaggttactgaaggtttaattgaaattgtcaactacaatgttgataactggcaatatgttgtttctggtgatcttatttccttacaagttcttacgcttgtcttaaactacttaaaggctgaaaagattgatttaactgttttattaaatacactttcagtggaagaagttcaaaaacaagtaattgaaatgatcactaccgcctttgaaaaggctaaggatcaaaagaagagacatggattcattaaattagaacgtggtgctgcttctattccattacgtggtattgatgttccattccactctagcttcttattaagaggtgttgctccattccgtcaatacttaatgagtaaatttgatccaaacttgattgatgttaatcgtttaatcggtaattatattccaaacttaactgctgaacccttctctcttaagaaggaatttattgaaaatatttatgctaaaactaattcttctcgtattaagaatgtattaaagggatggacggatgataagtatgcttctccacgtcttcaacaaaagttaggttacattcttttaattgaattattagcttaccaatttgctagtgctgttcgttggattgaaactcaagatagattattcgttgatattggtgttgaacgtttaattgaaattggtccaggtccaacgctttctggtatggctcaaaagacattaaagtttaagtatgaatattatgatgacgctaccagctctcgtcgtgaaattctttcctattcaaggaactataaagaaatcttttatgactttgaagatgaatctgaatcagaagctgttgaaaccgtttcaaaatctgctccaactccaactccaactccaactccagttccagttgctgctccagttgctgctgctggtagtgttgctgatgaagatattcaagttaaacatttaatcaacattcttattgctcaaaaattaaagaagaaagctaatgaagttccaatgacaagtactattaaggaattagttggtggtaagtctactcttcaaaatgaagttttaggtgatttacaaaaggaatttggtagtaacaatgttccagataaatctgaagaattaccattaaatgaattatctagtcaaattggtactggttctatggctcttggtaaatacagtcaaactttagttaataaacttattagtgctaagatggctgctggtttcactaagtcaaagattagtggttatctttctcaaaagtatggattaggtccaaagagaacggatgctcttttattattcggtttaacggatgaaccagcttctcgttttggtagtgaagatgaagctaaggcttggttagataaggttgcctctggttattctgcctttgttggtgttggcctttctgctggtgctgccgctgctgccgctccaatggcaatgtctatgcctatggctgttgcttcagttgctactgcttctgctgctagcgttgctgatgaagatattcaagttaaacatttaatcaacattcttattgctcaaaaattaaagaagaaggctaatgaagttccaatgacaagtactattaaagaattagttggtggtaagtctactcttcaaaatgaagttttaggtgatttacaaaaggaatttggtagtaacaatgttccagataagtctgaagaattaccattaaatgaattatctggacaaattggttctggttctattgctcttggtaaatacagtcaaaccctagttaataaactcattagtgctaagatggctgctggtttcactaagtcaaagattagtggttatctttctcaaaagtatggattaggtccaaagagaacggatgctcttttattattcggtttaacggatgaacctgcttctcgtttcggtagtgaagatgaagctaaggcttggttagataagattgctccaatgtactttagttttgtcggtgtttctgctggtgctgccccagctgctggtgctgctgcaagtgttccaatgatggcagctcctgttaatgccggtgctattgctgaagctactagaaagtatgatcaacttattaaggaacaacttgatattttcttaaactatcttgatattgatccacgtgaaggtttcaatctctatgaagatgaattaaataatgccgctagattacgtgctgaacttgacctctggataaatgaacatggggatgagtatgctcaaggtattaaaccaatttttgatccattaaaggttagaaaatatgattcctactggaattgggtacaccaagaatcattaattctttactatgatatcttgtacggtagattagctgttgtcgacagaaaggtaactagtcaatgtattcatgttatgaatagagctgatcaacatcttcttgatcactacaactacagaatcagagcgactgattcaaagaagggaccaacttatgaattagctaaggaatttgctcaaattcttttggaaaactgttcagaaacgatcaacgaaaacccggtttacaaggatgttgatgttccaaccatgccacaaacaaccgtatctgaaagtggtgaaattaagtatgctgaagttccacgtccaggaattagaaagatggaatcctacattaaattaatgcaagcaggtagtagaattacccgaattccaacaaagcattccaatagatctattcgttttactggtggtggtaatggtagtggtaacaacaagaccagagtcaagtctaagaaggtaccattcctcttccttaaggatccaaagaccggagaatatgatgaaaagttaaccaaggtctactacaaagctctctatgccatggctaatgatggtattacctttaaaaataagtatgttttaattactggttgtggtcgtaattccattggttctcaagtgattaagggattattaaatggtggtgctaagattattgctactacttctagattcagtaaggctactatgcaatactaccgtcaactctatgaagatcatggttctaagggatcatgtttaattgttgttccattcaatgctgcttctgttgaagatgttaatcgtttaatcgaatacatttactccaaggatccaaagaatggtttaggatgggatcttgattatgttattccattcgctgctatctccgaaaacggtagaactttagaaaacattgatagtagaagtgaattagctcatagaattatgctcaccaatttattaagaatgttaggtaagattgttactgaaaaggaatcgcataagtatgatacacgtcccgctcaatgtattcttccaatgtcaccaaaccatggtacctttggtggtgatggtctctactctgaatccaagattgctcttgaaaccctcttcaaccgttggcattcagaaggatggggaggttatcttactgttgctggtgctgtcattggttggactagaggaaccggtttaatgaatagtaataaccttgttgctgaaggtattgaaatgtttggtgttcacactttcagtactcatgaaatggccttcaaccttattggtttaatgcacagtgatatttgtaagctttgccttaagaacccagtctttgctgatcttaatggtggtcttcaatttattgataacttaaatggtaacatcaacatgattcgtaccatcttaaatgaaacgtccgaaattagacgttctattaagaatgaaaaggaattagaaaagagcattacgcttggtaagctccttgctaaggaaaagaaattagtcttaaagccacgtgccaacctaaagttctccttcccaaaggtaaagccattcgaagaattaaagaagttggattacttacgtggtatgatcgatttagatcgtaccgttgttgttactggttatggtgaagtcggtccctacggtaactcacgtactcgttgggaaatggaagcctatggtaagttctctcttgaaggttgtattgaaatggcctggattatgggtatgattaagtatgctaagaacaagaagactaaggatggaaaactctattctggatgggttgatgctgaaaccggtgaaccagttcaagatttcgaagttaaggcgaagtacgaagaaagaatcttacaacatactggtattcgtttcattgaaccagaactctttaatggctacgatccaaataaaaagaacttctaccaagaagttgccattgatcatgacttaccaggatttgaatgtagtaaggaagaagcggaacaatttaagagaaagcatggcgatcgtgttgatatctttgaaaacggtgaatccggtcaatggaatgttaaatttaagaagggatcaactatctatattccaaaggctcttcaatttgatagaacagttgctggtcaaattccaacaggttggaaaccagaaacctacggtattccaaagagtattattgatcaagtggatccagttaccctttacgttattgttgctacggttgaagccttaattaactctggtattactgatccatatgaattctatgaatatgttcatgtttctgaagttggaaactgttctggtggtggtgttggtggtatgctttcttcccgtaaggaatactttgaacgtgcatttgagaagccaattcaaagtgatattcttcaagaatgtttcatcaatactatgccagcttggattaacttattgttactttcttcatctggtccaattaagactccagtcggtgcctgtgctactgctgttgaatctgttgaaattggtttagaaacgatcttaagtggaaaggctaagattgtaattgttggtggttacgatgacttccaagaagaaggttcctacgaatttgctaacatgaaggctacgagtaacgcattagatgaattagctcatggtcgtgatccatcggaaatgtctcgtccaggtacgactactagaggtggtttcatggaatcccaaggtgctggacatgaaatcttgatgaccgcctctcttgctattaagatgggtgttccaatctacggtatcattgctcacacttctactgctacggataaggaaggacgttctgttccagctccaggtcaaggtattttaactactgctcgtgaagctcatgtcacctacaacccattattagactttaagtaccgtgctcgtcaattaaagttccgtcgtaagcaaattaagttatggattgaaaatgaattcgaattattgagagaagaaatggaaggtagaaaggagggtaaggaagataacgataatgatgaacaatttaataagtatgttagggaaagaacggcttatattaataaggaagctagacgtcaagaaaaggaagctcttcgtacctatggtaatgaattctacaagaatgatccaacaatttctccattaagaggagctcttgccgtctttggtttaactatggatgatattgatgctctctctttccatggtacaggtactaaggctaatgatactaatgaatcagaagttatcaacaaacaatttaaacatcttggtcgtagtaagggtaatgtttgcccagctattatgcaaaagtacttaaccggtcatccaaagggtgctgctgcttcctggatgcttaatggtatgcttcaagttatcgaaaccggtattatccctggtaatagaaatgccgataacatagaagaaaaacttcgtaaatttgattacatctacttcccatctcgttccattcatacggatggtgttaaggctggattattgaagtccttcggtttcggtcaagttggtggtgaagttttagttatttcacccgattatgttttatctagtcttactaaggaggaatatgatgtgtactgtaagaagagagaagttcgtcaacaagctatgtacagatacttacatgaatctatgactgaaaatgctgactttgttcaagttaaggaacatccaccatacgatgatactaatgaatccaatgtctacttagatccattagctagagcttcctatgataagaaggaaggttcatggaagtttaatggaaa

SEQ ID NO: 23135 - DNA, 8676 bp, Neocallimastix californiae
  FATTY ACID SYNTHASE SUBUNIT BETA
cgttccagaagaaaactggtcctgtgctgaacaaattgcttatgatttcaactcttccttcgaaaatactttcgttgctgatgatgaagatgttgaaaagaaaaatactttaaatggtttctggatttatgttaatttcatggaattcgctactcgttaccaagctaatagtaagactttattaactcaaaaggatattactcgtttattaattaatttattcattgatttcagttctcgtttccttaagggtaatgatattcatattagaactcgtcactttgaacatgaattccgtattcaagttattcaacactactacactgtctttgattacttacaaaaggatgaagaagctgccaatgctattgctaacttcttacctgttgaaccagctttagctaaggctgtacgtgctggtgatgctcttgctcttgctgttttcggtggtcaaggttacccaggtttcaatgaaatacttcaagcctacactatctatggtgctattgttcgtgattacattgctgaactttccactgttttaaaggaattagctgctaagccagaattcgaacgtacctacaagcaaggtcttgatatcttaaagtggttacgtaatccagaatctcttccagaagatgcttaccttgattctgctccagtttctttcccattaattggtattgttcaattagttcaatacttaattcttttccgttccttccgtaaaactccagattgggctcgtcgtttattcgctggtaccactggtcactctcaaggtttagttacttctgttgttattgcctcctccggtactgaagaagaatacttagaaaactctaagaaggctgtttccttattattcttaatcggtgctcgttcccaacaaatctttgctattaccccattatctccagaaacccttcaagaaattgctgataatggtgatgaaaatgatatgccaacttgtatgctttccattaacggtttaccagaagctaccgttcgccaaactgttaatgaaattaacaaattcattgaagaaccagatcgtaaggttaccatttctcttatcaacggtcttcgtatgatcgttgttaccggtgctccagaatctcttcaaaaccttaagatgactcttaagaagattcaagctggtccaaacgaagatcaatctcgtattccattctctaagagaaagcaagtcttcaccatgaagttcctttctgttactattccagctcacaatgaaatcttaaaggatgctgccgaattagttgttgatgatgctgccaagttaaacattactttcccaactaagaacttagctattccagtttaccgtaccgataatggtgttgacatgaaggaagaagctgaagttaccgatgttgtcgagtctgttgtcaaccaaatttgtattttaccagttgattgggttaaggctactaatgttccaggtttaactcatgttttagatttcggacctggtggtgcctctggtatcggttctcttattcaaaagaacaaggaaggtactggtgttcaagttatcctttctggtactattgccagtactaacccagacttaaagtgcaagatgtacgcttacactactgaagttgaagatttaccatatggcattaactgggctaaggaattcgctccaaaacttattagaaatgccgatggtgaactcttaatggatactcgttacactcgtttaactggtcgtccacctcttcttgttggtggtatgactccaactactgctaactcccaatttgtttctgctgttattaatgccggttacaatgttgaagttggttgtggtgctctttacgctcctcacgtcttagataagtgtattaaggaaattgttgaaaagattccagatggtgaaggtattctctgtaatattgttttccttaaccaacgtctttgggccttccaattcccaggtgtcttagatatgcgtaagaaccgtggtattcgtattgaaggtattaccattgctgctggtgtcccatctcttgaatactgtaaaaagatgatcccacaacttattgatgctggaattccatacattggtttcaagccaggtaaccgtgatgctatccttaaggttattcaaatcgctcgtaccttcccacaaatgccaattgttgttgaatggactggtggacgtagtggtggtcaccactcttgtgaggatttctatgctccaattcttgaaacttacgctgccttacgtaagcaatctaacattgttgtcgttgttggttccggttttggtgatgatgttgaaactcttccattcatcactggtgactggagtattgaattaggttacccaccaatgccatttgatggtttattagttggttctcgtgtctgtgttgctaaggaagctcttaccagtgatggtattaaggaagttattgtaaacaccccaggtattgaagaccaatcccaatgggaaaagtcctatgatcgtccagttggtggtgttgtcactgtcgaatctgaatatggtgaaccaattcacaagattgccactcgtggtattatgttctggaaggaattagataagactatcttctctattcacgatccaaagaagagattagaaaagcttcttgaaaagaaggactacattattgaacgtcttaacaaggacttccaaaaggtttggttcggtcaaaagaacggtaagccatgtgatattgaagaaatgacctacgaagaagttattctccgtttaattgaattacttttcgttcaaaagcgtaaggaatggttagatgtcagtcacttaaagaccaccgctgacttcatttaccgtactgaagaacgttttgttaaggatggttctaaggaaaccttcctttccagtatggatgatcttaaagttgaagatccagttgctctcatgaaggaattcttcgatactcgtgctccaggagctcgtactgaattattagctactgaagatgttcaatactttattggtttgacccgtaacaaggacagaaaaccaccaccattcatctgtgttctcgatgatgaattccacgtttggttaaagcgtgatagtttatggcaagctgaagatttagatgccgttgtcgatcaagacccacaacgtgttgctattttacaaggtccagtcgccattcgtcactctaagattgccaaccaaccagtcaaggaaatcttagacggtatcatcaagtctcacattaagtccattgaagctcgttactacgccaatcgtgctgtaccaaatgttgaataccttggtggtactccaatcccagctaacgttactgaagttccagctaacgttaaggttgaaaaggatggtaacactatgatctacactcttccagctaaggaagaagacttaccagatgataaggaatggattgaatttatttctggtccaaagtacggttggttaagagccctcttatgtactccaactgttgcccgtaacaagtccatcactcacaaccgtttcaagcgtgtcttcaagccacgtactagccaaattgttaagatcttccacaacaatgaaggtgatattaccaagattgaaatctttggttggaaccgtagtatggaacttccagctcttgaagctgaaattgatagtcaacgtgtcattactgttggtttacgtgaatggggtgttccagatgttgctggtgctgaagttatgaagcttctcttccgttacactccaaaccaaggttccactccaatccatgaagtcatggaaggtcgtaacagacgtattgctgaattctactacaacttatggtacggtccagaggattctggtgatggttggggtgatttaacttccatctacaagtgtaagaagcgtgttaccgaagaagatgttaagttcttctctgatgttactcgttacactcatccatctaacaaggtcgttccatccatggactttatcatcgttacctcctgggtttctgtcttcaagactatctttgctaaggaattcgatgctgatattactcgtttagttcacatgaacaatggttatgaagttattgacccacgcccattaaagatcggagaactcgtcgatactcgttccatcatttctgctgttactaaccttgactctggtaagttaattgaagttaccggtcatgtcttcagagaaggtaaggaattcgttaaggttacctctagcttcttatgtcgtggtaagtttgatgactacaacatgaccttcaacatccgtgatgaaccagaatacattcttgaagttaaggatgataagattcttaatgctctcatgactcgtaagtacatttccttcactgaaccagaaaagattcaagttggtgttaagttagttttgaagttgaagactgaaaagcgtttcgctaccaagaacacttacagtagcattaccactaagggtaagattttcattaaccacagtgctgttcacggtttccaaatggaagaagttggtcaatttaactacgacagtactactgatgaaaagttagaaggtaagaaagaaactctcggtaacccagccattgaattcgttaagaagtacgctaaggctaacgatcgtaagatctactttgaaaatggtggttacaacattcttccaaagggtgtcacccttcttcaacgtgctccaaacactaacgaagattactctcttgcctctggtgatgttaatccaattcacaccaactactactttgctaacttggctgatcttgatgttccaattactcacggtatgtggactagtgccgctactcgtcgttacattgaaacctatgccgctgataatgatgctgaacgtgtcgtttcctacaaggttaactttattggtatggtttctccaaaggatgaacttcgtaccagccttactcatgttggtatgcacaatggtagaaagatcattaaggtttccgttaaggacttacgtactaacgaaaccgttatggaaggtgaagccgaagttaagcaaaagccaactgcctacgttttcactggtcaaggtgctcaagaagttggtatgggtcaagaactctacaacaaatctgctgttgccaaggctgtttgggatagagctgatgcctacttaatgaagaagtatggttactctatcttagaaattgttcgtactaatccaaagtctcttaccgtctactttggtggtgaagaaggtgaaaagattcgtgaaaattacatcaacatgacctgtgaaattattgattccaacggaaaggttcaaaccaagcgtatgttcccagaaatcgatgaaaacactctctactacgaatacaagtccccaactggtttattaaatgctactcaattcactcaaccagctattactcttactgaaaaggctgcctttgaagatatgctcgaaaatggttacatctgtgatgatgctgtctatgctggtcactctcttggtgaatatgccgctctttcttgtgtcgctaacaccttgagtattgaaagtatggctgaaattgtcttctaccgtggtcttgttatgcaatcctctgtcgaaagagatgaattaaaccgttctgactacgctatgtgtgccgttaatccagttcgtgtccatccatacttctcttacgatttattagttgaagttgttaagaagattaacagtgaacacggaggactcttggaaattgttaattacaacgttgaaaactatcaatacgttgttaccggtgatttaacttctcttgaagctcttaagaacttattaactaaccttcgtgctgaatcaaagaagttcattgccttatacaaggaagatgctactcaagctatggatctcttaaacgaaaaggtttgtatctacgttaaattagctgaagaacgtaaggctaaggaaggtttcttcaatattgaaagaggtgctgctactattccacttcgtggtattgatgttccattccactccagttacttactttggggtgttccaaccttccgtgaattacttcatcaacgtgtccgtcgcgaagatgttgatgttaaatgtcttgttggtcgttacattccaaacttaatgggtgaaccattctctgttgaaaaggattacgctattcgtcttcaaaagcgtactaactctacctacttggaaaagattattgaagaatgggatgatcatttattcgaaattccatacattattatggttgaattattagcttatcaattagcttctgctgttcaatggattaagactcaagaattcttattcagttctaagaataagggtggtgctgatgttgaacgtcttattgaattcggtccaactccaactttagttggtatggctaaacgtactcttggtatgaactttgctaaatctgatcttgctctcggtaagaaacgtcaacttttatcttacgctaagaatactactgaaatttattatgaatttgatgatgctgagtttgaagaagaagctgatgttgctccagttgaagaagctccaaaggctgctccagctccaactccagctccagccccagttccagttgctgctccagctccagttgctgccgctccagctgcttctgtagctgatgctccagttactgctactgaaattttacgtgctatcttagctcaaaagttaaagaagtcaattggtgaagttccattaaataaatctattaaggaattatctggtggtcgtagtaccattcaaaatgaagtttctggtgatttacatactgaatttggtggtaactctattccattaaaggctgaagaacttgctcttgaagaacttggtaaacaaatttcttctactttcaatggtcaattaggtaaatacactactcaaatgattaaccgtatgctttctggtaagatgccagcaggtttctctgcttctgctgttaagacttacttagctaatacctacggtcttggtaagggtcgtactgatggtgttttattagttgctattactatggaaccatcctctcgtttaggttctgaagctgatgctcaaggatggttagataatgttgttagtgcttactctgctgcttctggtgttgccattagtaagggtagtgctgctccagctgctgctattgctgctccagttatgccagttgctgctatgccagttgctgtttctgccggtccagctgctgctgttgctgatgctccaatttcaccaaacgaaattattcgtgttatgttggctcaaaagttaaagaagtccattaatgaaattccaatgtctaaatctattaaggaattatctggtggtcgtagtaccgttcaaaatgaagtttctggtgatttacatactgaatttggtggtaactctattccattaaaggctgaagaacttgctattactgaattaggtggtgccattggtgctaaccacaatggtaaattaggtaaatacacctctactatggtcaaccgtatgcttagtggtaagatgccagctggtttttctgcctctaaggctagagaataccttaagagtagctatggtttaggtgaaaagagaaccgatggtgttttactttacagtactaccattgaaccaacttctcgtttaggttctgaagctgatgctcaagcttggttagataaggctgttgatctctactctggcgctaactctcttggtctttctaagggtggagccggtggtgccgttgctgctgccgttccaggtgttgctgctatgggtatggtcaatagtgctgaagttactgccttaaagatgaaacaagattctcttattcgtactcaattagaaaactatgccaaataccttggtgttgatttacgtgaagatcaaaagaaattagttgcttctgctgaatccactgctaagcttcaatctgatcttgatctctggttcgatgaacatggtgaagattatgccaacggtattaagccaatgttcactagtaagaaggctcgtacctacgattctagttggaattggggttaccaagacttctggttcatggtttatgatattcttgctggtgaaaagaaggatgctgatgctcttattgcttcagatgtcttcagaaccatggtgaatcgtgctaatgcttccttagaacaacaaattgaatttgttcaccgtaaggtcgttgctgatcaaaaggatgctgaaattaaggctactcttgaaaaggttactggtgctctcttagaagctatcaaggcctcctctggtaagccagtctttaagttcaacggtccattccaagctccacatgctctcgttgatgaagaaggtcaaatgatctacaaggaaattccacgtaagggtattaacagtgccgttgattacgttaaggaaatggaagaaggtgctatgcaaaccattggttctactaccaagaaggttccattcctttttgttcgtgaccaagctgctaatggtgttgacaatgttgatgaagccatgtctaaggtttacttaaacgaacttaagaagattgctgaagatggtatctccttcgctggtaagcacgttcttatcactggttgtggtagaaactcaattggtgaatgtgttcttaagtacctcttagctggtggtgctaaggttgttgctactacctctagctaccgtcgtgc

SEQ ID NO: 23136 - DNA, 11889 bp, Anaeromyces robustus
  FATTY ACID SYNTHASE SUBUNIT BETA
tgttccagaagaaaattggtctgctgctgaacaaattgcttatgattttaattcttcttttgataaacaattcgctgctgatgatgaagatgttgaaaaaagaaataccttaaatggtttttggatttatgttcatttcatggaatttgctactcgttatcaagctgataataaaactttattaactcaaaaggatattactcaattattaattcatttattcattgatttcagtactcgtttccttcgtggtaatgatattcatattagaactcgccatttcaaccatgaagatcgtattcaagttattcaacacttctatactgttttcgattatttacaaaaggacagtgaagccgctgaagctgttgctgattatttaccagttgaaccagctttagctaaggctgttcgtgctggtgatgctcttgctcttgccgttttcggtggtcaaggttatccaggttttaatgaaattcttcaagcttacactatttacggtgctattgttcgtgattacattgatgaactttccaccgttttaaaggatttagcttctaaaccagaatttgaacgtacctataaacaaggtcttgatatcttaaaatggttacgtcatccagattcccttccagaagatgcctaccttgattctgctccagtttccttcccattaattggtattgttcaacttgttcaatacttgattcttttccgtaccttccgtaaaactccagattgggctcgtcatttattcgctggtaccactggtcactctcaaggtttagttacctctgttgttattgcctcttctggtactgaagaagaatatttagaaaattctaagaaggctgtttcccttcttttcttaattggtgctcgttctcaacaaaaatttgccattactccactttccccagaaaccttacaagaaattgctgataatgaagatgaaaatgatatgccaacttgtatgctttctattaacggtttaccagaagctgttattcgtcaaaaggttaatgaattaaacagttttattgaagaagattcacgtaaggttaccatttctcttattaatggtcttcgtatgattgttgttactggtgctccagaatctcttcaaaatcttaagatgaccttaaagaagattcaagctggaccaaatgaagatcaatctcgtattccattctctaagagaaagttaattttcactatgaaattcctttctgtttctattccagctcacaatgaaattttaaaggaagctgctgatttaattattgaagatgccgctaaattaaatattactttcccaactcaagatttagctattccagtttaccgtaccgataatggtgttgatatgaaggaagaagttgatgttccagatgttgttgaatctgttgtcaaacaaatttgtattcttccagtggattgggttaaggctactaatgttccaggtttaactcatgttttagatttcggtccaggtggtgcctctggtattggttctttaattcaaaagaataaggaaggtactggtgttcaagttattctctctggtactattgctagtactaatccagacttgaaatgtaaaatgtatgcttacactactgaattagaagatttaccttatgctattaattgggctaaggaatttgctccaaaattaattcgtaatgccgatggtgaacttttaatggatactcgttacactcgtcttactggtcgtccacctcttttagttggtggtatgactccaactacagctaatcctcaatttgtttccgctgttattaatgctggttataatgttgaaattggttgtggtgctctttacgctccacatgttcttgaccaatgtattcaagatgttattaaaagaattccagatggtgaaggtattctttgtaatattgttttccttaaccaacgtctttgggccttccaattcccaggtgtcttagatatgcgtaagaaccgtggtattcgtattgaaggtattactattgctgctggtgttccatctcttgattattgtaagaaaatgattccacaaatgattgatgctggtattccatacattggtttcaaaccaggtaatcgtgatgctattatgaaggttattcaaattgctcgtaccttcccagaaatgccaatggttgttgaatggactggtggacgtagtggtggtcatcactcttgtgaagacttttacgctccaattcttgaaacctatgctgctttacgtaaacaaaagaatattgttgttgttgttggttccggttttggggatgatgttgaaactcttccattcattactggtgattggagtattgaacttggttacccaccaatgccatttgatggtcttttagttggtagtcgtgtttgtgttgctaaggaagccttaactagtgatggtattaaggaagttattgttaacactccaggtattgaagatcaatcccaatgggaaaaatcctatgatcaacctgttggtggtgttgttactgttgaatcagaatatggtgaaccaattcacaagattgctactcgtggtattatgttttggaaggaattagataaaaccatcttttccatttctgatccaaagaagcgtttagctaaacttttagaaaagaaggattacgttattgaacgtcttaacaaagatttccaaaaggtatggtttggtcaaaagaatggtaaaccatgtgatattgaagaaatgacctatgctgaagttattttacgtttaattgaattacttttcgttcaaaagcgtaaggaatggttagatgttagtcatttaaagaccacggctgatttcatttaccgtactgaagaacgttttgttaaggatccaaatcaacccaccttccttgaatctattgattctcttaaggttgaagatccagtcgctttaatggaagaattctttaacactcgtgctccaggagctcgtactgaattattaaccactgaagatgttcaatatttaattggtttgactcgtaacaaggatagaaaaccaccaccattcatttgtgttcttgatgaagaattccacgtttggttaaagcgtgatagtttatggcaagctgaagatttagatgctgttgttgatcaagatccacaacgtgttgctattttacaaggtccagtagctattcgtcattctaagattgctaatcaaccagttaaagatattttagatggtattgttaaatctcatattaaatctattgaaagtcgttattacgctaatcgtgctgttccagaagtcgattaccttggtggtactccaattccagctaatgttagagaagttccagctcatgttaaggttgaaaaggatgaaaaggctggttgtatgatttacactttaccagatcaagaagatcaattaccagaggataaggcttggattgaatttatggctggtccaaaatatggttggttaagagctcttctttgtacaccaaccattgctcgtaataaatctattactcataatcgtttcaaacgtgtctttaaaccacgtactggtcaaattgtaaagatttattatgctaaggatgctgaggctaaagaggatactaaagctaaagctaatgaagatgttaaagttgaagttgaagacgataaggacaaggttattaccaagattgaaatctttggatggaaccgtagtatggaacttccagctttagaagctgaaatggatgatcaacgtgttattactgttggtttacgtgaatggggtgttccaggtgttgctggcgctgaagttatgaaacttttattccgttacactccagaacaaggttctactccaattcatgaagttatggaaggtcgtaacaaacgtattgctgaattctattacaatttatggtatggtcgtgaagattctggtgatggttggggtgatttaaccactatttacaagtgtaagaaacgtgttactgaagaagatgttaaattcttctctgatgttactcgttacactcatccttctaataagattgttccatccatggactttattattgttacttcctgggtttctgttttcaaaactatttttgctaaggaatttgatgctgatattactcgtttagttcatatgaataatggttatgaagttattgatccacgtccattacaaattggagaaattgtagatactcgttctattatttctgctgttactaatttagattctggtaaattaattgaagttactggtcatgtctttagagaaggtaaggaattcattaaggtcactagtagtttcttatgtcgtggtaaattcgatgattacccaatgacctttaatattcgtgaagaacctgaatatattcttgaagttaaggatgaaaagattttgaatgctttaatgactcgtcaatacatttcctttaccgaaccagaaaagattcaaattggtgttaaattagtctttagattgaagaccgaaaaacgttttgctaccaagactacctatagtagtattactactaagggtaagatttatattaataatagtgctgttcatggtttccaaatggaagaagttggtcaatttaactatgatagtgctaatgatgaaaaattaaatggtatggaaactactcttggtaatccatccattgaattcattaaaaagtatgccaaggctaatgatcataagatctacttcgaaaatggtggttataacattcttccaaagggtgtccaccttcttcaacgtgctccaaataccaatgaagattattctcttgcctctggtgatgttaatccaattcacaccaactattactttgctaatttagctgatcttgatgttccaattactcatggtatgtggactagtgctgctacccgtcgttatgttgaaacctatgctgccgataatgatgctgaacgtgtcgtttcctacagagttaactttattggtatggtatcaccaaaggatgaacttcgtactagtcttactcatgttggtatgcataatggtcgtaagattattaaggtttccgttaaggatttacgtaccaatgaaaccgttatggaaggtgaagctgaagttaaacaaaagccaactgcttatgtctttactggtcaaggtgctcaagaagttggtatgggacaagaattatataataaatcggctgtcgctaaatccgtttgggatagagctgatgcctatttaatgaaaaagtatggttattccattttagaaattgttcgtactaatccaaaatctttaaccgtttactttggtggcgaagaaggcgaaaagattagagaaaactatatgaatatgacttgtgaaattattgattctaatggtaaggtacaaactaaacgtatgttcccagaaattgatgaaaatactctttactatgaatacaaatcacccaatggtttattaaatgctactcaatttactcaacctgctattacccttactgaaaaggctgcctttgaagatatgcttgaaaatggttacatttgtgatgatgccgtttatgctggtcactctcttggtgaatatgctgctcttagttgtgttgctaatactttaagtattgaaagtatggctgaaattgtattctaccgtggtcttgttatgcaatcctctgtagaaagagatgctcttaaccgttctgattatgctatgtgtgctgttaatccagtacgtgttcatccttacttctcttatgatttattagtagaagtcgttaagaagattaatagtgaacatgatggtggtcttcttgaaattgttaattataatgtagaaaattaccaatatgtcgttactggtgatattacttccttggaagctcttaagaatttattaactaaccttcgtgctgaagctaagaaattcattactttatataaggaagatgctagtcaagctatggatctcttaaatgaaaaggtcgttcattatgttaaggaagctgaagaacgtaaagctaaggaaggatggttcaatttagaaagaggagctgctactattccacttcgtggtattgatgttccattccattctagttatttattatggggagtcccaaccttccgtgaattacttcatcaaagagttcgtcgtgaagatgttgatgttaaatgtcttgtaggacgttatattccaaacttgatgggtgaacctttctctgttgaaaaggattatgctattcgtcttcaaaaacgtactaattctacctatttagaaaagattattgaagaatgggatcaacatcttttcgaaattccatatattattatgattgaattattagcttatcaattagcttctgctgttcaatggattaaaactcaagaattcctctttagtagtgaaaagaagggtggcgttgatattgaacgtcttattgaatttggtccaactccaactttagtgggtatggctaaacgtactcttgctaagaattatagtcaatctgatcttgctcttggtaagaaacgtcaacttctttcctatgctaagaatactactgaaatttattatgaatttgatgatatggaagaagaagaagatgatggtgaagctactatggtcgaagaagttaatgctaaagaagctccagttattgctccagctgttccagtagctgctccagttgctccagctccagttgctgctgctccagctgctccagctgcttccgttagtgatgctccagttaccgctaccgaaattttacgtgctattttagctcaaaaattaaagaaatctattaatgaaattccattaaataaatctattaaggaattaagtggtggacgtagtactattcaaaatgaagtttcaggtgatttacatactgaatttggaggtaatagtattccattaaaggctgaagaattagctttagaagaattaggtaaacaaatttcttctacctttaatggtaatttaggtaaatataccactcaaatgattaatcgtatgcttagtggtaaaatgccagctggtttctctgcttctgctgttaagagttatttagctaatagttatggtttaggtaaaggacgtactgatggtgtcttattagttgctattactatggaaccatcttctcgtttaggttctgaagctgatgctcaaggttggttagatagtgttgttaatgcctattcttctgcttctggtgtttcccttcaaaagggtggtgctgctccagctgccgctgctgctccagtagctgctatgccagttgctatgccagttgctgctgctgctgctccagctgcttctgtcccagatgctccaatttcacctaatgaaattattagagttatgttagctcaaaaattaaagaaatctattaatgatgttccattaagtaaatctattaaggaattaagtggtggacgtagtaccgttcaaaatgaagtttcaggtgatttacatactgaatttggaggtaatagtattccattaaaggctgaagaattagctattaatgaattaggtaatgctattggtgctaatcatagtggtaaattaggtaaatatacttctactatggttaatcgtatgcttagtggtaaaatgccagctggtttctctgcttctaaggctaaagattatcttaaatctagctatggtttaggtgatcgtagaaccgatgctgttttactttatagtactacggttgaaccttcttcacgtttaggttctgaagctgaagctcaagcttggttagataaggctgttgatctttattctggtgctaatggtcttggtcttgctaaaggtggtgctggtggtgctggtggtgctgctgttgccgtaccaggtgttgctgctatgggtatggttaattctgctgaagttactgccttaaagatgaaacaagattctcttattcgtgatcaattagaaaattatgctaaatatcttggtattgatttacgtgaagatcaaaagaaattagttgctactgctgaatctcaagctaaacttcaatctgatcttgatctttggtttgaagaacatggtgaagattatgctaatggtattaaacctatgttttctagtaaaaaggctcgtacttttgattctagttggaattggggttatcaagacttttggtttatggtttatgatattcttaccgctaacggtgataaggataagaaggatgctgaaacctatattcaatccgataaattccatactatgatttatcgtgctaatgattctttacgtcaacaagttgactttgttcatcgtaaagttgttgctgatcaaaaggatccagaaattaaggctattttagaaaaggtaactggtactttattagaaaagattgatcaagctaaatctaaagatggtaaacctatctttaaatttaatggaccatttgttgctccacatgctattattgatgaagatggtcaaatgatttacaaggaagttccacgtaaaggtattcaaaccgctagtgattatgttaaggaaatggaagaaggtgctttacaaaccgttggaccaatttctaagaaaatgccatatcttttcattcgtgatcaaatggctaccaatggtcaaggtttagattctatggatgaagctatgtctaagatttatttgaatgaattaaagaagattgctgaagaaggtatttcctttgctggtaaacatgttcttattactggttgtggtagaaattctattggtgaaaatgttttgaaatatcttattgctggtggtgctaaggttgttgctactacttcaagttatcgtcgtcaaactttagaacactttagaagtgtttatgaacaagtaggtactaagggctctactttagtcgttgtaccatttaatcaaggatctaagaaggatgttaatgatcttatagaatttatttattccaaggatagtcgtgttaatggtcttggatgggatcttgatttagttattccgtttgctgccatttctgaaaatggacgtgatattagtgatttagatggtaagagtgaattagctcatcgtattatgatgactaatgttattcgtattcttggtgctattcgtaatcaaaagatgaaggttcgttcccttgtttcctgtcaagttgttcttccactttcaccaaatcatggtacttttggaggagatggtttatacggagagtccaagattggattagaaaacttattaaaccgttggagatctgaaacttggtcaaactatttatctattactggtgcttgtattggttggaccagaggtactggtttaatgaatagtaataatcttatttctgaaggtattgaaagtgaaggacattgtcgtacatttactactactgaaatggctttcaatttaattggtcttgtttctgatgttatggtttctctttcacgtaagaatccaatttatgctgatttgaatggtggtatgcaatatatggctgatttgaatgttgctcttcgtcgtattcgtgaaaagatgatggatgaatccgaaaagaaaaagatggtgattgatgaagatcatgctcatatggatgttattggtgttggtaagatggaagaacaaaataagaagagaatggtagaaccacgttctaatattcgtattgaattcccagaattaaaggatcgttcccaattaaaggatatggaatatttacgtgatcttttagatcttgatcgtgttgttgtcgttaccggttatggtgaagttggtccatttggtaattgtcgtacacgttgggaaatggaagctgaaggtaaattctctttagaaggatgtgttgaattagcttggattatgggattcattcaacatgttacctataaacaaatgccagatggtaccttatactctggttgggtcgatgctaaatctggtgccccaattaaggatattgatattaaggctacctatgaaaaggatattcttgctcatactggtattcgtcttattgaaccagaacttttcaatggttataatccagaaaagaaaaagttccttcaagaagttatggttgataccgatcttccaccatttgaagctagtaaagaagaagctgaaaccttcaaacgtcaacatgaagatcatgtagaagtttatgaagttggtgatggacgttatatggtacgtattcttaagggagctagtatttatgttgctaaagctttacaatttgatcgtttagtttctggtcaattaccaaccggttgggatccagctcgttatggtattccaaaggatattatagaacaagtagatccaattacatgttattgtattgtttctgctgtagaagctttagttagtgcaggtattactgatccttatgaattttatgaatatgttcatgtttctgaagtcggaaatgcttgtggttcaggtgttggtgctgaaattgctaatcgtgctattttcaaggatcgtttcttggataaaccacttcaaagtgatattcttcaagaaacctttgttaatactatgagtgcttggattaatttattattactttcctcttctggtccaattcgtactccagttggtgcttgtgcctctgctgttgaatctgttgatattggtattgataccattttatctggtaaggctaaggttgtctttgttggtggttatgatgatttccaagaagaaggttcctatgaatttgctcaaatgaaggctacttctaattcacgtgaagaaatggctcaaggtcgtgaaccagatgaaatgtctagaccaaccgcttcctctcgtggtggttttatggaatctcaaggtgttggtactcaagttttaatgccagctagtttagccttaaagatgggtgtaccaatttatggtattattgctcatagtgctactgctacggataaggaaggacgttctgttccagctccaggtcaaggtattttaaccacagctcgtgaagttaataaaactaaaggtagatcaccactcttaaatccaaagtatcgtgctcgtcaattaaatgctcgtaagagatggattaaatcttgggtagaagatgaattaggtttaatgaatgaagaagtagaagatatgagaaaggaaggtgaagctaaggaagttattgatgcctttattgaagaacgtactcaatttattgatgctgaagctcgtaaacaagaaaaggaagccttccaagtttggggacaagacttttataagaatgatccaaccatttcaccattacgtggtgctttagccgcctttggtcttactgttgatgatattggtgttgcttccttccatggtacaggtacaaaggctaatgataagaatgaatcagatgtctttaataaacaatttgaacatttaggacgtactaaaggtaatgcttgtccagttgtatgtcaaaagtatcttactggtcatggtaagggtgctgctgctgcttggatgttgaatggtgttattcaaattattcaaactggtattattccaggtaatcgtaatgctgataatattgatccacttttagaaaagtttgatcatctttggttcaataataaaactttcaaaactccaggtgttaaagctggtttattaaaatcctttggttttggtcaagtaggtggtgaaattttagttattcatccagattgtcttttcgctactcttgatgatgccacttataagacttataaggccaagagagatattcgtgaacataaagccttccgttatcttcatgatactttatctggtcaagactttgttcaagttaagaatgaaccaccatacactccagaacaagaaagtgaagtttatttgaatccattagctcgtgcttcctataataagaagactaagaaatgggattatgaacaaca

SEQ ID NO: 23137 - DNA, 11301 bp, Anaeromyces robustus
  FATTY ACID SYNTHASE SUBUNIT BETA
cattccatttgaccaatggtctgttgctgaagaagttcgtgaacaatatcatatgcgtcaaactccttctccagaaactgctgatgttaatattccacaagaacaaagagaaatgcaactttttattgatttcttagaattttcatcagcttatgcttatggtcaaggtcaaggtcaaggtgaaattattactcaatacagtgaatatgaatcagttgctgctggtactgaagattcacaaggtttacttaaatttattacttgtgtattttctgaatattgtaatcgttattgtaaaaccaataatattcatgttacaactgcttcttatccaaagaagttaagacttcatgctattcaaacctattacaaaattcttgatcttttagtaacttctaatactaataataatactattgaagctgcttttatagaaaaagaaagtaaaagatgtaagaaatctgctttattccaagctgttgataagcataaggcttccatttttgccgtttttggtggtcaaggtagtgaagattactttgatgaaattaaagaaatttacaatacatatgaagttcttattaaatcttatttagaaagaatggcttgcgttttagaagaattagcttctaaaccagaacttttacaatttttcccaaaaggtttacatgttttaaagtggttagaagaaccagaaactttaccagatactaaatatatgattaatgctccaatttctttacctttagttggtctttgtcaacttttacattactgtgttttatataaatcattaggaaaaactccagatgaaatgagaagcagttttgttggtactactggtcattcacaaggtattatttcttctgtagttgtttcctcttctggaactgaagaagaatttattgaaaattctattaaagccttatctttattattctggattggtgttagatctcaaatggcttatccagaaactactattaatccaaagattcttcaagattctttaaataatgatgaaggtgaaccaactccaatgatttcttttgctaaccttccagttaataaaattgttgaacatattaaagctactaatcaacatcttccagaagatagaaaaattcatatttctttatataatggaccacgtagtattgtttgttctggtcacccacaaagtttatatggtttaaatgttactcttcgtaagttaaaggctcaagccaatattgatcaaaatagaattccatacagtcaaagaaagattcgttttaatagtcgtttccttccaatttctgttccattccattgtgattatttaaaggatgttaatgatactattatgaaggatgttgaacgtgatcatttaattcttggtaaaggtgaattggctattccaatttattctactgaaactggtgaagatttaagaggtcatccacaatttacttatgaattaattaaacaaatttgtactttaccagttcactgggaaaaagctacttctattactaatgctacccatattttagaatttggtccatctggtgctggtgttggtttattaactcacagaaataagattggtactggtgttcaaattattcttgctaatagtttagaaaccactgaaaaagaagttttaagtaaggattcccttttcaatagagatccatcttctgttacttattctatgaattgggagaaattattcgctccaaaattagttaaatctgctaataatggtaagatttatgttgaaactcgtttcagtcgtttacttggtaaacctccacttatggttggtggtatgactccaactactgctaatgaaaatcttgttagtgcttgtattaatgctggatatcatattgaattagctggtggtggtcaacactctactcaaatgattcgtaaccgtattaagaagattatgtctaatgttccatgtggtgaaggtattactatgaatattatgttcttaaatgctttccaatggggtttccaatatccattagttcaagaaatgagaaaggaaggtatcccacttgaaggtttatgtattgctgctggtgttccaagtcttgacgttgctaatgaaattctttccaacttaaaggcttgtggtattaaacatgttgctttcaaaccaggtagtgttagtgctattaaacaagttattgctattgccagacaaaatccagatatgccaattattatgcaatggactggtggtcgtgctggtggtcaccactcctttgaagatttccatcaaccaattattgatacttacgctattattcgtcgccaaccaaatattattattgttgttggtagtggtttcggtaatgctgaaggtactcttccatatttaactggtgaatgggctcgtaagtttggttatccaccaatgccatttgatggtattttattcggtagtagaattttagttgctgctgaagctggaactagtgaagaagttaaaaaattattagttgaatctgaaggtattgaaaatgaaaaggaatgggaaaacacctataagggtccaactggtggtgttgttactgttaaatctgaattaggtgaaccaattcacaaattagccactcgtggtgtcttattatggaaagaattagatgaaaccatctttagtcttccaccagaaaaacaattaccagctttacttgctcgtaaagaatatattgttaatcgtcttaataaggattatcaaaaggtttggttcccaaagaaatatgatgctgctgaagaggatagtagtaaggttgttgatcttaaagatatgacttactatgaagttttacgtcgtatgcttgaattaatgtatccaaatggtcaatggattgatgtttctttaagaatgatttatggtgatttcttccacagaactgaagaacgtttctacaaggcttctgaaggtaaagaatttatttccttccttcaatcctatgaacaattagaagaagatccagttggtttattagaaaagtttatggatgaaagagttccagaagctagagttcaattattgaacagtgatgatttaatgtacttcttgaacatttgtagcagacgtgatattaagccaccaccattcattccaaatatggacaagtctttcaaatattggtttaagaaggatagtttatggcaatctgaacatttagaagctgttgttggtcaagatccaggtcgtgtttgtgttcttcaaggtccagttgctgttagacattctactaaagctaacgaaccaattagctcaattcttgaaaccattaatcaagaacatattaaggaattaaagagtcgttactatcaaaatagtgacactgttattccagttgttgactactttggtggtgctgaaattcgtgatgttcgtagaaagattcgtggtgtttcaattaaaggtattaagaatgataacattttctctaccatgtttgaaattactgctgaaaataatgaagatcttccagatgaaaaggattggttagatttattagctggtcaacattacacatggttacatgctcttttagcctcaaaggtttatgttaaggatgatgatggttattaccaagataactgtgttagacgtattcttcgtccaaaaccacaacaattagttgaaattagaaccattaatgataaaattgaatcacttactcttttcactaaacaaggtggtaatgaaattgttaagatttctattgatgataagaaggttattaccgtcttaatgagtgaatattcattaaatgacaaggttgttaaacttccacttctcttccaatacaaaccagaacaaggttatgctccaattcatgaaattatggaaggtagaaatgaacgtattaagcgtttctattatgatttatggttcggtcttgataatggtaaatattcctttgaagaagactttaaccatgatccaagagaaccattcattagtgttagtgaaccaattactcgtcaacaaattaccgattttgttaatattattggtaatcaagctgaatcttacactgatcgtggtcaaaaggtcttatttgctccaatggatttcgctattgttgtaggttggcaaagtattattcgtgccatcttccctaaatttattgatgctgatttattaaaattagttcatttatctaacggtttccgtatgattgaaaatgaaactggtttaaaggaaggtgatgttgttaagactgaatctcgtattattagtgttgttaatgatgaaactggtaagattgtagaagttaagggtgtcttaaaacgtgatgaaaaaccattcatggaagttatttctactttcttctatcgtggtattttcactgattatgatgctacttttaagaatgttgaagaaaagagctatcatgttaccttaaagtctaagaaggatgttcgtattcttgaatctcttgattggtttaagatggctactgatgatgaagaattagctcttgttgaaggtgatcaattacttttcgaattaaacagtgaatatgcctacaaaacacatgatgtttacagtaaggttaaaactttcggtactgttaagaaattattatctactaaggtttatgttgatattgctaaggttgattatcattatgaaaaaccagatggttcatgtggtaatccagtcattgactttttagaaagaaatggtaaggttcaagatactccagtctattttgaaaatggtggttacagtattatgccaaagggtaagggactttctagtgtagttaatactcactcctctaaccttggttattcacgtgtttctggtgatgtcaatccaattcatactaatccatactttgctcaattagctgatcttccaggtaacattactcatggtatgtggactagtgcttctactcgtaagtttgttgaaactttcgctgctgaaaatcatccacatcgtgttacttcttatgaagttaaattccttgatatggttttaccaggtgatcgtttagaaactaaacttttccatactggtatggctaatggtaagaagattattcaatgtaagaccattaatcaaaacggtcaagtcattttagaaggaactgctgaagttgaacaaccaattactgcttatgtctttactggtcaaggtgctcaagaagttggtatgggtatggacttgtatgaaaaatctgctgttgctagagaaatttgggatcgtgctgatgctcacttaatggaaacttatggtttctctattattgatattgttaaaaataatccaactgaaattactatttactttggtaatgttaagggtcaacaaattcgtaagaattatcaacaaatgacttatgaacatgttaatgctgatggtgttattgaaagtctttctcttttcccagaaattgatgatgatagtacttcctacactttccatcatattggaggtttattatctgctactcaatttacacaaccttccttagtattaatggaaaaggctgcttttgaagaaatgagatctcgtggtttcattcaacaaaatagtgctttcgctggtcacagtttaggtgaatatgctgccttaactgctattggtgatgttttaagtattgaaactttagttgatgtcgttttctatcgtggtatgactatgcaaagagctgtccaacgtgattctaagggacgttccgattatgctatgtgtgctgttaacccaactcgtgttagtagtactttcaatgaaaatgctttacaatatcttgttgctaatattcaaaaggttactgaaggattaattgaaattgtaaattacaatgttgataactggcaatacgttgtttctggtgatcttatttctcttcaagttcttactaatgttttgaactacttaaaggctgaaaagattgatttaactgttttattaaatactctttccgtagaagaagtacaaaaacaagttattgaaattgttactaatgcttttgaaaaggctaaagaacaaaagagaaagcgtggatttattaacttagaacgtggtgctgcttctattccacttcgtggtatcgatgtaccattccactctagtttcttattaagaggtgttgctccattccgtcaatatttaatgagtaaatttgatccaaatcttattgatgttaatcgtttaattggtaattacattccaaacttaaccgctgaaccattctcattagaaaagaagtttattgaaaatatttatgctaaaactaattctagtcgtattaagaatgtattaaagggttggactgatgataaatatgcttcaccacgtcttcaacaaaaacttggttatattcttttaattgaattattagcttatcaatttgctagtgctgttcgttggattgaaactcaagatcgtttattcgttgatattggtgttgaacgtttaattgaaattggtccaggtccaacactttctggtatggctcaaaagactttaaaattcaagtatgaatattatgatgatgctactagttatcgtcgtgaaattctttcctattctagaaattacaaggaaattttctatgatttagaagatgaagatgattctgataaattagaatccactccaacttcaactccaaaatctgctccagctccaactccagctccagttgctgctccagttccagttgctgctccagtcccagctccaatgccagctgttgctgctgctagtgtaagtgatgaagatattcaagttaaagatttacttcatattcttattgctcaaaaattaaagaagaaggtacaagaagttccattaactgctactattaaggatttagttggtggtaaatctactcttcaaaatgaagttttaggtgatttacaaaaggaatttggtagcaataatgttccagataaatctgaagaaattccattaggtgaattagctggacaaattggttctggtgctgttccaatgggtaaatatagtcaaactttagttaataaacttgttagttccaagatggctgctggtttcactaaatctaagattcaagatcatctttcacaaaagtatggtcttggaccaaaacgtactgaagccttattattattcggtttaactgatgaaccatctgctcgtttcggtagtgaagatgaagctaaggcttggttagataaggttgctccaatgtacttcaattatgttggtgtttctgctggtgctgccccagctggtggtgctgccccagttggtattccaatggctgctgttaatgctggtgctttagctgaagcttctaagaaatacgatcaacttattcgtgaacaattagatatcttcttaaattatcttgatattgatccacgtgaaggtttcaaccgttatgaagaagaattaaataatgctgctaaacttcgtgctgaacttgatctttggattaatgaacatggtgatgaatatgctcaaggtattaaaccaatctttgatccattaaaggttagaaaatatgattcttactggaattgggtccatcaagaatccttaattctttattatgatattttattcggtagattagctgtcgttgatagaaaggttactagtcaatgtattcatgttatgaatcgtgcagatcaacatcttcttgacctttattcttaccatattaacactactgatccaaagaagggtccaacttatgaattagctaaagaatttgctcaaattcttatggaaaattgttctgaagctattaaggaaaatccagtttataaggatgttgatattccaactatgccacaaactattgttactgaacaaggtgaaattaaatacagtgaagttccacgtccaggtattaataagatggaatcctatattaaattaatgtctgctggtagtcgtattactcgtattccaaccaaacattctaaccgtagcattcgtttcactggtggtaataataagactagagttaagtctaagaaggtaccattccttttccttaaggatccaaagactggtgaatatgatgaaaaggctacaaaggtttattataaggctctttatgatatggccaatgatggtattacctttaaaaataagtatgttttaattactggttgtggtcgtaactctattggttctcaagttattaagggattattaaatggtggtgctaagattattgctactacatctagatttagtaaggctactatgcaatactaccgtcaactttatgaagatcatggttctaaaggttcatgtttaattgttgttccatttaatgctgcttcagttgaagatgttaatcatctcattgaatatatttattctaaggatccaaagaatggtttaggttgggatcttgattatgttattccatttgctgctatttctgaaaatggtagaactttagaaaacattgatagtagaagtgaattagctcatagaattatgcttactaacttattaagaatgttaggtaagattgtttctgaaaaagaagctcataagtatgatactcgtccagctcaatgtattttaccaatgtctccaaatcatggtacattcggtggtgatggtctttactctgaatcaaagattgctcttgaaacacttttcaaccgttggcattcagaaggatggggaggttatcttaccattgctggtgccgttattggttggacaagaggtactggtttaatgaatagtaataatttagttgctgaaggtattgaaatgtttggtgttcacaccttcagtactcatgaaatggctttcaatttaattggtttaatgcatagtgaaatttgtaagatgtgtcttaagaacccagtctttgctgatcttaatggtggtcttcaatttattgataacttaaaccataatattactatgatacgtactatcttaaatgaaacttctgaaataagacgttctattaaggctgaaaaagatttagaaaagagtattactcttggaaaacttcttgctaaggaaaagaaattaatgttaaaaccacgtgctaacttaaagtttgctttcccaaagatgaagccttacgaagaattaaagaaattagattacttacgtggtatgattgatttagaccgtactattgttgttactggttatggtgaagtaggtccatatggtaattcacgtactcgttgggaaatggaagcctatggtaaattctctcttgaaggttgtattgaaatggcatggattatgggtatgattaaatatgccaagaataagaagactaaagataataagatgtattctggttgggttgatactcaaaccggtgaaccagttcaagattatgaagttaaggctaaatatgaaaagagaatccttgaacatacaggtattcgtttcatagaaccagatcttttcggtggttacgatccaaataataagaacttctatcaagaagttgctattgatcatgacttaccaggatttgaatgtagtaaggaagaagctgaacaatttaagaagaagcatggtgatcatattgatatctttgaaaatactgaatctggtcaatggattgttaaggttaaaaagggatctactatctttattccaaaggctcttcaatttgatcgtactgttgctgctcaaattccaacaggttggaaaccagaaacttatggtgttccaaagaatattattgatcaagttgatccaattaccctttatgttattgttgctactgtagaagcacttgttagttctggtattactgatccatatgaattctatgaatatgttcatgtttctgaagttggtaattgttctggtggtggtgttggtggtatggtttccactcataaagaatactttgatcgtgcttttgaaaaaccagttcaaagtgatattcttcaagaaagctttattaatactatgccagcttggattaatcttttattactttcttcttcaggtccaatcaagactccagttggtgcttgtgctactgctgtagaatctgtagatattggtgttgaaaccattttaagtggtaaggctaagattgttattgttggtggttatgatgatttccaagaagaaggttcttatgaatttgctcaaatgaaggctactagtaattcattagatgaattagctcatggtcgtgatccatctgaaatgtctcgtccagctactactactagatctggtttcatggaagctcaaggtgctggtcatgaaattttaatgaaagctagtcttgctattaagatgggtgtaccaatttatggtattattgctcatacttctactgctactgataaggaaggacgttctgttccagctccaggtcaaggtattttaactactgctcgtgaatctcatgcttcatacaacccattattagatttcaaatatcgtgctcgtcaaatgaacttccgtcgtaaacaaattaaactttgggtagaaaatgaattagatttattaaaggaagaagtagaagctaaggatcaaaaagatgatgaacaatctattaaatatattaaggaaagaacagcttatattaataaggaagctaaacgtcaagaaaaggaagctcttcgtacctatggtaatgaattctataagaatgatccaactattgctccattaagaggtgctcttgctgtctttggtttaactattgatgatattgatgccttatctttccatggtactggtactaaggctaatgatactaatgaatctgaagttattaataaacaatttaaacatcttggacgtagtaaaggtaatgtttgtccagctattatgcaaaagtatttaactggtcatccaaagggtgctgctgcttcatggatgcttaatggtatgcttcaagttattgaaactggtattattccaggtaatcgtaatgctgataatattgaagaaaaacttcgtaagtatgaatatatttgttacccatcacgttcaattcatactgatggtgttaaggctggtttattaaaatccttcggttttggtcaagttggtggtgaagttttagttattgccccagaatatgttttatctagtcttactaaggaagaatatgatgaatattgtaagaagagagatgttcgtcaacaagctatgtatagatatcttcatgattctatgactgaaaatgctgactttgttcaagttaaagatcatccaccatatgatgaatctaatgaatctagtgtttacttagatccattagctagagcttcttatgataagaaggaaggttcttggaaattcagtggtaa

SEQ ID NO: 23138 - DNA, 11268 bp, Piromyces finnis
  FATTY ACID SYNTHASE SUBUNIT BETA
tattccatttgaccaatggtctgttgctgaagaagtacgtgaacaatatcacatgcgtcaaaatcctttacaagcaactgctgatactagcattccgcaagaacaaagagaaattgaactttttattgatttcttagaattctcttctgcttatgcctatggtcaaggtcaagttcaaggtgaaattgttactcaatatagtgaatatgaatctgttgctgctggtgctgaagattcccaaggtttacttaaattcattacttgtgttttctctgaattttgtaatcgctactgtaaggtcaacaatattcatgtcaccactgcttcttacccaaagaagttaagacttcatgctattcaaacctactacaagattctcgatcttttagtttccgccaatactaacaataatactattgaatctgcttttattgaaaaggaatctaacagatcaaaaaaatctgctattttccaagctgttgctaagcataaggcttctgtctttgctgtttttggtggtcaaggtagtgaagactattttgatgaaattaatgaaatttatagtacatatgaagccatggttaagtcttacttagaaagaatggcatgcattttagaagaattagcttctaaaccagaacttttacaattcttcccaaagggtttacatgtcttaaagtggttagaagaaccagaaacccttccagataaaaaatatttagtcaatgctccaatttctttaccattagtaggactttgccaacttttacattacactgtattatataagtctttaggaaagactccggatgaaatgagaagaagctttattggtactactggtcattctcaaggtattatttcatctgttgttgtttcttcttcaggaacagaagaagaatttattgaaaattcagaaaaggctttatctttattattctggattggtgttagatctcaaatggcttacccagaaaccaccattaacccaaagattcttcaagattccttaaataatgatgaaggtgaaccaactccaatgatttcatttgctaatcttccagttagcaaaattgttgaacacattaaggctacaaaccaacatcttccagaagatagaaaaattcaaatttcattatataatggtccacgtagtattgtttgttctggtcatccacaaagtttatatggtttaaatgttactctccgtaagttaaaggctcaatcaaatattgaccaaaatagaattccattcagccaaagaaaaattcgttttagtagtcgttttcttcaaatttctgttccattccactgtgattacttaaaggatgttaatgatattattatgaaggatgtcgaacgtgatcatttaattcttggtaagggtgaattagccattccaatttattctactgaaaatggtgaagatttaagaggtcacccacaattcacttatgaattaattaagcaaatttgtactttaccagttcattgggaaaaagctacttctgttactaatgctacccatatcttagaatttggtcctgttggtgctggtgttggtttattaactcacagaaataagattggtactggtgttcaagtcattcttgctaatagtttagaaacttctgaaaaggaagttttatgtaaggatgctcttttcaatagagatccatcctcagttaagtattctatgaactgggaaaaattatttgctccaaagttagttaaatcttcttgtaatggtaagatttacgttgaaactcgtttcagtcgtttaattggtaaaccaccacttatggttggtggtatgactccaactacagctaatgaaaatcttgtcggtgcttgtataaacgctggataccacattgaattagctggtggtggtcaacactccactcaaatgattcgtgaccgtattaagaaaattatgtctaaggttccatctggtgaaggtatcactatgaatattatgttcttaaatgctttccaatggggattccaatacccacttgttcaagaaatgagaaaggaaggtattccacttgaaggtttatgtattgctgctggtgttccaagtcttgatgttgctaatgaaattctcgctaacttaaaggcttgcggtattaaacatgttgcttttaagccaggaagtgtttctgctatccaacaagttattgctattgctaaacaaaatccagatatgccaataattatgcaatggactggtggtcgtgctggtggtcaccactctttcgaagatttccatcaaccaattattgatacctatgctgctattcgtcgtcaaccaaatatcattattgttgttggtagtggtttcggtgatgcagaaggtactcttccatacttaactggtgactgggctcgtaagttcggatatccaccaatgccatttgatggtattttattcggtagtagaatcttggttgctgctgaagctggtactagtgaagaagttaagaaattattagttgcttctgaaggtattgaaaatgaaaaggaatgggaaaacacttacaagggttcaactggtggtattgttactgttaaatctgaattaggtgaaccaattcataaggttgcaactcgtggtgttttattatggaaggaattagatgaaactattttcaatcttccagctgaaaaacaattaccagccttacttgctcgtaaggaatacatcgttaaacgtcttaacaaggattatcaaaaggtatggttcccaaagaaatacgatgttgaagatccagaaaaggttgttgaccttaaggatatgacctactacgaagttttacgtcgtatgcttgaacttatgtatccaaatggtcaatggattgatgtttccttaagaatgatttatggtgatttcttccatagaactgaagaacgtttctataaggcttctgaaggtaagaactttgtttctttccttcaatcttatgaacaattagaagaagacccagtcggtttattagaaaagttcatggatgaaagagttccagaagctagagctcaattattaaacagtgatgatttaatgtacttcttgaatatatgtggtagacgtgatattaagccaccaccatatattccaattatggacaagtcattcaaatattggtttaagaaggatagtttatggcaatctgaacacttggatgctgttgttggtcaagatccaggtcgtgtttgtattcttcaaggtccagttgctgttagacattctactaaggccaatgaaccaattggttctattcttgaaagtattaatcaagaacacattaaggaattaaagatgcgttactatcaaaacagtgatactgttattccaattgttgattactttggtggtgctgaaattcgtgatgttcgtagaaagattcgtaacgttaccatcaagggtattaagaatgataatatctattctactatctttgaaattactgctgaaaataatgaagatcttccagatgaaaatgattggtttgatttattaggtggtcaatattacacttggttacatgctcttttaacttcaaagatttttgttaaagatgacgatggttactatcaagataactgtgtcagacgtattcttcgtccaaaaccacaacatatggttgaaattagaaccattgatgataagataaactctcttactatgtttactaaccaaggtggtaaggaaattgttaagattacaatcgatgataagaatgttattactgttttaatgagtgaatactcattaaacactaaacttgttcaacttccactcttattccaatataaacctgaacaaggatacgctccaatccatgaaataatggaaggtagaaatgaacgtattaagcgtttctactatgacttatggtttggtcttgaaaatggtaaatatacatttgaagaagattataaccatgatccaaaagaaccatttattagtgttagtgaaccaattactagacaacaaattactgattttgttaatattattggtaaccaagctgaatcctacaccgaccgtggtcaaaaggttttatacgctccaatggatttcgctattgttgttggttggcaaagtataattcgtgccattttcccaaagtttattaatgctgatttattaaagttagttcatctttctaacggtttccgtatgattgataatgctactggtttaaaggaaggtgatattgttaagactgaatctcgtattattagtgttattaatgatgaaaatggtaagattgttgaagttaagggtgttcttaagcgtgatgaaaagccatttatggaagttatttctaaattcttctaccgtggtgttttcactgattatgaatctacttttaagaatgttgaagaaaaaccataccatgttactttaaaaactaagaaggatgttcgtattcttgaatcccttgattggttcaagatgactactgaagaagaaaaattagaagaaggtgatcaattactctttgaattaaatagtgaatacacatacaaaactcatgatatttatagcaaggtaaaaactgttggtactgttaaaaagttattatctaccaaggtttatgttgatgttgcaaaggttgattactcttatgaagaaccagatggttcctgtggtaatccagttgttaactttatggaaagaaatggtatggttcaagatactccagattactttgaaaatggtggttatagtattatgccaaagggtaaaggtatttctagtgttgttaatactcactcctctaaccttggatactctcgtgtatcaggtgatgttaacccaatccacactaatccatactttgctcaattagctgatcttcctggtaatattactcatggtatgtggactagtgcctctactcgtaagtttgttgaaacatttgctgctgaaaatcatccacaacgtgttacttcttatgaagttaatttcttagatatggttttcccaggtgatcgtttagaaactaaactttaccatactggtatggctaatggtaagaagattattaaatgtaaaactattaatcaaaatggacaagttattcttgaaggtactgctgaagttgaacaaccaattactgcttatgtcttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactgaaatcactatttactttggaaatgtaaagggtcaacaaattcgtaaaaattatcaacaaatgacttatgaacatgttaataatgaaggtgttgttgaaagtctctcacttttcccagaaattgatgatgatagtgtttcttacactttccgtcatattggtggtttattatcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaagagctgtccaacgtgattctaagggacgttctgactatgctatgtgcgctgtcaacccagttcgtgttggtagtacttttaatgaaagtgctcttcaatatcttgtcgctagtattaaaaaggttactaatggtttaattgaaattgtaaactataacgttgataactggcaatatgttgtttctggtgatcttatttccttacaagtacttactcttgtcttaaactacttaaagtttgaaaagattgatttaactgtattattaaagactctttctgaagaagaacttcaaaagcaagttaatgaaattattaacaatgcctatgtaaaggcaaaggatcaaaagaagaagcacggatttattaaattagaacgtggtgctgcttcaattccattacgtggtattgatgtaccattccactctagtttcttattaagaggtgttgctccattccgtcaatacttaatgagtaagtttgatccaaaattaattgatgttaaccgtttaattggtaattatattccaaacttaactgctgaaccattctctcttgaaaagaagtttattgaaaacatttatgcaaagactaactctactcgtattaagaatgttttaaagggatggactgatgataagtatgcttccccacttcttcaacaaaagttaggttacattcttttaattgaattattagcttaccaatttgcaagtgctgttcgttggattgaaactcaagatagattattcgttgatattggtgttgaacgtttaattgaaattggtccaggtccaactctttctggtatggctcaaaagacattaaagttcaagtatgaatattatgatgatgctactagttaccgtcgtgaaattctttcttactctaagaactataaggaaatcttctatgactttgaagatgaagatgaaccagaaaaggttgaagaagctccaaaatctgctccagctgctgccccagccccagccccagctccagttgccgctccagttccagttgctgccccagctgccccagctgctgctgtcgctgatgaagatattcaagttaaacatttaattcatattcttattgcccaaaagttaaagaaatctgtccaagaagttccaatgtctgccactattaaggatttagttggtggtaagtctactcttcaaaatgaagttttaggtgatttacaaaaggaatttggaagttctgcagttccagataagtctgaagaattaccattaagtgaattagccggtcaaattgcttctggtccaattccaatgggtaaatacagtcaaactttagttaataagcttattagttctaagatggctgctggtttcaccaagggtaagattaatgattatctttctcaaaagtatggtttaggtccaaagagaacagatgccttacttttattcggtttaactgatgaaccagcctctcgtttcggtagtgaagatgaagctaaggcctggttagataaaatagctccaaattacttcggttttgtaggtgtttctgcaggtgctgccccagctgcaggtgctgccgttagtgttccaatggctgccgttagctctggtgctcttgctgaagtttcttctaagtatgaacaacttattagagaacaacttgacattttcatgaactatcttgatattgatccacgtaagggatacaacctttatgaagaagagttaagtaatgctgctaaacttcgtgctgaacttgatgtttggatcaatgaacatggtgatgattatgctcaaggtattaagccaatctttgatccattaaaggttagaaaatatgattcctactggaactgggtctatcaagaatctttaattctttactatgatattttatatggtagattagctgctgtcgatagaaaggttactagccaatgtattcacgtcatgaacagagctgatcaacatcttcttgatctttatgattacaagattgatgctactgatccaaagaagggttcaacttatgaattagctaaagattttgctcaaattcttagagaaaattgttcagaagctataagtgaaaatccagtttacaaggatgttgaaattccaaagaaaccacaaactattgttactgaacaaggtgaaattaagtatagtgaagttccacgtccaggtgtaagcaagatggaatcttatattaaattaatgcaaggaggtagtagaattactagaatcccaactaagcattctaaccgttctattcgctttgctggtggtaacaataagactagagtaaagtcaaagaaggttccattccttttccttaaggatacaaagacaggtgaatacgatgaaaaggctactaaggtttattacaaatctctttacaatatggctaatgatggtatcacctttaagaacaaatatgttttagttactggttgtggtcgtaactctattggttctcaaattattaagggattattaaatggtggtgctaaaattattgctaccacttcaagattcagtaaggttactatgcaatattatcgtcaactttatgaagaccatggttctaagggttcatgcttaattgtagttccattcaatgctgcttctactgaagatgttaatagattaattgaatacatttactccaaggatccaaagaatggtttgggttgggatcttgattatgttattccatttgctgctatctctgaaaatggcagaaccttagaaaacattgatagtagaagtgaattagctcacagaattatgcttactaacttattaagaatgttaggtaagattgttagtgaaaaggaagctcacaagtatgacactcgtccagctcaatgtattttaccaatgtctccaaatcatggtacttttggtggtgatggtctttactctgaatccaagattgctcttgaaactctcttcaacagatggcattctgaaggatggggaggttaccttactatcgtcggtgctgtaattggttggactagaggtacaggtttaatgaacagcaataaccttgttgctgaaggtattgaaatgtttggtgttcacactttcagtactcatgaaatggcatttaaccttattggtttaatgcataatgatatttgtaaaatgtgtcttaagggtccagtctttgctgatcttaatggtggtcttcaattcattgatgatttaaatagcaatattactatgattcgtactctccttaatgaaacttcagaaattagacgttctattaaggctgaaaaggacttagaaaagagtattactcttggtaagcttatggctaaggaaaagaaattaatgttaaagccacgtgctaacttaaagtttactttcccaaaggttaaaccatttgatgaattaaagaagttagattaccttagcggtatgattgatttagatcgtactgttgttgtcactggttatggtgaagtaggtccatatggtaactctcgtactcgttgggaaatggaagcctatggtaaattctctcttgaaggatgcattgaaatggcttggattatgggtatgattaaatatgctaagaacaagaagactaaggatggtaaactctattccggatgggtagattctgaaactggtgaaccagttcaagactttgaagttaaggctaagtatgaagaaagaatcttaaagcacactggtattcgtttcattgaaccagaactcttcaatggttatgatccaaacaacaaggtcttctaccaagaagttgctattgatcatgacttaccaggatttgaatgcagtaaggaagaagctgaacaattcaagaagaagcatggtgatcgtgttgacatttatgaaaatgctgaatctggccaatggactgttaagattaagaagggttcttccatttacattccaaaggctcttcaattcgatagaactgttgctgctcaaattccaactggttggaagccagaaacttatggtgttccaaagagtattattgaccaagttgatccaataaccctttatgttattgtagctactgttgaagctttaattagttccggtattactgatccatatgaattctatgaatatgtacatgtctctgaagtcggaaactgttctggtggtggtgttggtggtatgacctctaatcataagcaatactttgatcgtgtatttgaaaaaccagttcaaagtgatattcttcaagaatgtttcattaacactatgccagcttggattaacttattattactttcttcttctggtccaattaagactccagttggtgcttgtgctactgctgtcgaatctgttgaaattggtttagaaaccattttaagtggtaaggctaaaattgttattgttggtggttatgatgacttccaagaagaaggttcatacgaattcgctcaaatgaaggctacaagtaattccttggaagaacttgctcatggtcgtgatccatcagaaatgtctcgtccagctactactacaagagctggtttcatggaagctcaaggtgctggtcatgaaattttaatgactgctagtcttgctattaagatgggtgttccaatctatggtattattgctcatacctctactgctactgataaggaaggacgttctgttccagctccaggtcaaggtattttaaccactgctcgtgaagttggaaatggtaagagtccattattaaatccaaagtatcgtgctcgtcaattaaatgctcgtaagagatggattaagtcatgggttgaagaagaattagaattaatgaatgaagaagttaaggatatggaaggcgaatctcaagaagttattgatgcctttattgaagaaagaactgctttcattgatgctgaagctcgtaagcaagaaaaggaagccttccaagtttggggacaagaattctacaagaatgatccaactatctctccattaagaggtgctcttgctgtctttggtttaactattgatgatattcaagccttatccttccatggtactagtactaaggctaacgattctaatgaatctgaagtattcaacaagcaattcaagcaccttggacgtactaagggtaatgcttgcccagttattactcaaaagtacttaactggtcatccaaagggtgctgctgcttcttggatgcttaatggtatgcttcaagttattgaaactggtattattccaggtaatcgtaatgctgataatattgatgaaaagcttcgtaagttcgaatacctcttctacccatctcgttctattcacactgatggtgtcaaggctggtttattgaagtccttcggttttggtcaagttggtggtgaagttttagttatttccccagattatgtcttaggtactttaactaaagaagaatacgatgtttatcttaagaagagagaagttcgtcaacaagctatgtatagatatcttcacgattcaatgactgaaaacgctgactttgttcaagttaaggatcatccaccatatgatgatgcttctgaatctagtgtttacttagatccattagctagagcttcatatgataagaaggaaggtacctggaagttcaatggaaa

SEQ ID NO: 23139 - DNA, 11265 bp, Piromyces finnis
  FATTY ACID SYNTHASE SUBUNIT BETA
tattccatttgaccaatggtctgttgctgaagaagtacgtgaacaatatcacatgcgtcaaaatcctttacaagcaactgctgatactagcattccgcaagaacaaagagaaattgaactttttattgatttcttagaattctcttctgcttatgcctatggtcaaggtcaagttcaaggtgaaattgttactcaatatagtgaatatgaatctgttgctgctggtgctgaagattcccaaggtttacttaaattcattacttgtgttttctctgaattttgtaatcgctactgtaaggtcaacaatattcatgtcaccactgcttcttacccaaagaagttaagacttcatgctattcaaacctactacaagattctcgatcttttagtttccgccaatactaacaataatactattgaatctgcttttattgaaaaggaatctaacagatcaaaaaaatctgctattttccaagctgttgctaagcataaggcttctgtctttgctgtttttggtggtcaaggtagtgaagactattttgatgaaattaatgaaatttatagtacatatgaagccatggttaagtcttacttagaaagaatggcatgcattttagaagaattagcttctaaaccagaacttttacaattcttcccaaagggtttacatgtcttaaagtggttagaagaaccagaaacccttccagataaaaaatatttagtcaatgctccaatttctttaccattagtaggactttgccaacttttacattacactgtattatataagtctttaggaaagactccggatgaaatgagaagaagctttattggtactactggtcattctcaaggtattatttcatctgttgttgtttcttcttcaggaacagaagaagaatttattgaaaattcagaaaaggctttatctttattattctggattggtgttagatctcaaatggcttacccagaaaccaccattaacccaaagattcttcaagattccttaaataatgatgaaggtgaaccaactccaatgatttcatttgctaatcttccagttagcaaaattgttgaacacattaaggctacaaaccaacatcttccagaagatagaaaaattcaaatttcattatataatggtccacgtagtattgtttgttctggtcatccacaaagtttatatggtttaaatgttactctccgtaagttaaaggctcaatcaaatattgaccaaaatagaattccattcagccaaagaaaaattcgttttagtagtcgttttcttcaaatttctgttccattccactgtgattacttaaaggatgttaatgatattattatgaaggatgtcgaacgtgatcatttaattcttggtaagggtgaattagccattccaatttattctactgaaaatggtgaagatttaagaggtcacccacaattcacttatgaattaattaagcaaatttgtactttaccagttcattgggaaaaagctacttctgttactaatgctacccatatcttagaatttggtcctgttggtgctggtgttggtttattaactcacagaaataagattggtactggtgttcaagtcattcttgctaatagtttagaaacttctgaaaaggaagttttatgtaaggatgctcttttcaatagagatccatcctcagttaagtattctatgaactgggaaaaattatttgctccaaagttagttaaatcttcttgtaatggtaagatttacgttgaaactcgtttcagtcgtttaattggtaaaccaccacttatggttggtggtatgactccaactacagctaatgaaaatcttgtcggtgcttgtataaacgctggataccacattgaattagctggtggtggtcaacactccactcaaatgattcgtgaccgtattaagaaaattatgtctaaggttccatctggtgaaggtatcactatgaatattatgttcttaaatgctttccaatggggattccaatacccacttgttcaagaaatgagaaaggaaggtattccacttgaaggtttatgtattgctgctggtgttccaagtcttgatgttgctaatgaaattctcgctaacttaaaggcttgcggtattaaacatgttgcttttaagccaggaagtgtttctgctatccaacaagttattgctattgctaaacaaaatccagatatgccaataattatgcaatggactggtggtcgtgctggtggtcaccactctttcgaagatttccatcaaccaattattgatacctatgctgctattcgtcgtcaaccaaatatcattattgttgttggtagtggtttcggtgatgcagaaggtactcttccatacttaactggtgactgggctcgtaagttcggatatccaccaatgccatttgatggtattttattcggtagtagaatcttggttgctgctgaagctggtactagtgaagaagttaagaaattattagttgcttctgaaggtattgaaaatgaaaaggaatgggaaaacacttacaagggttcaactggtggtattgttactgttaaatctgaattaggtgaaccaattcataaggttgcaactcgtggtgttttattatggaaggaattagatgaaactattttcaatcttccagctgaaaaacaattaccagccttacttgctcgtaaggaatacatcgttaaacgtcttaacaaggattatcaaaaggtatggttcccaaagaaatacgatgttgaagatccagaaaaggttgttgaccttaaggatatgacctactacgaagttttacgtcgtatgcttgaacttatgtatccaaatggtcaatggattgatgtttccttaagaatgatttatggtgatttcttccatagaactgaagaacgtttctataaggcttctgaaggtaagaactttgtttctttccttcaatcttatgaacaattagaagaagacccagtcggtttattagaaaagttcatggatgaaagagttccagaagctagagctcaattattaaacagtgatgatttaatgtacttcttgaatatatgtggtagacgtgatattaagccaccaccatatattccaattatggacaagtcattcaaatattggtttaagaaggatagtttatggcaatctgaacacttggatgctgttgttggtcaagatccaggtcgtgtttgtattcttcaaggtccagttgctgttagacattctactaaggccaatgaaccaattggttctattcttgaaagtattaatcaagaacacattaaggaattaaagatgcgttactatcaaaacagtgatactgttattccaattgttgattactttggtggtgctgaaattcgtgatgttcgtagaaagattcgtaacgttaccatcaagggtattaagaatgataatatctattctactatctttgaaattactgctgaaaataatgaagatcttccagatgaaaatgattggtttgatttattaggtggtcaatattacacttggttacatgctcttttaacttcaaagatttttgttaaagatgacgatggttactatcaagataactgtgtcagacgtattcttcgtccaaaaccacaacatatggttgaaattagaaccattgatgataagataaactctcttactatgtttactaaccaaggtggtaaggaaattgttaagattacaatcgatgataagaatgttattactgttttaatgagtgaatactcattaaacactaaacttgttcaacttccactcttattccaatataaacctgaacaaggatacgctccaatccatgaaataatggaaggtagaaatgaacgtattaagcgtttctactatgacttatggtttggtcttgaaaatggtaaatatacatttgaagaagattataaccatgatccaaaagaaccatttattagtgttagtgaaccaattactagacaacaaattactgattttgttaatattattggtaaccaagctgaatcctacaccgaccgtggtcaaaaggttttatacgctccaatggatttcgctattgttgttggttggcaaagtataattcgtgccattttcccaaagtttattaatgctgatttattaaagttagttcatctttctaacggtttccgtatgattgataatgctactggtttaaaggaaggtgatattgttaagactgaatctcgtattattagtgttattaatgatgaaaatggtaagattgttgaagttaagggtgttcttaagcgtgatgaaaagccatttatggaagttatttctaaattcttctaccgtggtgttttcactgattatgaatctacttttaagaatgttgaagaaaaaccataccatgttactttaaaaactaagaaggatgttcgtattcttgaatcccttgattggttcaagatgactactgaagaagaaaaattagaagaaggtgatcaattactctttgaattaaatagtgaatacacatacaaaactcatgatatttatagcaaggtaaaaactgttggtactgttaaaaagttattatctaccaaggtttatgttgatgttgcaaaggttgattactcttatgaagaaccagatggttcctgtggtaatccagttgttaactttatggaaagaaatggtatggttcaagatactccagattactttgaaaatggtggttatagtattatgccaaagggtaaaggtatttctagtgttgttaatactcactcctctaaccttggatactctcgtgtatcaggtgatgttaacccaatccacactaatccatactttgctcaattagctgatcttcctggtaatattactcatggtatgtggactagtgcctctactcgtaagtttgttgaaacatttgctgctgaaaatcatccacaacgtgttacttcttatgaagttaatttcttagatatggttttcccaggtgatcgtttagaaactaaactttaccatactggtatggctaatggtaagaagattattaaatgtaaaactattaatcaaaatggacaagttattcttgaaggtactgctgaagttgaacaaccaattactgcttatgtcttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactgaaatcactatttactttggaaatgtaaagggtcaacaaattcgtaaaaattatcaacaaatgacttatgaacatgttaataatgaaggtgttgttgaaagtctctcacttttcccagaaattgatgatgatagtgtttcttacactttccgtcatattggtggtttattatcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaagagctgtccaacgtgattctaagggacgttctgactatgctatgtgcgctgtcaacccagttcgtgttggtagtacttttaatgaaagtgctcttcaatatcttgtcgctagtattaaaaaggttactaatggtttaattgaaattgtaaactataacgttgataactggcaatatgttgtttctggtgatcttatttccttacaagtacttactcttgtcttaaactacttaaagtttgaaaagattgatttaactgtattattaaagactctttctgaagaagaacttcaaaagcaagttaatgaaattattaacaatgcctatgtaaaggcaaaggatcaaaagaagaagcacggatttattaaattagaacgtggtgctgcttcaattccattacgtggtattgatgtaccattccactctagtttcttattaagaggtgttgctccattccgtcaatacttaatgagtaagtttgatccaaaattaattgatgttaaccgtttaattggtaattatattccaaacttaactgctgaaccattctctcttgaaaagaagtttattgaaaacatttatgcaaagactaactctactcgtattaagaatgttttaaagggatggactgatgataagtatgcttccccacttcttcaacaaaagttaggttacattcttttaattgaattattagcttaccaatttgcaagtgctgttcgttggattgaaactcaagatagattattcgttgatattggtgttgaacgtttaattgaaattggtccaggtccaactctttctggtatggctcaaaagacattaaagttcaagtatgaatattatgatgatgctactagttaccgtcgtgaaattctttcttactctaagaactataaggaaatcttctatgactttgaagatgaagatgaaccagaaaaggttgaagaagctccaaaatctgctccagctgctgccccagccccagccccagctccagttgccgctccagttccagttgctgccccagctgccccagctgctgctgtcgctgatgaagatattcaagttaaacatttaattcatattcttattgcccaaaagttaaagaaatctgtccaagaagttccaatgtctgccactattaaggatttagttggtggtaagtctactcttcaaaatgaagttttaggtgatttacaaaaggaatttggaagttctgcagttccagataagtctgaagaattaccattaagtgaattagccggtcaaattgcttctggtccaattccaatgggtaaatacagtcaaactttagttaataagcttattagttctaagatggctgctggtttcaccaagggtaagattaatgattatctttctcaaaagtatggtttaggtccaaagagaacagatgccttacttttattcggtttaactgatgaaccagcctctcgtttcggtagtgaagatgaagctaaggcctggttagataaaatagctccaaattacttcggttttgtaggtgtttctgcaggtgctgccccagctgcaggtgctgccgttagtgttccaatggctgccgttagctctggtgctcttgctgaagtttcttctaagtatgaacaacttattagagaacaacttgacattttcatgaactatcttgatattgatccacgtaagggatacaacctttatgaagaagagttaagtaatgctgctaaacttcgtgctgaacttgatgtttggatcaatgaacatggtgatgattatgctcaaggtattaagccaatctttgatccattaaaggttagaaaatatgattcctactggaactgggtctatcaagaatctttaattctttactatgatattttatatggtagattagctgctgtcgatagaaaggttactagccaatgtattcacgtcatgaacagagctgatcaacatcttcttgatctttatgattacaagattgatgctactgatccaaagaagggttcaacttatgaattagctaaagattttgctcaaattcttagagaaaattgttcagaagctataagtgaaaatccagtttacaaggatgttgaaattccaaagaaaccacaaactattgttactgaacaaggtgaaattaagtatagtgaagttccacgtccaggtgtaagcaagatggaatcttatattaaattaatgcaaggaggtagtagaattactagaatcccaactaagcattctaaccgttctattcgctttgctggtggtaacaataagactagagtaaagtcaaagaaggttccattccttttccttaaggatacaaagacaggtgaatacgatgaaaaggctactaaggtttattacaaatctctttacaatatggctaatgatggtatcacctttaagaacaaatatgttttagttactggttgtggtcgtaactctattggttctcaaattattaagggattattaaatggtggtgctaaaattattgctaccacttcaagattcagtaaggttactatgcaatattatcgtcaactttatgaagaccatggttctaagggttcatgcttaattgtagttccattcaatgctgcttctactgaagatgttaatagattaattgaatacatttactccaaggatccaaagaatggtttgggttgggatcttgattatgttattccatttgctgctatctctgaaaatggcagaaccttagaaaacattgatagtagaagtgaattagctcacagaattatgcttactaacttattaagaatgttaggtaagattgttagtgaaaaggaagctcacaagtatgacactcgtccagctcaatgtattttaccaatgtctccaaatcatggtacttttggtggtgatggtctttactctgaatccaagattgctcttgaaactctcttcaacagatggcattctgaaggatggggaggttaccttactatcgtcggtgctgtaattggttggactagaggtacaggtttaatgaacagcaataaccttgttgctgaaggtattgaaatgtttggtgttcacactttcagtactcatgaaatggcatttaaccttattggtttaatgcataatgatatttgtaaaatgtgtcttaagggtccagtctttgctgatcttaatggtggtcttcaattcattgatgatttaaatagcaatattactatgattcgtactctccttaatgaaacttcagaaattagacgttctattaaggctgaaaaggacttagaaaagagtattactcttggtaagcttatggctaaggaaaagaaattaatgttaaagccacgtgctaacttaaagtttactttcccaaaggttaaaccatttgatgaattaaagaagttagattaccttagcggtatgattgatttagatcgtactgttgttgtcactggttatggtgaagtaggtccatatggtaactctcgtactcgttgggaaatggaagcctatggtaaattctctcttgaaggatgcattgaaatggcttggattatgggtatgattaaatatgctaagaacaagaagactaaggatggtaaactctattccggatgggtagattctgaaactggtgaaccagttcaagactttgaagttaaggctaagtatgaagaaagaatcttaaagcacactggtattcgtttcattgaaccagaactcttcaatggttatgatccaaacaacaaggtcttctaccaagaagttgctattgatcatgacttaccaggatttgaatgcagtaaggaagaagctgaacaattcaagaagaagcatggtgatcgtgttgacatttatgaaaatgctgaatctggccaatggactgttaagattaagaagggttcttccatttacattccaaaggctcttcaattcgatagaactgttgctgctcaaattccaactggttggaagccagaaacttatggtgttccaaagagtattattgaccaagttgatccaataaccctttatgttattgtagctactgttgaagctttaattagttccggtattactgatccatatgaattctatgaatatgtacatgtctctgaagtcggaaactgttctggtggtggtgttggtggtatgacctctaatcataagcaatactttgatcgtgtatttgaaaaaccagttcaaagtgatattcttcaagaatgtttcattaacactatgccagcttggattaacttattattactttcttcttctggtccaattaagactccagttggtgcttgtgctactgctgtcgaatctgttgaaattggtttagaaaccattttaagtggtaaggctaaaattgttattgttggtggttatgatgacttccaagaagaaggttcatacgaattcgctcaaatgaaggctacaagtaattccttggaagaacttgctcatggtcgtgatccatcagaaatgtctcgtccagctactactacaagagctggtttcatggaagctcaaggtgctggtcatgaaattttaatgactgctagtcttgctattaagatgggtgttccaatctatggtattattgctcatacctctactgctactgataaggaaggacgttctgttccagctccaggtcaaggtattttaactactgctcgtgaatctcatgcttcctacaatccattattagacttcaagtaccgtgctcgccaaatgaagttccgtcgtaagcaaattaaattatggattgaaaatgaattagagttattacaagaagaaatggatactagagaaaacaaggatgatgaacaattcaccaagtatgttaaagaaagaactgcatacattaacaaagaagctaagcgtcttgaaaaggaagctcttcgtacctatggtaatgaattctacaagaatgatccaactatttctccattacgtggtgctttagctgcctttggtcttactgttgatgatattggtgttgcttccttccacggtactggtactaaggccaatgataagaatgaatctgatgtattcaacaagcaattcgaacatcttggtcgtactaagggtaacgcttgtccagtagtttgtcaaaagtatcttactggtcacggtaagggtgctgctgctgcttggatgttaaatggtgttatccaaattcttcaaactggtattgttccaggtaaccgtaatgctgataacattgatccacttcttgaaaagtatgaacatctttggttcaataacaagactttcaagactccaggtgttaaggctggtttattaaagtcattcggtttcggtcaagttggtggtgaaattttagttgtccacccagactgtctctttgctactcttgatgaaaatacttacaatgcttacaaggctaagcgtgatatccgtgaacacaaggcctttagaaagcttcacgataccttaactggtgaagactttgtccaagttaaggatgaaccaccatacactccagaacaagaaagtgctgtttacttaaacccattagctcgtgcttcttacaacaagaagactaagaagtgggattatgaacaaca

SEQ ID NO: 23140 - DNA, 11268 bp, Piromyces finnis
  FATTY ACID SYNTHASE SUBUNIT BETA
tattccatttgaccaatggtctgttgctgaagaagtacgtgaacaatatcacatgcgtcaaaatcctttacaagcaactgctgatactagcattccgcaagaacaaagagaaattgaactttttattgatttcttagaattctcttctgcttatgcctatggtcaaggtcaagttcaaggtgaaattgttactcaatatagtgaatatgaatctgttgctgctggtgctgaagattcccaaggtttacttaaattcattacttgtgttttctctgaattttgtaatcgctactgtaaggtcaacaatattcatgtcaccactgcttcttacccaaagaagttaagacttcatgctattcaaacctactacaagattctcgatcttttagtttccgccaatactaacaataatactattgaatctgcttttattgaaaaggaatctaacagatcaaaaaaatctgctattttccaagctgttgctaagcataaggcttctgtctttgctgtttttggtggtcaaggtagtgaagactattttgatgaaattaatgaaatttatagtacatatgaagccatggttaagtcttacttagaaagaatggcatgcattttagaagaattagcttctaaaccagaacttttacaattcttcccaaagggtttacatgtcttaaagtggttagaagaaccagaaacccttccagataaaaaatatttagtcaatgctccaatttctttaccattagtaggactttgccaacttttacattacactgtattatataagtctttaggaaagactccggatgaaatgagaagaagctttattggtactactggtcattctcaaggtattatttcatctgttgttgtttcttcttcaggaacagaagaagaatttattgaaaattcagaaaaggctttatctttattattctggattggtgttagatctcaaatggcttacccagaaaccaccattaacccaaagattcttcaagattccttaaataatgatgaaggtgaaccaactccaatgatttcatttgctaatcttccagttagcaaaattgttgaacacattaaggctacaaaccaacatcttccagaagatagaaaaattcaaatttcattatataatggtccacgtagtattgtttgttctggtcatccacaaagtttatatggtttaaatgttactctccgtaagttaaaggctcaatcaaatattgaccaaaatagaattccattcagccaaagaaaaattcgttttagtagtcgttttcttcaaatttctgttccattccactgtgattacttaaaggatgttaatgatattattatgaaggatgtcgaacgtgatcatttaattcttggtaagggtgaattagccattccaatttattctactgaaaatggtgaagatttaagaggtcacccacaattcacttatgaattaattaagcaaatttgtactttaccagttcattgggaaaaagctacttctgttactaatgctacccatatcttagaatttggtcctgttggtgctggtgttggtttattaactcacagaaataagattggtactggtgttcaagtcattcttgctaatagtttagaaacttctgaaaaggaagttttatgtaaggatgctcttttcaatagagatccatcctcagttaagtattctatgaactgggaaaaattatttgctccaaagttagttaaatcttcttgtaatggtaagatttacgttgaaactcgtttcagtcgtttaattggtaaaccaccacttatggttggtggtatgactccaactacagctaatgaaaatcttgtcggtgcttgtataaacgctggataccacattgaattagctggtggtggtcaacactccactcaaatgattcgtgaccgtattaagaaaattatgtctaaggttccatctggtgaaggtatcactatgaatattatgttcttaaatgctttccaatggggattccaatacccacttgttcaagaaatgagaaaggaaggtattccacttgaaggtttatgtattgctgctggtgttccaagtcttgatgttgctaatgaaattctcgctaacttaaaggcttgcggtattaaacatgttgcttttaagccaggaagtgtttctgctatccaacaagttattgctattgctaaacaaaatccagatatgccaataattatgcaatggactggtggtcgtgctggtggtcaccactctttcgaagatttccatcaaccaattattgatacctatgctgctattcgtcgtcaaccaaatatcattattgttgttggtagtggtttcggtgatgcagaaggtactcttccatacttaactggtgactgggctcgtaagttcggatatccaccaatgccatttgatggtattttattcggtagtagaatcttggttgctgctgaagctggtactagtgaagaagttaagaaattattagttgcttctgaaggtattgaaaatgaaaaggaatgggaaaacacttacaagggttcaactggtggtattgttactgttaaatctgaattaggtgaaccaattcataaggttgcaactcgtggtgttttattatggaaggaattagatgaaactattttcaatcttccagctgaaaaacaattaccagccttacttgctcgtaaggaatacatcgttaaacgtcttaacaaggattatcaaaaggtatggttcccaaagaaatacgatgttgaagatccagaaaaggttgttgaccttaaggatatgacctactacgaagttttacgtcgtatgcttgaacttatgtatccaaatggtcaatggattgatgtttccttaagaatgatttatggtgatttcttccatagaactgaagaacgtttctataaggcttctgaaggtaagaactttgtttctttccttcaatcttatgaacaattagaagaagacccagtcggtttattagaaaagttcatggatgaaagagttccagaagctagagctcaattattaaacagtgatgatttaatgtacttcttgaatatatgtggtagacgtgatattaagccaccaccatatattccaattatggacaagtcattcaaatattggtttaagaaggatagtttatggcaatctgaacacttggatgctgttgttggtcaagatccaggtcgtgtttgtattcttcaaggtccagttgctgttagacattctactaaggccaatgaaccaattggttctattcttgaaagtattaatcaagaacacattaaggaattaaagatgcgttactatcaaaacagtgatactgttattccaattgttgattactttggtggtgctgaaattcgtgatgttcgtagaaagattcgtaacgttaccatcaagggtattaagaatgataatatctattctactatctttgaaattactgctgaaaataatgaagatcttccagatgaaaatgattggtttgatttattaggtggtcaatattacacttggttacatgctcttttaacttcaaagatttttgttaaagatgacgatggttactatcaagataactgtgtcagacgtattcttcgtccaaaaccacaacatatggttgaaattagaaccattgatgataagataaactctcttactatgtttactaaccaaggtggtaaggaaattgttaagattacaatcgatgataagaatgttattactgttttaatgagtgaatactcattaaacactaaacttgttcaacttccactcttattccaatataaacctgaacaaggatacgctccaatccatgaaataatggaaggtagaaatgaacgtattaagcgtttctactatgacttatggtttggtcttgaaaatggtaaatatacatttgaagaagattataaccatgatccaaaagaaccatttattagtgttagtgaaccaattactagacaacaaattactgattttgttaatattattggtaaccaagctgaatcctacaccgaccgtggtcaaaaggttttatacgctccaatggatttcgctattgttgttggttggcaaagtataattcgtgccattttcccaaagtttattaatgctgatttattaaagttagttcatctttctaacggtttccgtatgattgataatgctactggtttaaaggaaggtgatattgttaagactgaatctcgtattattagtgttattaatgatgaaaatggtaagattgttgaagttaagggtgttcttaagcgtgatgaaaagccatttatggaagttatttctaaattcttctaccgtggtgttttcactgattatgaatctacttttaagaatgttgaagaaaaaccataccatgttactttaaaaactaagaaggatgttcgtattcttgaatcccttgattggttcaagatgactactgaagaagaaaaattagaagaaggtgatcaattactctttgaattaaatagtgaatacacatacaaaactcatgatatttatagcaaggtaaaaactgttggtactgttaaaaagttattatctaccaaggtttatgttgatgttgcaaaggttgattactcttatgaagaaccagatggttcctgtggtaatccagttgttaactttatggaaagaaatggtatggttcaagatactccagattactttgaaaatggtggttatagtattatgccaaagggtaaaggtatttctagtgttgttaatactcactcctctaaccttggatactctcgtgtatcaggtgatgttaacccaatccacactaatccatactttgctcaattagctgatcttcctggtaatattactcatggtatgtggactagtgcctctactcgtaagtttgttgaaacatttgctgctgaaaatcatccacaacgtgttacttcttatgaagttaatttcttagatatggttttcccaggtgatcgtttagaaactaaactttaccatactggtatggctaatggtaagaagattattaaatgtaaaactattaatcaaaatggacaagttattcttgaaggtactgctgaagttgaacaaccaattactgcttatgtcttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactgaaatcactatttactttggaaatgtaaagggtcaacaaattcgtaaaaattatcaacaaatgacttatgaacatgttaataatgaaggtgttgttgaaagtctctcacttttcccagaaattgatgatgatagtgtttcttacactttccgtcatattggtggtttattatcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaagagctgtccaacgtgattctaagggacgttctgactatgctatgtgcgctgtcaacccagttcgtgttggtagtacttttaatgaaagtgctcttcaatatcttgtcgctagtattaaaaaggttactaatggtttaattgaaattgtaaactataacgttgataactggcaatatgttgtttctggtgatcttatttccttacaagtacttactcttgtcttaaactacttaaagtttgaaaagattgatttaactgtattattaaagactctttctgaagaagaacttcaaaagcaagttaatgaaattattaacaatgcctatgtaaaggcaaaggatcaaaagaagaagcacggatttattaaattagaacgtggtgctgcttcaattccattacgtggtattgatgtaccattccactctagtttcttattaagaggtgttgctccattccgtcaatacttaatgagtaagtttgatccaaaattaattgatgttaaccgtttaattggtaattatattccaaacttaactgctgaaccattctctcttgaaaagaagtttattgaaaacatttatgcaaagactaactctactcgtattaagaatgttttaaagggatggactgatgataagtatgcttccccacttcttcaacaaaagttaggttacattcttttaattgaattattagcttaccaatttgcaagtgctgttcgttggattgaaactcaagatagattattcgttgatattggtgttgaacgtttaattgaaattggtccaggtccaactctttctggtatggctcaaaagacattaaagttcaagtatgaatattatgatgatgctactagttaccgtcgtgaaattctttcttactctaagaactataaggaaatcttctatgactttgaagatgaagatgaaccagaaaaggttgaagaagctccaaaatctgctccagctgctgccccagccccagccccagctccagttgccgctccagttccagttgctgccccagctgccccagctgctgctgtcgctgatgaagatattcaagttaaacatttaattcatattcttattgcccaaaagttaaagaaatctgtccaagaagttccaatgtctgccactattaaggatttagttggtggtaagtctactcttcaaaatgaagttttaggtgatttacaaaaggaatttggaagttctgcagttccagataagtctgaagaattaccattaagtgaattagccggtcaaattgcttctggtccaattccaatgggtaaatacagtcaaactttagttaataagcttattagttctaagatggctgctggtttcaccaagggtaagattaatgattatctttctcaaaagtatggtttaggtccaaagagaacagatgccttacttttattcggtttaactgatgaaccagcctctcgtttcggtagtgaagatgaagctaaggcctggttagataaaatagctccaaattacttcggttttgtaggtgtttctgcaggtgctgccccagctgcaggtgctgccgttagtgttccaatggctgccgttagctctggtgctcttgctgaagtttcttctaagtatgaacaacttattagagaacaacttgacattttcatgaactatcttgatattgatccacgtaagggatacaacctttatgaagaagagttaagtaatgctgctaaacttcgtgctgaacttgatgtttggatcaatgaacatggtgatgattatgctcaaggtattaagccaatctttgatccattaaaggttagaaaatatgattcctactggaactgggtctatcaagaatctttaattctttactatgatattttatatggtagattagctgctgtcgatagaaaggttactagccaatgtattcacgtcatgaacagagctgatcaacatcttcttgatctttatgattacaagattgatgctactgatccaaagaagggttcaacttatgaattagctaaagattttgctcaaattcttagagaaaattgttcagaagctataagtgaaaatccagtttacaaggatgttgaaattccaaagaaaccacaaactattgttactgaacaaggtgaaattaagtatagtgaagttccacgtccaggtgtaagcaagatggaatcttatattaaattaatgcaaggaggtagtagaattactagaatcccaactaagcattctaaccgttctattcgctttgctggtggtaacaataagactagagtaaagtcaaagaaggttccattccttttccttaaggatacaaagacaggtgaatacgatgaaaaggctactaaggtttattacaaatctctttacaatatggctaatgatggtatcacctttaagaacaaatatgttttagttactggttgtggtcgtaactctattggttctcaaattattaagggattattaaatggtggtgctaaaattattgctaccacttcaagattcagtaaggttactatgcaatattatcgtcaactttatgaagaccatggttctaagggttcatgcttaattgtagttccattcaatgctgcttctactgaagatgttaatagattaattgaatacatttactccaaggatccaaagaatggtttgggttgggatcttgattatgttattccatttgctgctatctctgaaaatggcagaaccttagaaaacattgatagtagaagtgaattagctcacagaattatgcttactaacttattaagaatgttaggtaagattgttagtgaaaaggaagctcacaagtatgacactcgtccagctcaatgtattttaccaatgtctccaaatcatggtacttttggtggtgatggtctttactctgaatccaagattgctcttgaaactctcttcaacagatggcattctgaaggatggggaggttaccttactatcgtcggtgctgtaattggttggactagaggtacaggtttaatgaacagcaataaccttgttgctgaaggtattgaaatgtttggtgttcacactttcagtactcatgaaatggcatttaaccttattggtttaatgcataatgatatttgtaaaatgtgtcttaagggtccagtctttgctgatcttaatggtggtcttcaattcattgatgatttaaatagcaatattactatgattcgtactctccttaatgaaacttcagaaattagacgttctattaaggctgaaaaggacttagaaaagagtattactcttggtaagcttatggctaaggaaaagaaattaatgttaaagccacgtgctaacttaaagtttactttcccaaaggttaaaccatttgatgaattaaagaagttagattaccttagcggtatgattgatttagatcgtactgttgttgtcactggttatggtgaagtaggtccatatggtaactctcgtactcgttgggaaatggaagcctatggtaaattctctcttgaaggatgcattgaaatggcttggattatgggtatgattaaatatgctaagaacaagaagactaaggatggtaaactctattccggatgggtagattctgaaactggtgaaccagttcaagactttgaagttaaggctaagtatgaagaaagaatcttaaagcacactggtattcgtttcattgaaccagaactcttcaatggttatgatccaaacaacaaggtcttctaccaagaagttgctattgatcatgacttaccaggatttgaatgcagtaaggaagaagctgaacaattcaagaagaagcatggtgatcgtgttgacatttatgaaaatgctgaatctggccaatggactgttaagattaagaagggttcttccatttacattccaaaggctcttcaattcgatagaactgttgctgctcaaattccaactggttggaagccagaaacttatggtgttccaaagagtattattgaccaagttgatccaataaccctttatgttattgtagctactgttgaagctttaattagttccggtattactgatccatatgaattctatgaatatgtacatgtctctgaagtcggaaactgttctggtggtggtgttggtggtatgacctctaatcataagcaatactttgatcgtgtatttgaaaaaccagttcaaagtgatattcttcaagaatgtttcattaacactatgccagcttggattaacttattattactttcttcttctggtccaattaagactccagttggtgcttgtgctactgctgtcgaatctgttgaaattggtttagaaaccattttaagtggtaaggctaaaattgttattgttggtggttatgatgacttccaagaagaaggttcatacgaattcgctcaaatgaaggctacaagtaattccttggaagaacttgctcatggtcgtgatccatcagaaatgtctcgtccagctactactacaagagctggtttcatggaagctcaaggtgctggtcatgaaattttaatgactgctagtcttgctattaagatgggtgttccaatctatggtattattgctcatacctctactgctactgataaggaaggacgttctgttccagctccaggtcaaggtattttaactactgctcgtgaatctcatgcttcctacaatccattattagacttcaagtaccgtgctcgccaaatgaagttccgtcgtaagcaaattaaattatggattgaaaatgaattagagttattacaagaagaaatggatactagagaaaacaaggatgatgaacaattcaccaagtatgttaaagaaagaactgcatacattaacaaagaagctaagcgtcttgaaaaggaagctcttcgtacctatggtaatgaattctacaagaatgatccaactatctctccattaagaggtgctcttgctgtctttggtttaactattgatgatattcaagccttatccttccatggtactagtactaaggctaacgattctaatgaatctgaagtattcaacaagcaattcaagcaccttggacgtactaagggtaatgcttgcccagttattactcaaaagtacttaactggtcatccaaagggtgctgctgcttcttggatgcttaatggtatgcttcaagttattgaaactggtattattccaggtaatcgtaatgctgataatattgatgaaaagcttcgtaagttcgaatacctcttctacccatctcgttctattcacactgatggtgtcaaggctggtttattgaagtccttcggttttggtcaagttggtggtgaagttttagttatttccccagattatgtcttaggtactttaactaaagaagaatacgatgtttatcttaagaagagagaagttcgtcaacaagctatgtatagatatcttcacgattcaatgactgaaaacgctgactttgttcaagttaaggatcatccaccatatgatgatgcttctgaatctagtgtttacttagatccattagctagagcttcatatgataagaaggaaggtacctggaagttcaatggaaa

SEQ ID NO: 23141 - DNA, 11265 bp, Piromyces finnis
  FATTY ACID SYNTHASE SUBUNIT BETA
tattccatttgaccaatggtctgttgctgaagaagtacgtgaacaatatcacatgcgtcaaaatcctttacaagcaactgctgatactagcattccgcaagaacaaagagaaattgaactttttattgatttcttagaattctcttctgcttatgcctatggtcaaggtcaagttcaaggtgaaattgttactcaatatagtgaatatgaatctgttgctgctggtgctgaagattcccaaggtttacttaaattcattacttgtgttttctctgaattttgtaatcgctactgtaaggtcaacaatattcatgtcaccactgcttcttacccaaagaagttaagacttcatgctattcaaacctactacaagattctcgatcttttagtttccgccaatactaacaataatactattgaatctgcttttattgaaaaggaatctaacagatcaaaaaaatctgctattttccaagctgttgctaagcataaggcttctgtctttgctgtttttggtggtcaaggtagtgaagactattttgatgaaattaatgaaatttatagtacatatgaagccatggttaagtcttacttagaaagaatggcatgcattttagaagaattagcttctaaaccagaacttttacaattcttcccaaagggtttacatgtcttaaagtggttagaagaaccagaaacccttccagataaaaaatatttagtcaatgctccaatttctttaccattagtaggactttgccaacttttacattacactgtattatataagtctttaggaaagactccggatgaaatgagaagaagctttattggtactactggtcattctcaaggtattatttcatctgttgttgtttcttcttcaggaacagaagaagaatttattgaaaattcagaaaaggctttatctttattattctggattggtgttagatctcaaatggcttacccagaaaccaccattaacccaaagattcttcaagattccttaaataatgatgaaggtgaaccaactccaatgatttcatttgctaatcttccagttagcaaaattgttgaacacattaaggctacaaaccaacatcttccagaagatagaaaaattcaaatttcattatataatggtccacgtagtattgtttgttctggtcatccacaaagtttatatggtttaaatgttactctccgtaagttaaaggctcaatcaaatattgaccaaaatagaattccattcagccaaagaaaaattcgttttagtagtcgttttcttcaaatttctgttccattccactgtgattacttaaaggatgttaatgatattattatgaaggatgtcgaacgtgatcatttaattcttggtaagggtgaattagccattccaatttattctactgaaaatggtgaagatttaagaggtcacccacaattcacttatgaattaattaagcaaatttgtactttaccagttcattgggaaaaagctacttctgttactaatgctacccatatcttagaatttggtcctgttggtgctggtgttggtttattaactcacagaaataagattggtactggtgttcaagtcattcttgctaatagtttagaaacttctgaaaaggaagttttatgtaaggatgctcttttcaatagagatccatcctcagttaagtattctatgaactgggaaaaattatttgctccaaagttagttaaatcttcttgtaatggtaagatttacgttgaaactcgtttcagtcgtttaattggtaaaccaccacttatggttggtggtatgactccaactacagctaatgaaaatcttgtcggtgcttgtataaacgctggataccacattgaattagctggtggtggtcaacactccactcaaatgattcgtgaccgtattaagaaaattatgtctaaggttccatctggtgaaggtatcactatgaatattatgttcttaaatgctttccaatggggattccaatacccacttgttcaagaaatgagaaaggaaggtattccacttgaaggtttatgtattgctgctggtgttccaagtcttgatgttgctaatgaaattctcgctaacttaaaggcttgcggtattaaacatgttgcttttaagccaggaagtgtttctgctatccaacaagttattgctattgctaaacaaaatccagatatgccaataattatgcaatggactggtggtcgtgctggtggtcaccactctttcgaagatttccatcaaccaattattgatacctatgctgctattcgtcgtcaaccaaatatcattattgttgttggtagtggtttcggtgatgcagaaggtactcttccatacttaactggtgactgggctcgtaagttcggatatccaccaatgccatttgatggtattttattcggtagtagaatcttggttgctgctgaagctggtactagtgaagaagttaagaaattattagttgcttctgaaggtattgaaaatgaaaaggaatgggaaaacacttacaagggttcaactggtggtattgttactgttaaatctgaattaggtgaaccaattcataaggttgcaactcgtggtgttttattatggaaggaattagatgaaactattttcaatcttccagctgaaaaacaattaccagccttacttgctcgtaaggaatacatcgttaaacgtcttaacaaggattatcaaaaggtatggttcccaaagaaatacgatgttgaagatccagaaaaggttgttgaccttaaggatatgacctactacgaagttttacgtcgtatgcttgaacttatgtatccaaatggtcaatggattgatgtttccttaagaatgatttatggtgatttcttccatagaactgaagaacgtttctataaggcttctgaaggtaagaactttgtttctttccttcaatcttatgaacaattagaagaagacccagtcggtttattagaaaagttcatggatgaaagagttccagaagctagagctcaattattaaacagtgatgatttaatgtacttcttgaatatatgtggtagacgtgatattaagccaccaccatatattccaattatggacaagtcattcaaatattggtttaagaaggatagtttatggcaatctgaacacttggatgctgttgttggtcaagatccaggtcgtgtttgtattcttcaaggtccagttgctgttagacattctactaaggccaatgaaccaattggttctattcttgaaagtattaatcaagaacacattaaggaattaaagatgcgttactatcaaaacagtgatactgttattccaattgttgattactttggtggtgctgaaattcgtgatgttcgtagaaagattcgtaacgttaccatcaagggtattaagaatgataatatctattctactatctttgaaattactgctgaaaataatgaagatcttccagatgaaaatgattggtttgatttattaggtggtcaatattacacttggttacatgctcttttaacttcaaagatttttgttaaagatgacgatggttactatcaagataactgtgtcagacgtattcttcgtccaaaaccacaacatatggttgaaattagaaccattgatgataagataaactctcttactatgtttactaaccaaggtggtaaggaaattgttaagattacaatcgatgataagaatgttattactgttttaatgagtgaatactcattaaacactaaacttgttcaacttccactcttattccaatataaacctgaacaaggatacgctccaatccatgaaataatggaaggtagaaatgaacgtattaagcgtttctactatgacttatggtttggtcttgaaaatggtaaatatacatttgaagaagattataaccatgatccaaaagaaccatttattagtgttagtgaaccaattactagacaacaaattactgattttgttaatattattggtaaccaagctgaatcctacaccgaccgtggtcaaaaggttttatacgctccaatggatttcgctattgttgttggttggcaaagtataattcgtgccattttcccaaagtttattaatgctgatttattaaagttagttcatctttctaacggtttccgtatgattgataatgctactggtttaaaggaaggtgatattgttaagactgaatctcgtattattagtgttattaatgatgaaaatggtaagattgttgaagttaagggtgttcttaagcgtgatgaaaagccatttatggaagttatttctaaattcttctaccgtggtgttttcactgattatgaatctacttttaagaatgttgaagaaaaaccataccatgttactttaaaaactaagaaggatgttcgtattcttgaatcccttgattggttcaagatgactactgaagaagaaaaattagaagaaggtgatcaattactctttgaattaaatagtgaatacacatacaaaactcatgatatttatagcaaggtaaaaactgttggtactgttaaaaagttattatctaccaaggtttatgttgatgttgcaaaggttgattactcttatgaagaaccagatggttcctgtggtaatccagttgttaactttatggaaagaaatggtatggttcaagatactccagattactttgaaaatggtggttatagtattatgccaaagggtaaaggtatttctagtgttgttaatactcactcctctaaccttggatactctcgtgtatcaggtgatgttaacccaatccacactaatccatactttgctcaattagctgatcttcctggtaatattactcatggtatgtggactagtgcctctactcgtaagtttgttgaaacatttgctgctgaaaatcatccacaacgtgttacttcttatgaagttaatttcttagatatggttttcccaggtgatcgtttagaaactaaactttaccatactggtatggctaatggtaagaagattattaaatgtaaaactattaatcaaaatggacaagttattcttgaaggtactgctgaagttgaacaaccaattactgcttatgtcttcactggtcaaggtgctcaagaagttggtatgggtatggacttatatgaaaaatccccagttgctagagaaatttgggatcgtgctgataagcatttaatggaaaactacggtttctctattattgatattgttaagaacaatccaactgaaatcactatttactttggaaatgtaaagggtcaacaaattcgtaaaaattatcaacaaatgacttatgaacatgttaataatgaaggtgttgttgaaagtctctcacttttcccagaaattgatgatgatagtgtttcttacactttccgtcatattggtggtttattatcagctactcaattcactcaaccatctcttgtattgatggaaaaggctgcctttgaagaaatgagatcccgtggttacattcaacaaaacagtgcttttgctggtcacagtttaggtgaatatgccgctttaacagctattggtgatgttttaagtattgaaactttagttgatgttgtcttctatcgtggtatgactatgcaaagagctgtccaacgtgattctaagggacgttctgactatgctatgtgcgctgtcaacccagttcgtgttggtagtacttttaatgaaagtgctcttcaatatcttgtcgctagtattaaaaaggttactaatggtttaattgaaattgtaaactataacgttgataactggcaatatgttgtttctggtgatcttatttccttacaagtacttactcttgtcttaaactacttaaagtttgaaaagattgatttaactgtattattaaagactctttctgaagaagaacttcaaaagcaagttaatgaaattattaacaatgcctatgtaaaggcaaaggatcaaaagaagaagcacggatttattaaattagaacgtggtgctgcttcaattccattacgtggtattgatgtaccattccactctagtttcttattaagaggtgttgctccattccgtcaatacttaatgagtaagtttgatccaaaattaattgatgttaaccgtttaattggtaattatattccaaacttaactgctgaaccattctctcttgaaaagaagtttattgaaaacatttatgcaaagactaactctactcgtattaagaatgttttaaagggatggactgatgataagtatgcttccccacttcttcaacaaaagttaggttacattcttttaattgaattattagcttaccaatttgcaagtgctgttcgttggattgaaactcaagatagattattcgttgatattggtgttgaacgtttaattgaaattggtccaggtccaactctttctggtatggctcaaaagacattaaagttcaagtatgaatattatgatgatgctactagttaccgtcgtgaaattctttcttactctaagaactataaggaaatcttctatgactttgaagatgaagatgaaccagaaaaggttgaagaagctccaaaatctgctccagctgctgccccagccccagccccagctccagttgccgctccagttccagttgctgccccagctgccccagctgctgctgtcgctgatgaagatattcaagttaaacatttaattcatattcttattgcccaaaagttaaagaaatctgtccaagaagttccaatgtctgccactattaaggatttagttggtggtaagtctactcttcaaaatgaagttttaggtgatttacaaaaggaatttggaagttctgcagttccagataagtctgaagaattaccattaagtgaattagccggtcaaattgcttctggtccaattccaatgggtaaatacagtcaaactttagttaataagcttattagttctaagatggctgctggtttcaccaagggtaagattaatgattatctttctcaaaagtatggtttaggtccaaagagaacagatgccttacttttattcggtttaactgatgaaccagcctctcgtttcggtagtgaagatgaagctaaggcctggttagataaaatagctccaaattacttcggttttgtaggtgtttctgcaggtgctgccccagctgcaggtgctgccgttagtgttccaatggctgccgttagctctggtgctcttgctgaagtttcttctaagtatgaacaacttattagagaacaacttgacattttcatgaactatcttgatattgatccacgtaagggatacaacctttatgaagaagagttaagtaatgctgctaaacttcgtgctgaacttgatgtttggatcaatgaacatggtgatgattatgctcaaggtattaagccaatctttgatccattaaaggttagaaaatatgattcctactggaactgggtctatcaagaatctttaattctttactatgatattttatatggtagattagctgctgtcgatagaaaggttactagccaatgtattcacgtcatgaacagagctgatcaacatcttcttgatctttatgattacaagattgatgctactgatccaaagaagggttcaacttatgaattagctaaagattttgctcaaattcttagagaaaattgttcagaagctataagtgaaaatccagtttacaaggatgttgaaattccaaagaaaccacaaactattgttactgaacaaggtgaaattaagtatagtgaagttccacgtccaggtgtaagcaagatggaatcttatattaaattaatgcaaggaggtagtagaattactagaatcccaactaagcattctaaccgttctattcgctttgctggtggtaacaataagactagagtaaagtcaaagaaggttccattccttttccttaaggatacaaagacaggtgaatacgatgaaaaggctactaaggtttattacaaatctctttacaatatggctaatgatggtatcacctttaagaacaaatatgttttagttactggttgtggtcgtaactctattggttctcaaattattaagggattattaaatggtggtgctaaaattattgctaccacttcaagattcagtaaggttactatgcaatattatcgtcaactttatgaagaccatggttctaagggttcatgcttaattgtagttccattcaatgctgcttctactgaagatgttaatagattaattgaatacatttactccaaggatccaaagaatggtttgggttgggatcttgattatgttattccatttgctgctatctctgaaaatggcagaaccttagaaaacattgatagtagaagtgaattagctcacagaattatgcttactaacttattaagaatgttaggtaagattgttagtgaaaaggaagctcacaagtatgacactcgtccagctcaatgtattttaccaatgtctccaaatcatggtacttttggtggtgatggtctttactctgaatccaagattgctcttgaaactctcttcaacagatggcattctgaaggatggggaggttaccttactatcgtcggtgctgtaattggttggactagaggtacaggtttaatgaacagcaataaccttgttgctgaaggtattgaaatgtttggtgttcacactttcagtactcatgaaatggcatttaaccttattggtttaatgcataatgatatttgtaaaatgtgtcttaagggtccagtctttgctgatcttaatggtggtcttcaattcattgatgatttaaatagcaatattactatgattcgtactctccttaatgaaacttcagaaattagacgttctattaaggctgaaaaggacttagaaaagagtattactcttggtaagcttatggctaaggaaaagaaattaatgttaaagccacgtgctaacttaaagtttactttcccaaaggttaaaccatttgatgaattaaagaagttagattaccttagcggtatgattgatttagatcgtactgttgttgtcactggttatggtgaagtaggtccatatggtaactctcgtactcgttgggaaatggaagcctatggtaaattctctcttgaaggatgcattgaaatggcttggattatgggtatgattaaatatgctaagaacaagaagactaaggatggtaaactctattccggatgggtagattctgaaactggtgaaccagttcaagactttgaagttaaggctaagtatgaagaaagaatcttaaagcacactggtattcgtttcattgaaccagaactcttcaatggttatgatccaaacaacaaggtcttctaccaagaagttgctattgatcatgacttaccaggatttgaatgcagtaaggaagaagctgaacaattcaagaagaagcatggtgatcgtgttgacatttatgaaaatgctgaatctggccaatggactgttaagattaagaagggttcttccatttacattccaaaggctcttcaattcgatagaactgttgctgctcaaattccaactggttggaagccagaaacttatggtgttccaaagagtattattgaccaagttgatccaataaccctttatgttattgtagctactgttgaagctttaattagttccggtattactgatccatatgaattctatgaatatgtacatgtctctgaagtcggaaactgttctggtggtggtgttggtggtatgacctctaatcataagcaatactttgatcgtgtatttgaaaaaccagttcaaagtgatattcttcaagaatgtttcattaacactatgccagcttggattaacttattattactttcttcttctggtccaattaagactccagttggtgcttgtgctactgctgtcgaatctgttgaaattggtttagaaaccattttaagtggtaaggctaaaattgttattgttggtggttatgatgacttccaagaagaaggttcatacgaattcgctcaaatgaaggctacaagtaattccttggaagaacttgctcatggtcgtgatccatcagaaatgtctcgtccagctactactacaagagctggtttcatggaagctcaaggtgctggtcatgaaattttaatgactgctagtcttgctattaagatgggtgttccaatctatggtattattgctcatacctctactgctactgataaggaaggacgttctgttccagctccaggtcaaggtattttaaccactgctcgtgaagttggaaatggtaagagtccattattaaatccaaagtatcgtgctcgtcaattaaatgctcgtaagagatggattaagtcatgggttgaagaagaattagaattaatgaatgaagaagttaaggatatggaaggcgaatctcaagaagttattgatgcctttattgaagaaagaactgctttcattgatgctgaagctcgtaagcaagaaaaggaagccttccaagtttggggacaagaattctacaagaatgatccaactatttctccattacgtggtgctttagctgcctttggtcttactgttgatgatattggtgttgcttccttccacggtactggtactaaggccaatgataagaatgaatctgatgtattcaacaagcaattcgaacatcttggtcgtactaagggtaacgcttgtccagtagtttgtcaaaagtatcttactggtcacggtaagggtgctgctgctgcttggatgttaaatggtgttatccaaattcttcaaactggtattgttccaggtaaccgtaatgctgataacattgatccacttcttgaaaagtatgaacatctttggttcaataacaagactttcaagactccaggtgttaaggctggtttattaaagtcattcggtttcggtcaagttggtggtgaaattttagttgtccacccagactgtctctttgctactcttgatgaaaatacttacaatgcttacaaggctaagcgtgatatccgtgaacacaaggcctttagaaagcttcacgataccttaactggtgaagactttgtccaagttaaggatgaaccaccatacactccagaacaagaaagtgctgtttacttaaacccattagctcgtgcttcttacaacaagaagactaagaagtgggattatgaacaaca

SEQ ID NO: 23142 - DNA, 100 bp, Neocallimastix californiae
  fCBD
aatatggcaacaatgtggtggtcaaaattataatggaccaacttgttgtgaagcaggtactacttgtgtaaaattaagtgattactactaccaatgtcaa

SEQ ID NO: 23143 - DNA, 99 bp, Neocallimastix californiae
  fCBD
tttatatgatcaatgtggtggtgaaggttacttcggtccaactaaatgctgtaagggaaaatgtatttctcaaggaccatactattcacaatgtgccga

SEQ ID NO: 23144 - DNA, 102 bp, Neocallimastix californiae
  fCBD
agcttatgctcaatgtggtggtttaggttatgaaggatcaacttgttgtcaagctggtaccatttgtactgttgttaatgaacactattctcactgtgaacc

SEQ ID NO: 23145 - DNA, 99 bp, Neocallimastix californiae
  fCBD
tttatacgatcaatgtggtggtgatggttacttcggtccaactgaatgttgtaagggaaaatgtatttctcaaggaccatactattctcaatgtgctga

SEQ ID NO: 23146 - DNA, 102 bp, Neocallimastix californiae
  fCBD
agcttatggtaaatgtggaggtaatgattggactggttcaacttgttgtatggttggtactagttgtcaaaaaattaatgaatgggtttcattatgtcaacc

SEQ ID NO: 23147 - DNA, 105 bp, Neocallimastix californiae
  fCBD
agatttcgatcaatgtggtggtgttggttacaatggtccaactaattgttgtaatccagattataaatgtaaggaatacggtacttactatttccaatgtgtacc

SEQ ID NO: 23148 - DNA, 102 bp, Neocallimastix californiae
  fCBD
agcttacgctcaatgtggtggtattggttatgaaggtccaaattgttgtcaagccggtactgtttgtacagaaattaatgagcattattcacattgtgaacc

SEQ ID NO: 23149 - DNA, 105 bp, Neocallimastix californiae
  fCBD
tccatttgaaccatgtggtggacttagatataagggtgctccaacttgctgtcaaactggatattattgttcaagaagaaataataattattatcaatgtgttcc

SEQ ID NO: 23150 - DNA, 99 bp, Neocallimastix californiae
  fCBD
agcctatggtagctgtaatggtaatggtttctctccaaacttaccaaaatgttgtgaagaaggatattactgtaatacccgaaggaatcaatgtcaacc

SEQ ID NO: 23151 - DNA, 105 bp, Neocallimastix californiae
  fCBD
gggttacatgccatgtggtggtagtaaattcccagatgctccaacatgttgtgaaaagtattactattgtgaaactgctgatccatcctatcatcagtgttatcc

SEQ ID NO: 23152 - DNA, 105 bp, Neocallimastix californiae
  fCBD
ggcttatgaaatgtgtggaggtacattgttcccaaatcaaccaacttgttgtgaacctggtaatacttgtgttattatgaatccaagatatcatgaatgtattcc

SEQ ID NO: 23153 - DNA, 102 bp, Neocallimastix californiae
  fCBD
tgtatggggtcaatgtggtggtgaaggatggaatggtccaacctgttgtaattcaggtagtgtttgtgttgtaacaaatcaatactatcatcaatgtaaacc

SEQ ID NO: 23154 - DNA, 105 bp, Neocallimastix californiae; identical to SEQ ID NO: 19888
  fCBD

SEQ ID NO: 23155 - DNA, 100 bp, Neocallimastix californiae; identical to SEQ ID NO: 19889
  fCBD

SEQ ID NO: 23156 - DNA, 100 bp, Neocallimastix californiae; identical to SEQ ID NO: 19890
  fCBD

SEQ ID NO: 23157 - DNA, 105 bp, Neocallimastix californiae
  fCBD
aggttatagtgtatgtggtggttctcttttcagagatgcttctccatgttgtgaacaaggtttcgcttgtaagattattagtgaatcctattatgtctgtttacc

SEQ ID NO: 23158 - DNA, 105 bp, Neocallimastix californiae
  fCBD
gggttacagaccatgtggaggttccgaatatccagatgcctctccatgttgtgaagaaggttttacttgtagagcctataatgatcttgtatcagtatgtgttcc

SEQ ID NO: 23159 - DNA, 105 bp, Neocallimastix californiae
  fCBD
agcttatcgtccatgtggtggttcttatttccaagatggtccaaattgttgtgaaccaggttttatttgtgttgatgcaaatcctcttttcaaacaatgtcttcc

SEQ ID NO: 23160 - DNA, 99 bp, Neocallimastix californiae
  fCBD
agcctatgaaatgtgtggtggatctttcaatccagtaagatgctgtgaaaaaggtaccgtttgtaccgttttcagtgaatatcatcatgaatgtattcc

SEQ ID NO: 23161 - DNA, 87 bp, Neocallimastix californiae
  fCBD
tggtggtttattatatccaaatgccccaggttgttgtgaaggttatgtttgttattcaatgaatgcttactataaagaatgtgtacc

SEQ ID NO: 23162 - DNA, 105 bp, Neocallimastix californiae
  fCBD
agcttatcaaccatgtggaggtaatgattatccaaatgctccaaattgttgtgaagctggatttgcttgcttaatgaaaaatccaaattaccatcaatgtattcc

SEQ ID NO: 23163 - DNA, 105 bp, Neocallimastix californiae; identical to SEQ ID NO: 19891
  fCBD

SEQ ID NO: 23164 - DNA, 105 bp, Neocallimastix californiae
  fCBD
ggctaaccaaccttgtggtggttcatattatccaaatgcaccaacttgttgtgaaccaggatatgaatgtactttcagaagtccattcttttctctttgtctttt

SEQ ID NO: 23165 - DNA, 105 bp, Neocallimastix californiae
  fCBD
aggcttttatccatgtggtggttcattattcccagatgcttctccatgttgtgaagaaggatttacttgccgatacaacaatgagtatgtttctgtttgtgttcc

SEQ ID NO: 23166 - DNA, 105 bp, Neocallimastix californiae
  fCBD
aggttatcatccatgtggcggtttgtactaccctgatgcttcgccatgctgtgaagaaggttttagatgtgaaagtaataatcaatatacttttgtctgcgttcc

SEQ ID NO: 23167 - DNA, 105 bp, Neocallimastix californiae
  fCBD
gggatattatccttgtggtggtttaagatatccagatgaatcaccatgctgtgaagaaggtttcagatgtcaataccaaaatccattctacttccaatgtgtatt

SEQ ID NO: 23168 - DNA, 105 bp, Neocallimastix californiae
  fCBD
aggctataatccatgtggaggtactaacttcccagatgcttcgccatgttgtgaacaaggtttcaagtgtgaattccataatgagaaattagctatttgtgttcc

SEQ ID NO: 23169 - DNA, 102 bp, Neocallimastix californiae
  fCBD
tcgctatgcccaatgtggtggtgtcaattatcatggttcaacaaagtgttgtggtaatttaacatgtgtatatcgtggtgaatattattctcaatgtgatca

SEQ ID NO: 23170 - DNA, 102 bp, Neocallimastix californiae
  fCBD
accatatggacaatgtggtggtataaattataatggtccaacatgttgtccaagcggttacacttgtaaatttattagtgattattattatcaatgtactaa

SEQ ID NO: 23171 - DNA, 99 bp, Neocallimastix californiae
  fCBD
agaatttgatcaatgtgatggtattaattataatggtccaaaatgttgttctgtaggtaaatgcgttagacttaatgattattattatcaatgtcaaaa

SEQ ID NO: 23172 - DNA, 105 bp, Neocallimastix californiae
  fCBD
ggcttttgaaatgtgtggtggtactttgttctcaaatgctcctaagtgttgtgaaccaggtaatacttgtgtgaagaggtatgatatttatcatcaatgtattcc

SEQ ID NO: 23173 - DNA, 105 bp, Neocallimastix californiae
  fCBD
tccatatgaaaaatgtggtggttatgaattcccaaatgcaccaagatgttgtcaagccggttactactgtgataaaacttatcataactatcatcaatgtcttcc

SEQ ID NO: 23174 - DNA, 105 bp, Neocallimastix californiae
  fCBD
agcttatggtatttgtggtggttatgacttcccagatgccccaacttgttgtgaagatggttattactgctcaaagaaatatccaaacttccaccaatgtcttcc

SEQ ID NO: 23175 - DNA, 105 bp, Neocallimastix californiae
  fCBD
accatatgaaaaatgtggtggttatgaattcccaaatgcaccaagttgttgtgtcaagaatttctattgtgataagacgcactctaattattatcaatgtcttcc

SEQ ID NO: 23176 - DNA, 105 bp, Neocallimastix californiae
  fCBD
accatatgaaccatgtggtggtacagaatttttagattatccaagttgctgtaaaccaggttactattgtttaaagagacatccaaaatattatcaatgtgtacc

SEQ ID NO: 23177 - DNA, 105 bp, Neocallimastix californiae
  fCBD
accatatgaaccatgcggtggtactgaatttttagattatccaagttgttgtaaaccaggttactactgtttaaagagacatccaaaatattatcaatgtgttcc

SEQ ID NO: 23178 - DNA, 102 bp, Neocallimastix californiae
  fCBD
agcatttgaaatgtgtggtggtgaattattccctaatgctccaagttgttgtgagccaggtaatacttgtgttaatcgttcaaccttctatcaatgtgttcc

SEQ ID NO: 23179 - DNA, 97 bp, Neocallimastix californiae
  fCBD
tcaatgggctcaatgtggtggtatcggttttaacggtccaacctgttgttcctctggaaaatgtgttaaactcaatgattggtattctcaatgtcaa

SEQ ID NO: 23180 - DNA, 100 bp, Neocallimastix californiae
  fCBD
acattgggatcaatgtggtggtgtaaatcaccggggtccattctgttgtgaatcaggtttaacttgtgtatttgtgaatgattattattctcaatgctta

SEQ ID NO: 23181 - DNA, 105 bp, Neocallimastix californiae
  fCBD
agcttttgaaatgtgtggtggtaccttattcccagaggcaccaaattgttgtgaacccggtaatatttgtgtcaaaaaatacgatacctatcatcaatgtcttcc

SEQ ID NO: 23182 - DNA, 108 bp, Neocallimastix californiae
  fCBD
gaagtactctccatgtggtggagagaacttccctgaaattaccactaactgttgtgaagagggctcctcctgtttagctcacaatcagtactattatcaatgcattcc

SEQ ID NO: 23183 - DNA, 105 bp, Neocallimastix californiae
  fCBD
agcttttgaaatgtgtggtggtaccttattcccaaatgccccaaattgttgtgaacccggtaatacttgtatcataaaatacgatacctatcatcaatgcgttcc

SEQ ID NO: 23184 - DNA, 105 bp, Neocallimastix californiae
  fCBD
tgcttacagcgtctgtggcggctacgattttccaaatgccccaacttgctgtcaaaaaggttactactgttcaaaggttcaaccaaacttccatcaatgtcttcc

SEQ ID NO: 23185 - DNA, 105 bp, Neocallimastix californiae
  fCBD
cgcttacgctatctgtggtggttataacttcccaaaggcacctcgatgctgtcaaccaggttattactgtgataaaagtcatcctaactattatcaatgtcttcc

SEQ ID NO: 23186 - DNA, 105 bp, Neocallimastix californiae
  fCBD
agcttatgccatatgtggtggtagtcaatatccaaacgtaccaaattgttgtatcgaaggctactactgtgataaatctcatgaaaactactaccaatgtcttcc

SEQ ID NO: 23187 - DNA, 105 bp, Neocallimastix californiae
  fCBD
atcatttgaaatgtgtggtggtaccttattccctaatgttccaaattgttgtgaaccaggtaatacttgtgtgattaaacatgatacttatcaccaatgtattcc

SEQ ID NO: 23188 - DNA, 105 bp, Neocallimastix californiae
  fCBD
agcctatggatgttgtggtggttccgataatccagatgctccaaattgttgtcagagtggttacacctgtgtcaaggatgacccaagattctggcaatgtattcc

SEQ ID NO: 23189 - DNA, 105 bp, Neocallimastix californiae
  fCBD
agtatatgaaatttgtggtggtaaaaactatccaaatgctccaaaatgttgtgaacctggttctaaatgtgttcacttcagtgaagatttctaccaatgtaatcc

SEQ ID NO: 23190 - DNA, 105 bp, Neocallimastix californiae
  fCBD
agcctatgaaccatgtggtggtcttgaacatccaaatgcaccaacttgttgtgaagcaggatttgcttgcttacaaaagaatccaaattatcatcaatgtattcc

SEQ ID NO: 23191 - DNA, 105 bp, Neocallimastix californiae
  fCBD
ggcctatgaaccatgtggtggtcttgaacatccaaatgcaccaacttgttgtgaggcaggatttgcttgcttacaaaagaatccaaattaccatcaatgtattcc

SEQ ID NO: 23192 - DNA, 105 bp, Neocallimastix californiae
  fCBD
accatatgaaccatgtggtggaagcagtttcttagattatccaagatgttgtccaccaggatactactgccttcaccgaaatgaaatttatcatcaatgtgttcc

SEQ ID NO: 23193 - DNA, 105 bp, Neocallimastix californiae
  fCBD
accatatgaaccatgtggtggtagtggattcttagattatccaagatgttgtccaccaggatactattgccttcaccgaaatgaaatttatcatcaatgtgttcc

SEQ ID NO: 23194 - DNA, 105 bp, Neocallimastix californiae
  fCBD
accatatgaaccatgtggtggtagtggattcttagaatatccaagatgttgtccaccaggatactactgccttcaccgaaatgaaatttatcatcaatgtgttcc

SEQ ID NO: 23195 - DNA, 99 bp, Neocallimastix californiae
  fCBD
ggccttcggtagatgtaacggtaatggatccctacctaatgtaccaagatgttgtgaagacggctactactgtaacagctactggaatcaatgtcaacc

SEQ ID NO: 23196 - DNA, 102 bp, Neocallimastix californiae
  fCBD
agcatttgaaatgtgtggtggtcaattattccctaaggcaccaaactgttgtgaatctggttatacctgtgtcgatcgtggaacgtatcatcaatgtcttcc

SEQ ID NO: 23197 - DNA, 105 bp, Neocallimastix californiae
  fCBD
accgtatgaaccgtgcggtggaagtagtttcttagattatccaaattgttgtccaccaggatattactgcctacaccgaaatgaaatttaccatcaatgtgttcc

SEQ ID NO: 23198 - DNA, 88 bp, Neocallimastix californiae
  fCBD
tgcttttggacaatgtggcggtaccgactaccgtggttcaaccaagtgttgtgaaaatttaagatgtgtttatttaaatgattactat

SEQ ID NO: 23199 - DNA, 105 bp, Neocallimastix californiae
  fCBD
atcgtatgaagcctgtggtggatcaagatatccaaatgtaccgaaatgttgtactccaggtaatgtatgtgtgaagaataataatgtatttcaccaatgtatgcc

SEQ ID NO: 23200 - DNA, 105 bp, Neocallimastix californiae
  fCBD
agaatttaatgtatgtggtggtattagtaatccttatgcaccaaaatgttgtaaatctggttacatttgtgtttcctttaacaaatatttctcaatttgtatgcc

SEQ ID NO: 23201 - DNA, 105 bp, Neocallimastix californiae; identical to SEQ ID NO: 19898
  fCBD

SEQ ID NO: 23202 - DNA, 105 bp, Neocallimastix californiae
  fCBD
tccttatgaaccatgtggtggaattagtttcttagattctccatcatgttgtccacagggatattattgtttaaaaagaaatgaaaattaccatcaatgtgttcc

SEQ ID NO: 23203 - DNA, 102 bp, Neocallimastix californiae
  fCBD
atcatttgaaatgtgtggtggtatattattccctaatgtaccaaattgttgtgaaccaggaaatacttgtattgaacgtgaaacctacaatcaatgtattcc

SEQ ID NO: 23204 - DNA, 105 bp, Neocallimastix californiae
  fCBD
agcctttgaaatgtgtggtggtaccttattccctaatgctccaaactgttgtgaagaaggcagtacctgtaataagaagtatccatactatcatcaatgtcttcc

SEQ ID NO: 23205 - DNA, 105 bp, Neocallimastix californiae
  fCBD
ggctaatgaaccatgtggtggttcctattataaagatgctccaaattgttgtgaaccaggatatgcttgtgtttacagaagttcattttattccgtctgtcaacc

SEQ ID NO: 23206 - DNA, 105 bp, Neocallimastix californiae
  fCBD
atcttatgaaatgtgtggtggaacaaattatccagatgctccaaattgttgtgaaccaggtaatttctgttggaaaaaatattccaacctttatcaatgtcttcc

SEQ ID NO: 23207 - DNA, 105 bp, Neocallimastix californiae
  fCBD
ggcatttgaaatgtgtggtggtaccttgttcccaaatgctgccaactgttgtgaacctggtaatacttgtgttaagaagtatgatatctattatcaatgtattcc

SEQ ID NO: 23208 - DNA, 105 bp, Neocallimastix californiae
  fCBD
agcttatgaaatatgtggtggttatgaatatccaaatgcaccaaattgttgtatcaagaattactattgtgataagacttatgataattattatcaatgccttcc

SEQ ID NO: 23209 - DNA, 102 bp, Anaeromyces robustus
  fCBD
agcttatgcccaatgtggtggtaaagaatacacaggtccaaactgttgtcaagctggtactatttgtactgaaattaatgaacactactctcactgtgaacc

SEQ ID NO: 23210 - DNA, 99 bp, Anaeromyces robustus
  fCBD
tttatatgatcaatgtggtggtgaaggttacttcggtccaactgaatgttgtaagggaaaatgtactagccaaggaccatactattctcaatgtgcaga

SEQ ID NO: 23211 - DNA, 105 bp, Anaeromyces robustus
  fCBD
aggttattatccatgtggaggaagtaataatccagatgccaaaggatgttgtgaaccaggtttttattgttatcaacatgatcaatattatcatcaatgtattcc

SEQ ID NO: 23212 - DNA, 105 bp, Anaeromyces robustus
  fCBD
atcttattctatgtgtggtggtaatttatatccagatgctccagattgttgtgaagaaggtaatttctgttggaaaactcatccagattattatcaatgtattcc

SEQ ID NO: 23213 - DNA, 105 bp, Anaeromyces robustus
  fCBD
ggcttataatgcatgtggtggtttagctaatccagatgctcatgcttgttgtgaaaaaggttatagatgtgaatatataaatgattacttctatatgtgttcacc

SEQ ID NO: 23214 - DNA, 105 bp, Anaeromyces robustus
  fCBD
accattctatccatgtggtggtctttcatacccagatgcttcaccatgttgtcaatctggttataagtgtgaatatcatagtgatgaattatccgtttgtatccc

SEQ ID NO: 23215 - DNA, 81 bp, Anaeromyces robustus
  fCBD
agactacccagatgctccaacttgttgtgttgatggttatgtatgtggtgaacttaaacaaggttttgtacaatgtattcc

SEQ ID NO: 23216 - DNA, 105 bp, Anaeromyces robustus
  fCBD
aaaattaaagatttgtggtggtaaaagttatccagatgcatctccatgttgtgaagaaggttacagatgtgaagctgttaacgaatatatttacatgtgtaaaga

SEQ ID NO: 23217 - DNA, 102 bp, Anaeromyces robustus; identical to SEQ ID NO: 19901
  fCBD

SEQ ID NO: 23218 - DNA, 102 bp, Anaeromyces robustus
  fCBD
agtttgggatcaatgtggtggtgctacttattatggtccaacttgctgtgaaagcaatagtagatgtatcgtacataatgaatattattcacaatgtgaacc

SEQ ID NO: 23219 - DNA, 105 bp, Anaeromyces robustus
  fCBD
accatatatggtttgtggtggttcaagtttccctgatgcttcaccatgttgtgaagaaggctatgtatgtgaattccaaaatgaatatgtttacatgtgtgctcc

SEQ ID NO: 23220 - DNA, 105 bp, Anaeromyces robustus
  fCBD
aggatataatccatgtggtggtataaattatccagatgcttcaccatgttgtgaagaaggttacagatgtgaagtttataatgaacttatgtatatctgttttcc

SEQ ID NO: 23221 - DNA, 105 bp, Anaeromyces robustus
  fCBD
agcttttcaaccatgtggtggaccaaaagcagaaaatgcttcatcctgttgtgaagaaggttacaaatgttcttattataatggttacatatcactttgtattcc

SEQ ID NO: 23222 - DNA, 105 bp, Anaeromyces robustus
  fCBD
accttatatgccttgtggtggaacagaacatcaagatgctccaaattgttgtgttccaaattatatttgttctacttcaaattcaaaatatcatcaatgtattcc

SEQ ID NO: 23223 - DNA, 105 bp, Anaeromyces robustus
  fCBD
agtttataatgtttgtggtggtaccaattatccaaatgctccaaaatgttgtgaatctggttctacctgtgtagctttcagttctatgcatcatgaatgtattcc

SEQ ID NO: 23224 - DNA, 105 bp, Anaeromyces robustus
  fCBD
accctatcaaccatgtggtggtatatactatcaaaattcaccaaaatgttgtaaatctggttctacctgtgtcaaaaatgatccaaacttctatcaatgtattcc

SEQ ID NO: 23225 - DNA, 105 bp, Anaeromyces robustus
  fCBD
tgattataatccatgtggtggtaaagcttatccagatgcttcaccatgttgtgctgaaggttctgtatgcgtttatcataatgaatctctttctctttgtattcc

SEQ ID NO: 23226 - DNA, 102 bp, Anaeromyces robustus
  fCBD
aaattggaaccaatgtggtggtaaagaatatactggaccaacatgttgtaatgaaaattatcattgtatttatgttaatgagtattactctcaatgtaaaac

SEQ ID NO: 23227 - DNA, 105 bp, Anaeromyces robustus
  fCBD
tgcttatcaaccatgtggtggtaaacaatatccagatgcttcttcatgttgtgttgaaggttatatatgtagtcgtcatagtagtgatatatctatttgtattcc

SEQ ID NO: 23228 - DNA, 105 bp, Anaeromyces robustus
  fCBD
aggttatcaaccatgtggtggtagaaaatatagagatgcttcaccatgttgtgttgaaggttatgtatgtagttttcatagtaatgatatatctatctgtgttcc

SEQ ID NO: 23229 - DNA, 102 bp, Anaeromyces robustus; identical to SEQ ID NO: 19904
  fCBD

SEQ ID NO: 23230 - DNA, 105 bp, Anaeromyces robustus
  fCBD
atcatatggtatttgtggtggtactgcttatcctgatgctccaacttgttgtgaagaaggtaatttctgttggaaaagatatgataatcttcatcaatgtattcc

SEQ ID NO: 23231 - DNA, 105 bp, Anaeromyces robustus
  fCBD
agcttatgatgcttgtggtggttcaaattatccaaattctccaagatgttgtattgaaggattaacttgtgtttatgaatctgaagctgcctcttattgtgttcc

SEQ ID NO: 23232 - DNA, 99 bp, Anaeromyces robustus
  fCBD
agcttatgaaatgtgtggtggttatggatatgaaactaaatgttgtgaatctggtactatatgtaaagtatttagtgaatatcatcatcaatgtattcc

SEQ ID NO: 23233 - DNA, 105 bp, Anaeromyces robustus
  fCBD
agcttatcaaccatgtggtggtcttgaatatccagatgctccaaattgttgtgaagcaggttttgcttgtttaagaaagaatccaaattatcatcaatgcattcc

SEQ ID NO: 23234 - DNA, 105 bp, Anaeromyces robustus
  fCBD
agcttattatccatgtggtggttcttattatccagatttaccaaattgttgtgaaccaggatttgtttgtgttgaaacaacttctgttattaaacaatgtcttcc

SEQ ID NO: 23235 - DNA, 105 bp, Anaeromyces robustus
  fCBD
accatggggtgtatgtggaggatatgatttcccagatgctccaaattgttgtacaccaggttttgcatgtgacaaaacttatccaagttactaccaatgtaaacc

SEQ ID NO: 23236 - DNA, 105 bp, Anaeromyces robustus
  fCBD
aggatattacccatgtggtggtaaccgtttcccagatgcaccaagttgttgtgaagcaggtttttattgtaagaaaaataatattgattattatcaatgtactcc

SEQ ID NO: 23237 - DNA, 105 bp, Anaeromyces robustus
  fCBD
agctttccaaccatgtggaggtaatgattataaaaatgcttctccatgttgtgtagaaggttatgtttgtgatgttattaatacaagaatttctatttgtgtacc

SEQ ID NO: 23238 - DNA, 102 bp, Anaeromyces robustus
  fCBD
aggatatggtcaatgtggtggtattaattatacaggtccaacatgttgtccatctggatattcatgtaaaaaacataatgattattattcacaatgtgaacc

SEQ ID NO: 23239 - DNA, 105 bp, Anaeromyces robustus
  fCBD
agattatgaaaaatgtggtggtataggttataatggaccaacatgttgtgaaaaccctaactttaaatgtgaagtcattaacgaatatttccatcaatgtacacc

SEQ ID NO: 23240 - DNA, 102 bp, Anaeromyces robustus; identical to SEQ ID NO: 19907
  fCBD

SEQ ID NO: 23241 - DNA, 105 bp, Anaeromyces robustus
  fCBD
aggttatcaaccatgtggtggtagaaaacataaagatgcttcaccatgttgtgttgaaggttatgtatgtacttatcataataaagatttatctgtttgtgttaa

SEQ ID NO: 23242 - DNA, 105 bp, Anaeromyces robustus
  fCBD
aggattcttaccatgtggtggtagtttaatgccagatgccccaaattgttgtgaaccaggtttttattgtagaattgaaaatgaatatttccatcaatgtgtacc

SEQ ID NO: 23243 - DNA, 105 bp, Anaeromyces robustus
  fCBD
agcctatatgccatgtggtggtacaaattatccagatgccccaagttgttgtgttaaaaattattcatgtaaaaaatatacaccagaacatttccaatgtattcc

SEQ ID NO: 23244 - DNA, 105 bp, Anaeromyces robustus
  fCBD
aggttttagtccatgtggtggtaaaaagtatccagatgcttctccttgttgtgaagaaggttttaaatgtgaatatcataataaaaatttatttgtttgtgtacc

SEQ ID NO: 23245 - DNA, 105 bp, Anaeromyces robustus
  fCBD
aggatttttcccatgtggtggattaagacatcctgatgcatctccatgttgtgaagaaggtttcagatgtgaatatcaaaatgaaaactattacatgtgtgttta

SEQ ID NO: 23246 - DNA, 114 bp, Anaeromyces robustus; identical to SEQ ID NO: 19908
  fCBD

SEQ ID NO: 23247 - DNA, 99 bp, Anaeromyces robustus
  fCBD
tttttatcaaaaatgtggtgccgatgatgaacctaaaagatgttgtgtaccaggttctaaatgtgtaagattaactcaattccattatcaatgtatgcc

SEQ ID NO: 23248 - DNA, 102 bp, Anaeromyces robustus
  fCBD
ggaatttgaaatgtgtggtggttcattatatcctgattcaccagaatgttgtgaaggtacattttgtttaaaaagtaattctaaatatcatcaatgtattcc

SEQ ID NO: 23249 - DNA, 105 bp, Anaeromyces robustus; identical to SEQ ID NO: 19909
  fCBD

SEQ ID NO: 23250 - DNA, 105 bp, Anaeromyces robustus
  fCBD
tgcttatcaatcctgtggtggtttatttaatcctaatgccccaaattgttgtaaagaaggatttacatgtgttaaaaaggatcccaacttttatcaatgtattcc

SEQ ID NO: 23251 - DNA, 105 bp, Anaeromyces robustus
  fCBD
tgcctttgaaatatgtggtggaactgattatccaaatgctccaaactgttgtatcactggttatatatgtaataaaattcatgtaaattattatctttgtttacc

SEQ ID NO: 23252 - DNA, 105 bp, Anaeromyces robustus
  fCBD
tgcctttgaaatatgtggtggaaaggatcatccagatgctccaaattgttgtatctctggttatgcttgtgataaaactttcaaaagacattatatatgtattcc

SEQ ID NO: 23253 - DNA, 105 bp, Anaeromyces robustus
  fCBD
tgcttataatgcttgtggtggaaccgattatccagatgctccaaattgttgtgttccaaattatgtttgtataaaaacttcttccaaatatcatcaatgtcttcc

SEQ ID NO: 23254 - DNA, 105 bp, Anaeromyces robustus
  fCBD
tgcctttgaaatatgtggtggaaaggatcatccagatgctccaaattgttgtatctctggttatgtctgtgataaaactttcaaaagacattatatatgtattcc

SEQ ID NO: 23255 - DNA, 102 bp, Anaeromyces robustus
  fCBD
gaaatttgatatgtgtgctccacaacttccaaatgcaccagattgttgtgaaccaggttttacttgtactaatgaattaactaatttttatcaatgtattcc

SEQ ID NO: 23256 - DNA, 105 bp, Anaeromyces robustus
  fCBD
agtttatgatatttgtggtggtactaattatcctaatgctccaaaatgttgtgaatctggttctacttgtgtagcctttagtgaaattcatcatcaatgtattcc

SEQ ID NO: 23257 - DNA, 99 bp, Anaeromyces robustus
  fCBD
agcttatgaaatgtgtggtggtatgaatactgaaaagaaatgttgtgaacaaggtagtagatgcgtagaatttaatgaattctatcatcaatgtattcc

SEQ ID NO: 23258 - DNA, 105 bp, Anaeromyces robustus
  fCBD
accatatcaaccatgtggtggtcttggttatccagatgctccaaattgttgtgaacaaggttatgtatgtcaacataatgatttatactatcatcaatgtattcc

SEQ ID NO: 23259 - DNA, 105 bp, Anaeromyces robustus
  fCBD
actttatgatatttgtggtggtaaacttttcccagatgcaccaacttgttgtgaacaaggttctaaatgtattatttatgatgaaagtataagtagatgtcttcc

SEQ ID NO: 23260 - DNA, 102 bp, Anaeromyces robustus
  fCBD
ggaatatgaaatgtgtggtggtactttatatccagatgctccaagttgttgtgaaggtaccttctgttggactaaatataaagaatatcatcaatgtatgcc

SEQ ID NO: 23261 - DNA, 91 bp, Anaeromyces robustus; identical to SEQ ID NO: 19910
  fCBD

SEQ ID NO: 23262 - DNA, 100 bp, Anaeromyces robustus; identical to SEQ ID NO: 19911
  fCBD

SEQ ID NO: 23263 - DNA, 100 bp, Piromyces finnis
  fCBD
gaaatggcaacaatgtggtggtattggctacagtggtccaacacaatgtgaatcaggtagtgaatgtgttgctaccaatgaattttattcccaatgtcta

SEQ ID NO: 23264 - DNA, 102 bp, Piromyces finnis
  fCBD
agcttatgctcaatgtggtggtcttggttatgaaggttcaacctgttgtcaagctggtactatctgtactgtagttaatgaacattactctcattgtgcacc

SEQ ID NO: 23265 - DNA, 102 bp, Piromyces finnis
  fCBD
agcctatggtaagtgtggtggtaaggattggactggttctacctgttgtatggttggtactagttgtaaggaagttaacgaatgggtttccttatgtgaacc

SEQ ID NO: 23266 - DNA, 99 bp, Piromyces finnis
  fCBD
tttatatgatcaatgtggtggtgatggctactttggtccaactgaatgttgtaagggaaaatgtatttctcaaggaccatactattcccaatgtgctga

SEQ ID NO: 23267 - DNA, 102 bp, Piromyces finnis; identical to SEQ ID NO: 23265
  fCBD

SEQ ID NO: 23268 - DNA, 306 bp, Neocallimastix californiae
  fn3_3
acgtggaaaagtcactggtaaattaactattaagaatcagttagataattctgttttcaagttagatgatgccgtcgtaactttagttcaaccggaatctaacagtgaatccattccaaatcaacaatggcgtcattactccttctggactcatagtatttctggtgtcagtccaaacttcactattaataatgttattccaggtacctatcaattacgtgcttggtctaagggtgttgttggtgaatttatcttaaacaaaactattactgtaactgctggtcaaaccactaatcttggtgaaat

SEQ ID NO: 23269 - DNA, 294 bp, Anaeromyces robustus
  fn3_3
acgtggttccgtatctggtaaattagttattaaagatccattatatggtagtcttaaaatttctgatgcaacagttactttagttcaaccagaaagtagtacagaaccaattcatccacaacaatggcataaaatgtctcactgggttactcatgtcactggtgatttcaaaattgaaaatgtagtaccaggtacttatcaacttagagcttggtctaaaggtattgttggagaattttatactactaataccatcacagtaactagtggacaagaaacaaaacttggtgaagt

SEQ ID NO: 23270 - DNA, 294 bp, Piromyces finnis
  fn3_3
gcgtggttcagtttctggtaaattagttatcaatgatccattatatggtaatcttaaattaagtgatgcaactgttactttagttcaaccagaaagtagcaatgaaccaattcacccacaacaatggcacaagatgtctcattgggttactcatattactggcgatttcaagattgaaaatgttgttccaggtacttatgaattaagagcttggtgtaagggtattgttggtgaattctacaccaccaatacaattactgttactagtggtcaagaaaccagacttggtgatgt

SEQ ID NO: 23271 - DNA, 306 bp, Piromyces finnis
  fn3_3
acgtggaaaggttacaggtactttagctattaataatccattaactaatactcgtttaccacttgaagatgctgttgttactttagttcaaccacaatcagcaaccgaaccaattccaaaccaacaatggcgtcatatgtcattctggactcacagtttatctggtgctacaccaaactttgtaatttacaacgttattccaggtacatatgaattacatgcttgggcaaagggtgttgttggtgaatttgttttagataagttagttaccgttaaagctggtgaagttgttaatcttggaaagtt

SEQ ID NO: 23272 - DNA, 273 bp, Neocallimastix californiae
  Fn3_assoc
atcttcaggtactatttattacactcttgatagttctgatccaactacatctaacactgctaagatctataatggtgaaattagaatgtatgatagatctattgaagaaaatgtatatggtaaacatcaacatgaagacaatagcccatattctactaccttacaaacaaattacaaggccaccaatgttaaatacgataaacttactattgttcgtgctgctaccaagttacaagatggttccttcagtcctgtcgtcactaaggcttattt

SEQ ID NO: 23273 - DNA, 222 bp, Neocallimastix californiae
  Fn3-like
acaagcttatcttactatgccttctccaaaggatgatccacgtattggtgaatacccagaattccaattaaagggatttgaaaagtatttcttaaaggctggtgaaaagagaaaagtaaaccttcttgttccatacgccgaaaccaaatactttaacactactactaacacttgggaaactactattgatggtaaatacaaggtttccattggtctttctca

SEQ ID NO: 23274 - DNA, 219 bp, Neocallimastix californiae
  Fn3-like
tccaatgcttttccttggttacccagaagtttctgaacttaagaattacccaattcgtggtttaaaggcattcgataagattaacttaaaggctggtgaaaagaaaactgttactcttactgttgatcaacatggattatcatactacaacacttctcagggtaagtttgttgttccaagcggtggtgaatacactgtctatgttggtaagagtgctgg

SEQ ID NO: 23275 - DNA, 222 bp, Neocallimastix californiae
  Fn3-like
acaagcctatcttacaatgccatctgcaaaggatgatccacgtattggtgaatacccagaattccagtttaagggatttgataagattttcttaaaggctggtgaaaagaaaaagattaatcttcttgttccatatgctgaaactaaatatttcaatactactaccaacacttgggaaactactatcgatggtaaatacaaggtttctattggtttatcaca

SEQ ID NO: 23276 - DNA, 225 bp, Neocallimastix californiae
  Fn3-like
tttacaagcttatcttaccatgccatctgctgaagatgatccacgtattggtgaatatccagaatatatgcttaaggcttttgaaaaggtattcttaaaggctcatgaaaagaaacaagttaaccttcttgttccatatgctgaaaccaaatatttcaatactactactaatacttggcaagaaactatagatggtaaatacaaggtttctattggtctttctca

SEQ ID NO: 23277 - DNA, 219 bp, Neocallimastix californiae
  Fn3-like
tccaatgcttttccttggttttccaaatgtttctgaaatgggtgattatccagtacgtaatttaaaggctttcgataagattaacttaaaggctggtgaaagtaaaactgttactcttgaagttgatcaacatggtttatcctactacaacactaataaaaagaagtttgttgttccaactggtggtgaatacactgtatatgttggtaaaagtgctgg

SEQ ID NO: 23278 - DNA, 225 bp, Anaeromyces robustus; identical to SEQ ID NO: 23276
  Fn3-like

SEQ ID NO: 23279 - DNA, 219 bp, Anaeromyces robustus; identical to SEQ ID NO: 23277
  Fn3-like

SEQ ID NO: 23280 - DNA, 216 bp, Piromyces finnis
  Fn3-like
ttatcttaccatgccaactgttgaagctgatccacgtattggtgtttacccagaacttaacttcaagaacttcaccaagatttatcttgaagctggtgaaaagagaaaggttaaccttcttgtagcctatgctgatactcaatacttcaacactaccaagaatgaatggcaaacaactattgatggtacatacaaggttcatgttggtttctcaca

SEQ ID NO: 23281 - DNA, 216 bp, Piromyces finnis; identical to SEQ ID NO: 23280
  Fn3-like

SEQ ID NO: 23282 - DNA, 864 bp, Neocallimastix californiae
  Galactose mutarotase-like
tagtatcactattgataataattctagttcttattctatttctggaaagaatttcaatttcattattgataaatctactggtactcttaaaaactataaatataagggagaaacactcattaatgaaggtcctactcctaatttcttccgtggttatgttgaaaacgattataatggaagtaactgggcaaaaacatttgatcctaactggcgtaatgctatgaatggtgctcgtgtcaacagtattgatgttaaaaatggtgttggtagtgaaaagatcattgtttctcatctttcacttcctaaagccggtaatactaaagtagatataacatatactattcaaagtaatggtagtattgatgttgaattaaatgttgatggtacaagagctggtcttggaaactaccttcgtgtcggttctataatgatattgccaaagggtgctgaaaagcttagctggtacggaaatggtccagttgaaacctttaatgatcgtaagaccaatggtagaaagggtgtatgggaaaacactgtatcaggtatgttttatcctttcatgaaagcagatgactgtggtaatcttactgacataaaatggattgctgtacaaaataatggaaaaggtgctagtcttcttattgcagctgacggaactgtagaagctagtgcacttcacttcacacctgaagatcttatgcgtgctgatcatcctttcaagcttaagccacgtaaggaaactattcttagtgttgattatggatcaatgggtactggtagtgccacttgtggacaagctacattggataaatacagactcccatctggaaagcaatatagatggaaattcacaatcttcccaat

SEQ ID NO: 23283 - DNA, 792 bp, Neocallimastix californiae
  Galactose mutarotase-like
tttgacacaaaacaataactcatatattttaaaaaataactatgctaccgtggttatttctaaaaaagatggttatattacttcattaaagattgctggtgacaatcaagaatttttaaatagagcttatattgatgctaatggttcaaaagctggctttcatgcaaaaaaaagtacaattattaagaataccaatgatcatgttgaaattgcattcactgataatgtattaaatatggattgggaagttagatatactatgcttaatgatactaagggtgtttacttctcattaaaacttgaccataaagcaagctatgctgatacacaattcagtgaaatacgtttagtttttagattaaagagtaatccattcaattggttacaaattgaagataatgttggtcgttacttaccaactgctgaagaacaaaagaattgtgaagtaatgggtccaaaggaagcttgtaaggttaaaactggtgaagttcttcacaagtacgattggtctattgatgctttaaaacatgatgttcatggtttctctactaaaaatggtttaggttgttggtttgtccttccatctatggaatggaagaatggtggtgcctacaatcgtgatcttgcctgtcacaatggtgaaaatgattccatacaaattatgtacatggctggttctcactatggtgctggtgatgaatacccaaagaagggtgaaaattggtcaaaggtttacggtccatatttaatttatgtaaataaagctggttctccacaagcctcatggaaaga

SEQ ID NO: 23284 - DNA, 870 bp, Neocallimastix californiae
  Galactose mutarotase-like
tgatgctgttaatgtttctgaaacttccaatggttttagtgttagtggtaagaacttccaattcactgttgacaaatccactggtactattaaatcttacacttacaatggtgctactcttattactgaaggtccaactccaaacttctggcgtggttatgttgaaaatgataacaacggtggtggttgggtaaaggctttcgatcctagctggcgtagtgctatggaaggtgctcgttgtgatggtgttagtactaagaatggatctgatggtgacaaaattataacctcacgtcttactcttccaaaggctggtagtactaaggttgatataacttatactattcatggtgatggtagtgttgatgttgaattcaatgttgatgcttccagagctggtcttggtaacttccttcgtgttggttccattatgaaattaccaactggtgctgaaaaactttcttggtatggtaatggtccagttgaaactttcaatgatcgtaaaactaatggtagaatgggagtatgggaaagtacagttacagatatgttcttcccttacatgaaggctgatgatactggtaatcttactgatcttaaatggatttctgttcaaaatgaaaagaagagtgctagtatccttattgccgctgaaggtaaggtagaaggtagtgctcttcatttcactccagaagatcttatgcgtgctgatcatccattcaaacttagtccacgtaaggaaacctatcttagtgttgattatggatctatgggtactggtagtgccacttgtggtcaaggtactcttgataaatatcgtcttccatctaacagacaatacaattggaaattcactattattccaatttc

SEQ ID NO: 23285 - DNA, 807 bp, Anaeromyces robustus
  Galactose mutarotase-like
aaatttaactgaaaacaatacttcctatatattatcaaatggattagcaacttttacaattgctaaaagttctggttttattacttctatgaagtataaaaacaattctcaagaattcttaaacagatcttatattgatgctaatggaggaaaagtttatttctctgttactagttcttcagtagttataagaactgatgatttagttgaaattgtattttatgatgactattccaagcatgtaggcactggttttgctattgattgggaagtcagatatactatgagatctggtgtttccggtctttatttctctttaacacaagctcataaatctaattacgaagaagctcaatgttctgaattaagacttgttatgcgtttaaagagtgatgttttcaattggttacaagttgatgatttcactaagagagttatgccaactgctgctcaacaaaacaaatgtactactctttctccacaagaagcttgtcaattagaaacaggagaagttattcataaatatgattggtctattgatgttcttgaacataaggttcatggttttgccagtatcagtaaaaatcttggttcttggtttgttatgccaagtatggaatggaaaaatggtggtgccgttaacagagatcttgcttgtcaccaaggtggtgctgattctcttcaaattttataccttagaggttctcattatggtgctggtgatgctatattaaagagaggtgaagtttggtctaaaatgcatggtccaattcttatttacttaaatgaaggttctgatgttaatgc

SEQ ID NO: 23286 - DNA, 873 bp, Piromyces finnis
  Galactose mutarotase-like
tgattccattagtgttactgaaaatcaaaattcatacattttatcaggcaagaattttgaattcctcatcaataaatcatcaggtcttctcagtacctataaatacagaggtgaaaccatcatcactgaaggtccaactcctaacttctggcgtggttatgttgagaatgataataatggtgctggttgggcaaaaacttttgattccaactggcgtaatgctatgaatggtgctcgttgtgataaaatcgaggttaacaatggaagtgatagtagtgaaaaaatcattgtttcacatcttacccttcctaaagttggaagtacaaaggtagacataacctacaccgttcattgtgacggaagtgttgatgttgaattcaatgttgatgctactagatcagatcttggaaacttccttcgtgttggttcaatgatgaaattaccagaaggctttgaaaagcttagttggtatggtaatggtcctgttgaaactttcaatgatcgtaaaacaaatggtagaatgggagtatgggaaagtaccgtaacagatatgttctatccttatatgaaggcagacgattgtggaaatcttacagaccttaagtggatttcagttcaaagtaaaaagagaagtgcaagtatacttgttgtcgctgaaggagcagtagaaggaagtgctcttcattttgctccagaagatcttatgcgtgcagatcatccatataaacttagaccacttaagacgactattctcagtgttgattatggatctatgggtactggaagtgctacttgtggacaagctacacttgataagtatcgtcttccttccgatagaccatataattggaaattcactattatccctgtttc

SEQ ID NO: 23287 - DNA, 840 bp, Piromyces finnis
  Galactose mutarotase-like
tactttaactgaaaataatacttcatacattttatccaatggattagcaacatttacaattgctaaaagttcaggttttattacttcaatgaagtataaaaacaactcacaagaatttttaaatagatcttacattgatgctaacggaggaaaagtttatttttctgtaacaagttcatatgtagccactaaaaatagtgatttagttgaaattgtttttgttgatgattattccaaacatgttggtactggatttgctattgattgggaagttagatatactatgaaatcaaatgtttctggtatctatttctctttaactcaatcacacaaatctaattatgaagaagcacaatgttctgaattaagactagttatgcgtttaaagagtgacgtatttaattggttacaagttgatgactttaataaaagagttatgccaactgcttctgaacaatcaaaatgtgttactctttcaccaagtgaggcgtgtagattagaatcaggagaagtaattcataaatatgattggtctgttgatgctcttgaacacaaggtccatggttttggtagtattagtaagaatctcggttcatggtatgttattccaagtatggaatggaaaaatggtggtgctgttaatagagatcttgcgtgccatcaaggtggttctgattcacttcaaattttatactttagaggttctcactatggtgcaggtgatgcagttcttaagaaaggagaagtttggtccaaaatgcatggtccaattcttatttacttaaatgaaggatctgatgttaatgctctatgggctgatgctaatcgtcaagcagatta

SEQ ID NO: 23288 - DNA, 810 bp, Piromyces finnis
  Galactose mutarotase-like
tcttactgataatggaagttcatacatattaagaaatgattatgccattgttacaattgcaaagaattccggttatattacttccttaaaattaaatggaaataatcaagaatttttaaatagatcttatattgatgctaacggtggaaaagtttatttttcaccacaaagtagcaaagtaataaaaaatacatcctcacatgtagaagttgctttctatgataattataattctaattcaaaattaggacttgattgggaagttagatacactatgctctctgatacaagaggtgtttactattcattaactaatactcacaaaacaaattacccagaaacatcatatagtgaaattcgtttagtactcagattaaaggcagatattttcaatcacttacaagttgaagatgatgtataccgtgatatgccaagcgctgctgatcaaaacaaatgtgttgaaatgggaccaaaagaagcttgccaattaccaaacggagaagttattcacaaatatgattggtctgttgatatgttaaaacatcatattcatggtttctccagtaaatcaactggtttaggttgttggtttgttattccatcattagaatggaagaatggtggtgcatacaaccgtgatctttcttgtcaccaaggtggtagtgattcattacaaattatgtacatgaatggttcccactatggtggtggtgatgctaccattaaaagtggtgaatatttccaaaaggtttatggtccattcttaatttacttaaataaggctagttcagttgaagcttcttggaacga

SEQ ID NO: 23289 - DNA, 333 bp, Neocallimastix californiae
  Galactose-bd-like
ctacgctgctagtatggcttggcaaagtggtattagtgttaagggacaaggtgctgttactcaagttaattatggacgtggttcctggactggtgtttctaatgttgctttaggtaatgctaagaccattactcttagagcctcttcctctagtggtgctactgttaagatttgtgccggtagtgaaaatggtacagttcttggttatgttgatattccagctggtggttccttacaaaatgttactggaaatctttctggtgcttctggtaccaagaatctcttcttcattgcttctggtaatcttactattgaatcatggcaattagatgg

SEQ ID NO: 23290 - DNA, 333 bp, Neocallimastix californiae; identical to SEQ ID NO: 23289
  Galactose-bd-like

SEQ ID NO: 23291 - DNA, 360 bp, Neocallimastix californiae
  Galactose-bd-like
taatgcttacaatactaactatgcttcaatgatggcatggcaaggtggtgtttctacaaatggtttaggtcatactactgttacctacaacagaggtgaatggactggtgtttctaatgttgattttggagaagctgctacctccgttaagataacagccgcttctaacaatggtgctgttattagaattactactggaagtccaaatggtgatgttgttggttatgtttctattccagctactggtggtaactccaactttaagactgttactgctgatattaacactgttagtggaactaagcacgttttctttgttgcttctggtgatgttgttgtcgatacctggcaattcattgg

SEQ ID NO: 23292 - DNA, 333 bp, Neocallimastix californiae
  Galactose-bd-like
ctacgctgctagtttcgcctggcaaagtggtattagtgttaagggtcaaggtgctgttacacaagttaactatggacgtggtgcttggactggtgtttctaatgttaatttaggtaatgctaaatccattactcttaaggcttcatcatctggtggtgctactgttaaaatctgtgctggtagtgaaaatggtactgttcttggttatgttgatattccagctggtggttccttacaaaatgtttctggtaatctttctggagcttctggtaccaagaatcttttcttcattgcttccggtaatcttactattgaatcatggcaattaggtgg

SEQ ID NO: 23293 - DNA, 648 bp, Neocallimastix californiae
  Galactose-bd-like
agatattttcgcagtaaaccgtgaacctgcttcttgtaatcctgttccttatcaagacacagaatcagctgtaaatgcagtatgggattacaatgctcgtgaacaatcaagttttcttcaaatgctgacaggaaaaaatgaaaattgggacttggtagttgtacaaaattcaaatcaagctcaatcacatattaattctggttgtttcaaatctgattttagaccatcagctgatcatggttggaaaactgttcaacttccaaaaagctggacttgtcaaggttttgacttttccatctatactaatgtaaatcaaccatggcaatcaagatacgacagttacgtacctgtaccagaggcaccagtaaattataatccagttggtctttaccgtaaaaagttcactttggatagttcaatgcgtaaatctggtagacgtatctatatagaatttgatggtgtagaatcagcttactatgtttatgtcaatggacaagctgtcggatacagtgaagataccttcagtcctcaccgtttcgatattaccgatgtcctttcatcaggagaaaatacacttgccgttgaagttcacaaattctgtgatggaacttggtttgaagatcaagacatgatttatgatggtggtat

SEQ ID NO: 23294 - DNA, 498 bp, Neocallimastix californiae
  Galactose-bd-like
taaaaatccttcatttgagcaggataacgtaaatagtctttccaaggatagtacccgtggtgccttcgttgccacaagcgtcgttaactggaaactttctggaagttatggagtgagtgacatcatgacatcttctgccactgccacggacaataactttggtgcaccaggtaacccatcagatggtaaacagatgtactatattcgtaatgcatggaatgcttcttcggcatcattacttcaaagtgtgactttgcctgctggaatctataaacttacgattgacaacaaatgtgtaactgcatcaagtcatgcagcttatcttgttgcaggtgaggacaatgttacccttcctttcaaggattctttaccaagtaaatggacaactactgagctattgttcacactctctcgtgacacaactcttaacattggtatagaggttgaattcggtagtggttctggaggaagtgtgttggtggataacttccgcctcta

SEQ ID NO: 23295 - DNA, 342 bp, Neocallimastix californiae
  Galactose-bd-like
taaggttaataacgcttctagttttgcttggcaatatggtattactattaagggtcaagataatgttcttcctgtcaattatgttaaaggagcatggacaggtatttccaatgtcgatttaggtaatgctaaatctattactcttaaagcttatgctccaaatggtgctactattaaggtttgtgttggaagtgaaaatggaactgttcttggttatgttgatattccaaagggtaacagtttacaaaatgttacaggaaatcttgataatgcttcaggaacaaagaatcttttcttagtttcttctggtgatgctaccattgagtcatggcaacttactgg

SEQ ID NO: 23296 - DNA, 471 bp, Neocallimastix californiae
  Galactose-bd-like
agatccaaatggttacttattccataacacatttgaaagaggtatagatggttggagtagtagaggttctgctcaagtttcttttaacaaaaatactgcctatgatggtaatggttctatttactgttctgaaagaggagctaattggagtggtgcttcccgtaatctttcaccaaatgttttcaaaccaggaaatgcttacagtttcagtgttgttgttaaatatgaggaaggaccagcttctcaaatattctatcttacccttcaatatgatgatggttctggtgaaactcaatatgaaaaggtttctattgttgaagttgcaaagggtcagtggactcaactttacaatactaactataagattcctgatagagcatgtaacatgttattctatgtggaaacagaaaagggagaagatagtttctacgttgatgaagctattggggctccagctggaacagctattga

SEQ ID NO: 23297 - DNA, 330 bp, Neocallimastix californiae
  Galactose-bd-like
tgccgctagtttcgcttggcaaagtggtattagtgttaagggacaaggtgctgttactcaagttaattatggacgtggtgcctggactggtgtttctaatgttgctttaggtaatgccaagtctattactcttaaggcctcttcctctagtggtgctactgttaagatttgtgccggtagtgaaaatggtacagttcttggttatgttgatattccagctggtggttccttacaaaatgttactggaaatctttctggtgcttctggtaccaagagtcttttcttcattgcttctggtaatcttactattgaatcatggcaattaggtgg

SEQ ID NO: 23298 - DNA, 528 bp, Neocallimastix californiae
  Galactose-bd-like
aattgcttgggaaatcggtattccagatcgtactgctatggaatataagcatggggatcatttcaatcaatggggtcttccatataaatttccacaagaattcccaaatggagtcaattactacattggaaaatcaaactatgctaaagattggaattattgtcatgtttctgttccaggaaatgggggaacatataaatccgttccatggaatatttactttaatttaaataaaaaaccaacaggtactgcagttttacgtgtttctgttgctgctaatacttccactgctctttcagtttcaattaatggtggtaaaaattcagctgaagtttcaaactttaaagatgatgcttgtgttcgtcgtgatggtattcgtggattctatcgtgaattagaattcaaatttagtccaaatgacttcaagattggagaaaataagattactttgaatgccagaaagactggtggttacactaatagttatcaatttgatggtattatgtatgatcatattcgtcttgaaac

SEQ ID NO: 23299 - DNA, 366 bp, Neocallimastix californiae
  Galactose-bd-like
aaatgttgatgcctttaaaacttactatgcctctatgatggcttgggaaggtggtgtctctattaacggtttaggtcacactactgttacttataataagggtgactggactggtgtttcaaatgttgatttcggtaatggcgcttacggtattaaggtctcagctgcctctagaaatggtgctgttattaagattgctgctggtagtgaaactggtaatgctcttggttacattaacattccagccactggtggtacaaactctttcaaaaccgttactgcttctcttagcaagattactggtgttaagaacattttcttcattgcatccggtgatgttgttcttgatacatggcaattcactga

SEQ ID NO: 23300 - DNA, 648 bp, Neocallimastix californiae
  Galactose-bd-like
agatgttttcgcagttaatcgtgaagctgcttcatgtaaccctgttcctttccaaaatgtagaagcagctgtaaatgctgtatgggattataatgcccgtgaagattcaagttatttacaaatgcttacaggtaagaatcaaaattgggatcttgttgtagaacaaaatgctcaaaaagcacaaaatcatatcaataatggatgtttcaaaccaaattatcaaccatcatccaacaatggttggaaaactgttcaacttccaaaaagttggacttgtcaaggttttgatttttctatttatactaatgtaggtcaaccatggcaatccaattatgatggatatgttccagttccacaagctccaactaattataatcctgttggtctttatcgtaaaaagtttacagttgatagtactatgcgtcaatcaggtagacgtatttatattgaatttgatggtgtagaatctgcttattatgtttatgttaatggtcaagctattggttacagtgaagatactttcagtcctcaccgtttcgatattactgatgctcttaccaatggtgaaaatactcttgctgttgaagttcataaattctgtgatggtacatggtttgaagatcaagatatgatttatgatggtggtat

SEQ ID NO: 23301 - DNA, 471 bp, Neocallimastix californiae
  Galactose-bd-like
accagatgaaaatggttattatttccataatacttttgaagaagatgaagatacttggactggtagacatactgcttctattcaagttagtcaaaaagctgcttatgctggtaaaagttcactttattgttataagagagaatataattggactggtgctcaacgtactctttctcctaaaatgtttaaaccaggagaaacttatagtttcagtgttgttgtaagatatgatgaaggaccagcaagtcaaaacttttaccttactcttcaatatgaaaatggtactgatgaagttcaatatgataagatttctattgaatccgttaaaaagggagaatggactcaacttgctaatgctaattataagattccagctaatgcttatgatatgtatttctatgttgaaactgaagaaggtgaagatagtttctatgttgatgaagctattggtgctgtagctggtacagctat

SEQ ID NO: 23302 - DNA, 318 bp, Neocallimastix californiae
  Galactose-bd-like
ggcatggcaaagtggtatttctgtcgaaggtcatggtgctgttactcaagttaaatacggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaagtgg

SEQ ID NO: 23303 - DNA, 366 bp, Anaeromyces robustus; identical to SEQ ID NO: 23299
  Galactose-bd-like

SEQ ID NO: 23304 - DNA, 471 bp, Anaeromyces robustus; identical to SEQ ID NO: 23301
  Galactose-bd-like

SEQ ID NO: 23305 - DNA, 333 bp, Anaeromyces robustus
  Galactose-bd-like
ctatgctgcttctatggcatggcaaagtggtatttctgtcgaaggtcatggtgctgttactcaagttaaatacggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaagtgg

SEQ ID NO: 23306 - DNA, 333 bp, Anaeromyces robustus
  Galactose-bd-like
tgcttctagttttgcttggcaaagtggtattaagattaaaggtcaaggtgaagttactactgttgaatatccaagtggtggttggacaggtatttctcaagttgctttaggagatgccaaatctattactattaaagcatcttctcaatcaggagctactattaagatttgtactggtaatgaaaatggtaatgttcttggttatgttgaaattccatcaggtggtaatttaaaagaagttactggtgatcttactaatgctacaggtactcaagatcttttcttagttgcatctaataatgtttctattgaatcttggaaattaaatggtaa

SEQ ID NO: 23307 - DNA, 537 bp, Anaeromyces robustus
  Galactose-bd-like
tccaactatttttgaagttggtgtacctgatcgtactgctgaagaatatttacatggtgatcatttcaatcaatggggtctttacaataagtttgcagaagaattccctaacagtgttaacttctatattggtaaatctgactggcaatttgattggaattattgtcaagtttccattccaggaggtgctaatggtaattacaaagcttgtgaaccatggaaaattcactttaatattaataaagttccatctggaaacattcttcttagagtttcaattgctgcctcatcttcaactgcattatctgtttctgttaatggaagaaatcaatcttctgaagttaaagatcttattgatgatgcttgtattcgtcgtgatggtattcgtggtatttggagtatgaaagaatttactttcccagctagtctattaaaacaaggtgaaaactatgtttcccttcatactcgtgccattggtggttatttaacttattatagatttgatggtattatgtatgatcacattagattagaaac

SEQ ID NO: 23308 - DNA, 351 bp, Anaeromyces robustus
  Galactose-bd-like
agatggttcagctgttaacccagctgctaatatggcttggcaaaacggtattagtgttaagggtcaaggtgctgtacttccagttagttacactcgtggtgcttggactggtgtttctaatgttgctttaggtggtgctagttctattactcttaaagcatcttctcaatcaggtgctactattaagatttgtactgaaagtgaaaatggtcaagctattggttatgttgatattccagctggtggatccttacaaaatgttagtggtactctttcaggtgctactggtactaaaaatcttttcttcgtttcctctggtgatgctaccattgaatcatggcaattaggtgg

SEQ ID NO: 23309 - DNA, 357 bp, Anaeromyces robustus
  Galactose-bd-like
ggatgtagatggttttgctgttaatccagctgctaatatggcttggcaatatggtattagtgtcaatggtcaaggtgctgtagttccagttaattataaccgtggtgcttggactggtgtttctaatgttgctttaggtggtgctacttctattactcttaaggcttcttcaaagtctggtgctactattaagatttgtactgaaagtgaaaatggtcaagctcttggttacgttgatattccagctggtggatccttacaaaatgttagtggtactctttcaggagctactggtactaaaaatcttttcttcgtttcctctggtgatgctaccattgaatcatggcaattaggcgg

SEQ ID NO: 23310 - DNA, 477 bp, Anaeromyces robustus
  Galactose-bd-like
agaacccgataaggatggttattatttccataatacttttgaaaatggtacagatcgttgggaaaatagaggttatgcaagtgtttctcaatcaaaagatgatgcttataaaggtagtggatctctttattgtgataatagagaatataattggagtggtgcttctcgttctctttcctctaatgtctttgaagctggtaaagaatatagttttagtgttattgtaaaatataatgaaggaccagattcacaaaaattctatcttactcttcaatatgataatggaactgatgaaattcaatatgataaaattgctaccgttaatgtttccaaagatcaatgggttcaattagctaatactaattataaaattccagctaatgcatccgatcttattttctatgttgaaactgaagaaggattagaaagtttctatattgatgaagctattggtgctgcagctggtactaaaattga

SEQ ID NO: 23311 - DNA, 357 bp, Piromyces finnis
  Galactose-bd-like
aaatgttgatgcctacagtaccaactacgcctcaatgatggcttggcaagctggtgtttccgtttatggtttaggtcacaccactgttacctacagaaagggtacctggactggtgtttctggtgttgaatttggtgacaatgccacttccgttaagatttcagctgcctctgccaatggtgctactattagaatcacctctggaagtgaaaacggtgaagttattggttacgttaccgttccagctactggtgatgaattcgtcactgttactgctgatgttagtgtttctggtgttaaggacatcttctttgttgcctctgacgaagttgttgtcgatacctggcaatttgttgc

SEQ ID NO: 23312 - DNA, 642 bp, Piromyces finnis
  Galactose-bd-like
agatgttttcgctataaatcgtgaagcagcttcatgtaaccctattccttatcaagatttaaattcagcagtaaatgctgtatgggattataatgcgcgtgaacaatcagattatcttcaaatgctcacaggaaaaaatgaaaattgggatcttgtagttgaacaaaattcaaacaaagctcaaacacatattaactcaggttgtttcaaacctgactataaaccatcttcaagttggaagaccgttcaacttccaaagagttggacctgccaaggatttgatttttctatctatactaatataggtcaaccttggcaatccaattatgatactgatatccctgtcccacatgccccaacaaattataaccctgtaggactttatcgtaaaaagtttatggtggacagtacaatgcgtcaatctggtagacgtatctatattgaatttgatggtgtagaatctgcttattatgtttatgttaatggtcaaggtgttggttacagtgaagatacattcagtcctcaccgttttgatattactgattttcttgttaatggagaaaacactcttgctgttgaagttcataaattctgtgatggaacatggttcgaagatcaagatatgatttatgatggtggtat

SEQ ID NO: 23313 - DNA, 231 bp, Piromyces finnis
  Galactose-bd-like
tgcaccatcaaccggtatgtatgacttgtctattgtttactgtgctaatatgggtcaaaaaatcaatactcttatggttaatggtcaaagtgcaggtgatgttacattcactgaaaataaaaagtttgaatcaaaagatgttggtgctatttatttaaataaaggaaagaatactattggtcttgtagcttcatggggttggatgtgggttgatgcttttgttattaatga

SEQ ID NO: 23314 - DNA, 474 bp, Piromyces finnis
  Galactose-bd-like
agataaggatggttattatttccataatacttttgaaaatggtgctgaacgttgggaaaatagaggttatgctagtgtagctcaatcaaaggatactgcttataagggtaatggatctctttactgtgaaaagagagaatataattggagtggtgcttcccgttctctttcttctaacgtttttgaaccaggtaaagaatttagtttcagtgctgttgttaagtatgatgaaggaccagaatctcaaacctttttcctttcacttcaatataatgatgattcgggtgaaactcaatacgataaaattgctattgttaaggttactcaaggtgaatgggtacaattagcaaatacaaactataaaattccagccaattcttccaacttaatgttttacattgaaactgaagaagaattatcaagcttttatgttgatgaagctattgctgctccagcaggtactaaaattgaagg

SEQ ID NO: 23315 - DNA, 537 bp, Piromyces finnis
  Galactose-bd-like
tccaactgtctttgaagttggtattcctgatcgtactgctgaagaatatttacatggggatcactttaatcaatggggtctttacaatcaattccaagatgaattcccaaatagcgtaaacttccgtattggtgaatctgattggcaatttgattggaactattgtcaagtttcaattccaggtggtgctgatggaaagtacaaagctgctgaaccatggaaaatttatttcaatcttgacaaagtcccatcaggtaacatcctcgttagagtttctgttgctgcttcatcctcaactgctttatcagtttctgttaatggtaagaatcaaagtgctgaggttaaggatcttgttgatgatgcttgtattcgtcgtgatggtattcgtggtatttggagtatgaaggaatttacattctcatctagtttattaaaacaaggtgaaaattacatttctcttcacgctcgtgctattggtggttatttaacctattacagatttgacggtattatgtacgatcatgttagattagaagt

SEQ ID NO: 23316 - DNA, 525 bp, Piromyces finnis
  Galactose-bd-like
agtttgggaaattggtataccagatcgtactgcaatggaatataaacatggtaatcattttaaccaatggggtctttaccataaatttaagactgaattcccaaacagtgttaactattatgttggtaaatctaattatgctactgattggaattactgtcacgtttcaattcaaggtgcagatggtaaatatatgcaatctccatggaatatttacttcaacttaaataaaataccaacaggaacatctgttttacgtatttccattgctgcttcttcatattctgctctttctgttgccttaaacgatggtaaagcaactgctgaagttaaagatttagttgatgatgcttgtattcgtcgtgatggtattcgtggtatttggagtatgaaggaatttacattctcatctagtttattaaaacaaggtgaaaattacatttctcttcacgctcgtgctattggtggttatttaacctattacagatttgacggtattatgtacgatcatgttagattagaagt

SEQ ID NO: 23317 - DNA, 330 bp, Piromyces finnis
  Galactose-bd-like
agctgcttcatttgcttggcaaagtggtatcaagattaagggacaaggtgcagttactaccgttgaaattccacgtggtggatggactggtgtatctcacgttgctcttggtaatgctaaatctattactattaaggctagctcctcttctggtgccaccattaaggtttgtactggtaatgaaaagggtgatgtcctcggttatgttgaaattccagcaggtggttctttacaagaagttactgctgaaatttctaatgcttcaggtactaaggatctcttctttgttgcttctaattctgtttctatggaatcatggcaattaaaggg

SEQ ID NO: 23318 - DNA, 357 bp, Piromyces finnis; identical to SEQ ID NO: 23311
  Galactose-bd-like

SEQ ID NO: 23319 - DNA, 330 bp, Piromyces finnis; identical to SEQ ID NO: 23317
  Galactose-bd-like

SEQ ID NO: 23320 - DNA, 360 bp, Piromyces finnis
  Galactose-bd-like
aaatgttgatgcctacagtaccaactacgcctcaatgatggcttggcaagctggtgtttcagttaatggtttaggacacaccactgtttcttacaacagaggtgattggactggtgtttctaacgttgactttggagacagtgccacttccgtaaagatatccgccgcttccagcaatggagccaccattagaattacttcaggcagtgaaaatggtgatgttattggatacgttactattccagctacaggtggtgataagaacttcaagaccgttacagctaatgttaaggcttctggtactaagaacatcttctttgttgcctctggtgatgttactattgatacctggcaattcat

SEQ ID NO: 23321 - DNA, 330 bp, Piromyces finnis; identical to SEQ ID NO: 23317
  Galactose-bd-like

SEQ ID NO: 23322 - DNA, 360 bp, Piromyces finnis; identical to SEQ ID NO: 23320
  Galactose-bd-like

SEQ ID NO: 23323 - DNA, 360 bp, Piromyces finnis; identical to SEQ ID NO: 23320
  Galactose-bd-like

SEQ ID NO: 23324 - DNA, 330 bp, Piromyces finnis; identical to SEQ ID NO: 23317
  Galactose-bd-like

SEQ ID NO: 23325 - DNA, 327 bp, Piromyces finnis
  Galactose-bd-like
tgctagtttcgcttggcaatatggtattagtgttaagggacaagctgcagttaccactgttaattattctcgtggtggttggactggtgtttccaatgttgctttaggtaatgctcaatctattactcttaaggcttcatctaaatcaggtgctactgttaagatttgtactggtagtgaaaatggtcaagctattggttatgttgatattccagctggtggttctttacaaaatgttactggtagtattagtggtgcttccggtactaaaaatcttttctttgttgcatctggtgatttaagtattgaatcatggcaattaggagg

SEQ ID NO: 23326 - DNA, 360 bp, Piromyces finnis; identical to SEQ ID NO: 23320
  Galactose-bd-like

SEQ ID NO: 23327 - DNA, 357 bp, Piromyces finnis; identical to SEQ ID NO: 23311
  Galactose-bd-like

SEQ ID NO: 23328 - DNA, 357 bp, Piromyces finnis; identical to SEQ ID NO: 23311
  Galactose-bd-like

SEQ ID NO: 23329 - DNA, 327 bp, Piromyces finnis; identical to SEQ ID NO: 23325
  Galactose-bd-like

SEQ ID NO: 23330 - DNA, 354 bp, Piromyces finnis
  Galactose-bd-like
ctatgaagcagaagatggtaaacttgatggaattactgtctataaagatctttcaggattttctggtactggttatgttggtagatttgaaaatccaggaaattcaataacagtaacagtcaatgcaccatcaactggtatgtatgatttatctattatatactgtgctaatatgggtcaaaaaatcaatactcttatggttaatggtcaaagtgcaggtgatgttacattcactgaaaataaaaagtttgaatcaaaagatgttggtgctatttatttaaataaaggaaagaatactattggtcttgtagcttcatggggttggatgtgggttgatgcttttgttattaatga

SEQ ID NO: 23331 - DNA, 423 bp, Neocallimastix californiae
  Galactose-binding domain-like
tgttagagctacttacactgttatctttaagaatgctaccggtatgccaagtggatatgataactggggatgggattgttctatttcttactctggtggtgctatggttatcactccaaagaaaggaaagtatggagctgtttcccttaagaatacttcaagatctttcaccggtggttctcttcgtttcgatatgaagaatgaaggtaaggttaagatccttgttgaaaattctgacaaggatgaaaaattcgatgttgatactattgccccaagtgatgaataccaaacttacatctttgatatcgactttgatttaccatttgaccgtattgatttccaagatgctaatggtactggagatcgtatctacattaagaatcttgtttattctaccggttctgctgaagatttcgattacaa

SEQ ID NO: 23332 - DNA, 462 bp, Neocallimastix californiae
  Galactose-binding domain-like
aaaggttagagcaacttactcagttatttatgaaactggtaagaaacttaacagtggatatgaaaactggggttggttagctaaaatgagtttcaaagacaacgccatggttgtaactagtgacgaagatgaatatggtgctgtttctgttcacaagaactctggttactatggtactggtggttgtattcacttattagctaagactgaaaacactgctttagttaaggttcaaggtgttaaaggtgaaccagaagaagatgctttcagtgtaggtactgttagatcttctgatgatttcacagaatacaagtttgatgttgatagtgaatatactttcgatcgtattattattcaagatggtcaagctagtggtattccaattaatgttagatacttaatttactccactggatcttgtgatgatttcaatccaccagttgatacttcatatgtcccagc

SEQ ID NO: 23333 - DNA, 333 bp, Neocallimastix californiae
  Galactose-binding domain-like
ttggggttgggcttctgttgatgtaaatgatgatggtagtgttgttgctgttttagaagaagataaatatggtgccttctctcttcacactggtaagaagttcggtgcaggtaagattcacgttgaattaaagtctgacaaggaaggtttcccagttaaaattattgttcacagtacagatgatgaacaaattgttattaagaccattgatgatgcttactctgaagaacttaaggcttacgatgttgaagttccagctggtacttatgatagaatttctattcaagatgcatggggtaaggctcttactatcactatgaacaattattatta

SEQ ID NO: 23334 - DNA, 378 bp, Neocallimastix californiae
  Galactose-binding domain-like
acttgatggtaaatggcaaaactggtcatggggtattgatagtactgaagttgatgaagaaggtaactttgttaaccacattaccgctggttcatggggtgctgtctccttcaagagaagtgatggtgttgaatttggtgctggtaccttatacttcaaggctaaagttaacgacaccagagctaatcttcaaattttattccacagctccactgatgatgatgattatgttaatgtgggtaactacaagggtatttctatcagtgaaatgactcaataccaagttgaagttactgctccagaaggtaagaagtatgacagaattaccattcaagatgttttcaaccaaggcattactctttaccttaatgatgttta

SEQ ID NO: 23335 - DNA, 327 bp, Neocallimastix californiae
  Galactose-binding domain-like
cgctgctagtatggcttggcaaagtggtattagtgttaagggacaaggtgctgttactcaagttaattatggacgtggttcctggactggtgtttctaatgttgctttaggtaatgctaagaccattactcttagagcctcttcctctagtggtgctactgttaagatttgtgccggtagtgaaaatggtacagttcttggttatgttgatattccagctggtggttccttacaaaatgttactggaaatctttctggtgcttctggtaccaagaatctcttcttcattgcttctggtaatcttactattgaatcatggcaattaga

SEQ ID NO: 23336 - DNA, 330 bp, Neocallimastix californiae
  Galactose-binding domain-like
ctacgctgctagtatggcttggcaaagtggtattagtgttaagggacaaggtgctgttactcaagttaattatggacgtggttcctggactggtgtttctaatgttgctttaggtaatgctaagaccattactcttagagcctcttcctctagtggtgctactgttaagatttgtgccggtagtgaaaatggtacagttcttggttatgttgatattccagctggtggttccttacaaaatgttactggaaatctttctggtgcttctggtaccaagaatctcttcttcattgcttctggtaatcttactattgaatcatggcaattaga

SEQ ID NO: 23337 - DNA, 342 bp, Neocallimastix californiae
  Galactose-binding domain-like
taactatgcttcaatgatggcatggcaaggtggtgtttctacaaatggtttaggtcatactactgttacctacaacagaggtgaatggactggtgtttctaatgttgattttggagaagctgctacctccgttaagataacagccgcttctaacaatggtgctgttattagaattactactggaagtccaaatggtgatgttgttggttatgtttctattccagctactggtggtaactccaactttaagactgttactgctgatattaacactgttagtggaactaagcacgttttctttgttgcttctggtgatgttgttgtcgatacctggcaattcat

SEQ ID NO: 23338 - DNA, 327 bp, Neocallimastix californiae
  Galactose-binding domain-like
tgctagtttcgcctggcaaagtggtattagtgttaagggtcaaggtgctgttacacaagttaactatggacgtggtgcttggactggtgtttctaatgttaatttaggtaatgctaaatccattactcttaaggcttcatcatctggtggtgctactgttaaaatctgtgctggtagtgaaaatggtactgttcttggttatgttgatattccagctggtggttccttacaaaatgtttctggtaatctttctggagcttctggtaccaagaatcttttcttcattgcttccggtaatcttactattgaatcatggcaattaggtgg

SEQ ID NO: 23339 - DNA, 543 bp, Neocallimastix californiae
  Galactose-binding domain-like
tgaaaattgggacttggtagttgtacaaaattcaaatcaagctcaatcacatattaattctggttgtttcaaatctgattttagaccatcagctgatcatggttggaaaactgttcaacttccaaaaagctggacttgtcaaggttttgacttttccatctatactaatgtaaatcaaccatggcaatcaagatacgacagttacgtacctgtaccagaggcaccagtaaattataatccagttggtctttaccgtaaaaagttcactttggatagttcaatgcgtaaatctggtagacgtatctatatagaatttgatggtgtagaatcagcttactatgtttatgtcaatggacaagctgtcggatacagtgaagataccttcagtcctcaccgtttcgatattaccgatgtcctttcatcaggagaaaatacacttgccgttgaagttcacaaattctgtgatggaacttggtttgaagatcaagacatgatttatgatggtggtatcttccgtgatgttttcttagttagtgctccaga

SEQ ID NO: 23340 - DNA, 504 bp, Neocallimastix californiae
  Galactose-binding domain-like
tattaaaaatccttcatttgagcaggataacgtaaatagtctttccaaggatagtacccgtggtgccttcgttgccacaagcgtcgttaactggaaactttctggaagttatggagtgagtgacatcatgacatcttctgccactgccacggacaataactttggtgcaccaggtaacccatcagatggtaaacagatgtactatattcgtaatgcatggaatgcttcttcggcatcattacttcaaagtgtgactttgcctgctggaatctataaacttacgattgacaacaaatgtgtaactgcatcaagtcatgcagcttatcttgttgcaggtgaggacaatgttacccttcctttcaaggattctttaccaagtaaatggacaactactgagctattgttcacactctctcgtgacacaactcttaacattggtatagaggttgaattcggtagtggttctggaggaagtgtgttggtggataacttccgcctctatcg

SEQ ID NO: 23341 - DNA, 336 bp, Neocallimastix californiae
  Galactose-binding domain-like
taacgcttctagttttgcttggcaatatggtattactattaagggtcaagataatgttcttcctgtcaattatgttaaaggagcatggacaggtatttccaatgtcgatttaggtaatgctaaatctattactcttaaagcttatgctccaaatggtgctactattaaggtttgtgttggaagtgaaaatggaactgttcttggttatgttgatattccaaagggtaacagtttacaaaatgttacaggaaatcttgataatgcttcaggaacaaagaatcttttcttagtttcttctggtgatgctaccattgagtcatggcaacttactggagg

SEQ ID NO: 23342 - DNA, 435 bp, Neocallimastix californiae
  Galactose-binding domain-like
ttacttattccataacacatttgaaagaggtatagatggttggagtagtagaggttctgctcaagtttcttttaacaaaaatactgcctatgatggtaatggttctatttactgttctgaaagaggagctaattggagtggtgcttcccgtaatctttcaccaaatgttttcaaaccaggaaatgcttacagtttcagtgttgttgttaaatatgaggaaggaccagcttctcaaatattctatcttacccttcaatatgatgatggttctggtgaaactcaatatgaaaaggtttctattgttgaagttgcaaagggtcagtggactcaactttacaatactaactataagattcctgatagagcatgtaacatgttattctatgtggaaacagaaaagggagaagatagtttctacgttgatgaagctattgg

SEQ ID NO: 23343 - DNA, 375 bp, Neocallimastix californiae
  Galactose-binding domain-like
tgacccagcttggagtaattggtcttggaactatgagtctgttgaagtcgatgatgacggtaatgttgttgcagtattagaagaagataaatatggtgccttctctcttcacactgacaaggaattcaatgccggaaagatccacattgaattaaaatccgacaaagaaggtgctccagttaaaattattgttcacactactggtgatgagcaagttactgttgaaactattgaagatgcttactctgatgaacttaaggcttacgatgttgatgttccagctgctgaaggtgatacctacaatagaatttctgttcaagatgcatggggtaaggcacttactattactatgaacaatttctactttacttcttc

SEQ ID NO: 23344 - DNA, 399 bp, Neocallimastix californiae
  Galactose-binding domain-like
cgatattattaaggaaggtgaattcatgattgatggtaaatggcaaaactggtcatggggtgttgaagattctgaatttgatgaagatggtaactttgtaaactatattaccgctgatacttatggtggtgtttcctttaagagaagtgacagtgttcaatttggtgctggtactttatatttcaaagctaaggttaacgataccaatgctaaccttcaagttttattccatactactgctgaagaatacgttaatatgggtaactttaaagatatttctgacactgaaatgactcaatacaaggctaaagttactgctccaactgcagaaaagtatgatagaattactattcaagatgttgccaacaacggtcttactctttatcttaatgatgttta

SEQ ID NO: 23345 - DNA, 375 bp, Neocallimastix californiae
  Galactose-binding domain-like
aggtttcatgattgaaccaggatgggctaattggtcttggggttatgaatctgttgatattgatgaagaaggtaatgttgttgctctcttcgaagaagaaaagtatggtgcattttctgttcatggtgataaggaattcagtgctggtaagatacatattgaattaaagtctgataaggaaggtgctccagttaagattattgtccacactaaggatgatgaacaaattacacttgaaactattgaagatgcttactccgatgaacttaaagcttatgatgttgatgttaccgctactgaaggtgctacctacgatagaatttcggttcaagatgcttggggtaaagctattactttaactattaacaacttcta

SEQ ID NO: 23346 - DNA, 330 bp, Neocallimastix californiae
  Galactose-binding domain-like
ctatgccgctagtttcgcttggcaaagtggtattagtgttaagggacaaggtgctgttactcaagttaattatggacgtggtgcctggactggtgtttctaatgttgctttaggtaatgccaagtctattactcttaaggcctcttcctctagtggtgctactgttaagatttgtgccggtagtgaaaatggtacagttcttggttatgttgatattccagctggtggttccttacaaaatgttactggaaatctttctggtgcttctggtaccaagagtcttttcttcattgcttctggtaatcttactattgaatcatggcaattagg

SEQ ID NO: 23347 - DNA, 528 bp, Neocallimastix californiae; identical to SEQ ID NO: 23298
  Galactose-binding domain-like

SEQ ID NO: 23348 - DNA, 363 bp, Neocallimastix californiae
  Galactose-binding domain-like
tgatgcctttaaaacttactatgcctctatgatggcttgggaaggtggtgtctctattaacggtttaggtcacactactgttacttataataagggtgactggactggtgtttcaaatgttgatttcggtaatggcgcttacggtattaaggtctcagctgcctctagaaatggtgctgttattaagattgctgctggtagtgaaactggtaatgctcttggttacattaacattccagccactggtggtacaaactctttcaaaaccgttactgcttctcttagcaagattactggtgttaagaacattttcttcattgcatccggtgatgttgttcttgatacatggcaattcactgatga

SEQ ID NO: 23349 - DNA, 418 bp, Neocallimastix californiae
  Galactose-binding domain-like
agctacatacactactattttcagaactactagttctatgccaaatggttatgatgactggggttggggatgtaacatttcttattctggtggtgccatggttattactccagaagaaggtgaatatggtgctctttctcttaagagaattagtggttacttcaagggtggttctatccgtttcgatatgaagaatgaaggtaaggttaatgttatggttgaaaattctgatactgatgacaagattactgtaaaatctattaacccaagtagttcctacgaaacttacattcttgatgttgactttggcagctttgaccgtattaatttccaagatgccagaggtgatggtagtcgtatttggattaagaaccttgttcactctactggttatgccgatgaatttgttgacccaatc

SEQ ID NO: 23350 - DNA, 456 bp, Neocallimastix californiae
  Galactose-binding domain-like
agttaaaccaacttactctgttatttacgaaattggtggtagattaaacactggatatgataactggggttgggattctagtttaactttcaaggatggttctatggttgttactgctgataagggttcttacggtgctgcttctattaagaatactaaaaaagactttggtgttggaggtagtattcgttttgatgttaaatctaaaggtaaacttttagttaaagtcgaaagtactgaagataaagaagttgctattgttggtaccactgatggtggagaatctgacttcaagacttacattttcgatattgattatgatggtccattcgatcgtattaaccttcaagatagtaatggtaatggtgatccaatctatattagatatttaatttactctactggttctgctgatgatttcgttgatccaattgacacttcaagacaaccagttgt

SEQ ID NO: 23351 - DNA, 399 bp, Neocallimastix californiae
  Galactose-binding domain-like
cgatattattaaggaaggtgattacatgattaatggtaaatggcaaaactggtcatggggtgttgaaaatgctgaatttgatgatgatggtaatttagttgctactattactgctggtacttatggtggtgtttccttcaagagaagtgacagtactctctttggtaagggtactctttacttcaaggctatggttaacgatactagagctcaacttcaagtcttattccatactactggtgatgaatatgttaatgttggatccttctctaaattctctgattctgaattagttcaatattctgttaatattaaagaaccaactggtgataaatatgatagaattactattcaagatgttgctaataatggtcttactttataccttaatgatgttta

SEQ ID NO: 23352 - DNA, 543 bp, Neocallimastix californiae
  Galactose-binding domain-like
tcaaaattgggatcttgttgtagaacaaaatgctcaaaaagcacaaaatcatatcaataatggatgtttcaaaccaaattatcaaccatcatccaacaatggttggaaaactgttcaacttccaaaaagttggacttgtcaaggttttgatttttctatttatactaatgtaggtcaaccatggcaatccaattatgatggatatgttccagttccacaagctccaactaattataatcctgttggtctttatcgtaaaaagtttacagttgatagtactatgcgtcaatcaggtagacgtatttatattgaatttgatggtgtagaatctgcttattatgtttatgttaatggtcaagctattggttacagtgaagatactttcagtcctcaccgtttcgatattactgatgctcttaccaatggtgaaaatactcttgctgttgaagttcataaattctgtgatggtacatggtttgaagatcaagatatgatttatgatggtggtattttccgtgatgttttccttgttagtgccccaag

SEQ ID NO: 23353 - DNA, 435 bp, Neocallimastix californiae
  Galactose-binding domain-like
ttattatttccataatacttttgaagaagatgaagatacttggactggtagacatactgcttctattcaagttagtcaaaaagctgcttatgctggtaaaagttcactttattgttataagagagaatataattggactggtgctcaacgtactctttctcctaaaatgtttaaaccaggagaaacttatagtttcagtgttgttgtaagatatgatgaaggaccagcaagtcaaaacttttaccttactcttcaatatgaaaatggtactgatgaagttcaatatgataagatttctattgaatccgttaaaaagggagaatggactcaacttgctaatgctaattataagattccagctaatgcttatgatatgtatttctatgttgaaactgaagaaggtgaagatagtttctatgttgatgaagctattgg

SEQ ID NO: 23354 - DNA, 261 bp, Neocallimastix californiae
  Galactose-binding domain-like
cggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaagtgg

SEQ ID NO: 23355 - DNA, 363 bp, Anaeromyces robustus; identical to SEQ ID NO: 23348
  Galactose-binding domain-like

SEQ ID NO: 23356 - DNA, 456 bp, Anaeromyces robustus; identical to SEQ ID NO: 23350
  Galactose-binding domain-like

SEQ ID NO: 23357 - DNA, 418 bp, Anaeromyces robustus; identical to SEQ ID NO: 23349
  Galactose-binding domain-like

SEQ ID NO: 23358 - DNA, 399 bp, Anaeromyces robustus; identical to SEQ ID NO: 23351
  Galactose-binding domain-like

SEQ ID NO: 23359 - DNA, 435 bp, Anaeromyces robustus; identical to SEQ ID NO: 23353
  Galactose-binding domain-like

SEQ ID NO: 23360 - DNA, 327 bp, Anaeromyces robustus
  Galactose-binding domain-like
tgcttctatggcatggcaaagtggtatttctgtcgaaggtcatggtgctgttactcaagttaaatacggccgtggtgcttggactggtgtttctaatgttgatttaggtagtgcttcatctattactcttaaagcttcttctagatctggtgctactattaaggtttgtactgatagtgaaaatggaaatgctcttggttacgttgaaattccagctggtggttccttacaaaatgttactggtcaacttagtggtgctactggtactaagaacctcttctttgtttcctcaggtgatgccgttattgaatcatggcaattaagtgg

SEQ ID NO: 23361 - DNA, 324 bp, Anaeromyces robustus
  Galactose-binding domain-like
ttctagttttgcttggcaaagtggtattaagattaaaggtcaaggtgaagttactactgttgaatatccaagtggtggttggacaggtatttctcaagttgctttaggagatgccaaatctattactattaaagcatcttctcaatcaggagctactattaagatttgtactggtaatgaaaatggtaatgttcttggttatgttgaaattccatcaggtggtaatttaaaagaagttactggtgatcttactaatgctacaggtactcaagatcttttcttagttgcatctaataatgtttctattgaatcttggaaattaaa

SEQ ID NO: 23362 - DNA, 537 bp, Anaeromyces robustus; identical to SEQ ID NO: 23307
  Galactose-binding domain-like

SEQ ID NO: 23363 - DNA, 345 bp, Anaeromyces robustus
  Galactose-binding domain-like
tggttcagctgttaacccagctgctaatatggcttggcaaaacggtattagtgttaagggtcaaggtgctgtacttccagttagttacactcgtggtgcttggactggtgtttctaatgttgctttaggtggtgctagttctattactcttaaagcatcttctcaatcaggtgctactattaagatttgtactgaaagtgaaaatggtcaagctattggttatgttgatattccagctggtggatccttacaaaatgttagtggtactctttcaggtgctactggtactaaaaatcttttcttcgtttcctctggtgatgctaccattgaatcatggcaattagg

SEQ ID NO: 23364 - DNA, 351 bp, Anaeromyces robustus
  Galactose-binding domain-like
tgtagatggttttgctgttaatccagctgctaatatggcttggcaatatggtattagtgtcaatggtcaaggtgctgtagttccagttaattataaccgtggtgcttggactggtgtttctaatgttgctttaggtggtgctacttctattactcttaaggcttcttcaaagtctggtgctactattaagatttgtactgaaagtgaaaatggtcaagctcttggttacgttgatattccagctggtggatccttacaaaatgttagtggtactctttcaggagctactggtactaaaaatcttttcttcgtttcctctggtgatgctaccattgaatcatggcaattagg

SEQ ID NO: 23365 - DNA, 435 bp, Anaeromyces robustus
  Galactose-binding domain-like
tggttattatttccataatacttttgaaaatggtacagatcgttgggaaaatagaggttatgcaagtgtttctcaatcaaaagatgatgcttataaaggtagtggatctctttattgtgataatagagaatataattggagtggtgcttctcgttctctttcctctaatgtctttgaagctggtaaagaatatagttttagtgttattgtaaaatataatgaaggaccagattcacaaaaattctatcttactcttcaatatgataatggaactgatgaaattcaatatgataaaattgctaccgttaatgtttccaaagatcaatgggttcaattagctaatactaattataaaattccagctaatgcatccgatcttattttctatgttgaaactgaagaaggattagaaagtttctatattgatgaagctat

SEQ ID NO: 23366 - DNA, 288 bp, Piromyces finnis
  Galactose-binding domain-like
tttaggtcacaccactgttacctacagaaagggtacctggactggtgtttctggtgttgaatttggtgacaatgccacttccgttaagatttcagctgcctctgccaatggtgctactattagaatcacctctggaagtgaaaacggtgaagttattggttacgttaccgttccagctactggtgatgaattcgtcactgttactgctgatgttagtgtttctggtgttaaggacatcttctttgttgcctctgacgaagttgttgtcgatacctggcaatttgttgc

SEQ ID NO: 23367 - DNA, 537 bp, Piromyces finnis
  Galactose-binding domain-like
tgaaaattgggatcttgtagttgaacaaaattcaaacaaagctcaaacacatattaactcaggttgtttcaaacctgactataaaccatcttcaagttggaagaccgttcaacttccaaagagttggacctgccaaggatttgatttttctatctatactaatataggtcaaccttggcaatccaattatgatactgatatccctgtcccacatgccccaacaaattataaccctgtaggactttatcgtaaaaagtttatggtggacagtacaatgcgtcaatctggtagacgtatctatattgaatttgatggtgtagaatctgcttattatgtttatgttaatggtcaaggtgttggttacagtgaagatacattcagtcctcaccgttttgatattactgattttcttgttaatggagaaaacactcttgctgttgaagttcataaattctgtgatggaacatggttcgaagatcaagatatgatttatgatggtggtatattccgtgatgttttccttgtaagtgctcctgc

SEQ ID NO: 23368 - DNA, 231 bp, Piromyces finnis; identical to SEQ ID NO: 23313
  Galactose-binding domain-like

SEQ ID NO: 23369 - DNA, 453 bp, Piromyces finnis
  Galactose-binding domain-like
tggttattatttccataatacttttgaaaatggtgctgaacgttgggaaaatagaggttatgctagtgtagctcaatcaaaggatactgcttataagggtaatggatctctttactgtgaaaagagagaatataattggagtggtgcttcccgttctctttcttctaacgtttttgaaccaggtaaagaatttagtttcagtgctgttgttaagtatgatgaaggaccagaatctcaaacctttttcctttcacttcaatataatgatgattcgggtgaaactcaatacgataaaattgctattgttaaggttactcaaggtgaatgggtacaattagcaaatacaaactataaaattccagccaattcttccaacttaatgttttacattgaaactgaagaagaattatcaagcttttatgttgatgaagctattgctgctccagcaggtac

SEQ ID NO: 23370 - DNA, 537 bp, Piromyces finnis; identical to SEQ ID NO: 23315
  Galactose-binding domain-like

SEQ ID NO: 23371 - DNA, 528 bp, Piromyces finnis
  Galactose-binding domain-like
aatagtttgggaaattggtataccagatcgtactgcaatggaatataaacatggtaatcattttaaccaatggggtctttaccataaatttaagactgaattcccaaacagtgttaactattatgttggtaaatctaattatgctactgattggaattactgtcacgtttcaattcaaggtgcagatggtaaatatatgcaatctccatggaatatttacttcaacttaaataaaataccaacaggaacatctgttttacgtatttccattgctgcttcttcatattctgctctttctgttgccttaaacgatggtaaagcaactgctgaagttaaagatttagttgatgatgcttgtattcgtcgtgatggtattcgtggtatttggagtatgaaggaatttacattctcatctagtttattaaaacaaggtgaaaattacatttctcttcacgctcgtgctattggtggttatttaacctattacagatttgacggtattatgtacgatcatgttagattagaagt

SEQ ID NO: 23372 - DNA, 378 bp, Piromyces finnis
  Galactose-binding domain-like
tgtcaatagtgaatggcaaaactggtcatggggtgtcaatgacagtgaaattgatgaaaatggtgctatggccaatgaacttaatgccggtgattgggctggtgtttccttcaagagaagtgacactaccaaattcggtaagttcactttatacttcaaggctatggtcagtgatccaaaggctgttattcaagttgttgttcacaattcctccgaagaagatgattacactactgtcggcagtttcaagggactttctgactccgaaatgaaggaatacagtcttgaagttgatgtcgatgctaaatatgatagaattactattcaagatatctacaacaagggatacactctctacattaatgatgtatacattgt

SEQ ID NO: 23373 - DNA, 420 bp, Piromyces finnis
  Galactose-binding domain-like
taacgctgcttggcaagattggtcatggggtaacgatgaaaatagttttgatgatgatggtaattatcaagctactttccaagaagaaaaatatggtgctctctcccttcacactggtgatacattcaatgctggtaagcttcatttagaacttaagagtgatactgaaggtgctccaatcaacattgttgttcacactattgaaggtaatgaatttgttactcttgaaactatttctagcccatctactgaagaacttgaagcctatgatattgatgttccagctgtttctggtgataactacaacagaatttctattcaagatgcctggggtaaagcaattactgttactgttaacaatatttacttcattccatctgaagttccacaagaaaataaaccaatcaatactaatggcga

SEQ ID NO: 23374 - DNA, 399 bp, Piromyces finnis
  Galactose-binding domain-like
cgatcttgttaaggaaggtgattacatgattgatgctaaatggcaaaactggtcttggggtgttgaaaatagcgaatttgatgacgatggtaatatggttaactacattgctgctggtacttatggtggtgtttccttcaagagaggagatagtactttattcggaaagggtattttccactttaaggctatggtcaatgacactaatgctcaaattcaagtattattccacactactgctgatgaatatgttgctatcggaagtgttagcgatctttctgactctgaattagttgaatacactcttgaagttgatgaaccaactgctgaaaagtacgatagattcacaattcaagatgttgctaacaatggtcttgttcttactcttaatgatgttta

SEQ ID NO: 23375 - DNA, 327 bp, Piromyces finnis
  Galactose-binding domain-like
agctgcttcatttgcttggcaaagtggtatcaagattaagggacaaggtgcagttactaccgttgaaattccacgtggtggatggactggtgtatctcacgttgctcttggtaatgctaaatctattactattaaggctagctcctcttctggtgccaccattaaggtttgtactggtaatgaaaagggtgatgtcctcggttatgttgaaattccagcaggtggttctttacaagaagttactgctgaaatttctaatgcttcaggtactaaggatctcttctttgttgcttctaattctgtttctatggaatcatggcaattaaa

SEQ ID NO: 23376 - DNA, 288 bp, Piromyces finnis; identical to SEQ ID NO: 23366
  Galactose-binding domain-like

SEQ ID NO: 23377 - DNA, 327 bp, Piromyces finnis; identical to SEQ ID NO: 23375
  Galactose-binding domain-like

SEQ ID NO: 23378 - DNA, 348 bp, Piromyces finnis
  Galactose-binding domain-like
ctacagtaccaactacgcctcaatgatggcttggcaagctggtgtttcagttaatggtttaggacacaccactgtttcttacaacagaggtgattggactggtgtttctaacgttgactttggagacagtgccacttccgtaaagatatccgccgcttccagcaatggagccaccattagaattacttcaggcagtgaaaatggtgatgttattggatacgttactattccagctacaggtggtgataagaacttcaagaccgttacagctaatgttaaggcttctggtactaagaacatcttctttgttgcctctggtgatgttactattgatacctggcaattcat

SEQ ID NO: 23379 - DNA, 327 bp, Piromyces finnis; identical to SEQ ID NO: 23375
  Galactose-binding domain-like

SEQ ID NO: 23380 - DNA, 348 bp, Piromyces finnis; identical to SEQ ID NO: 23378
  Galactose-binding domain-like

SEQ ID NO: 23381 - DNA, 348 bp, Piromyces finnis; identical to SEQ ID NO: 23378
  Galactose-binding domain-like

SEQ ID NO: 23382 - DNA, 327 bp, Piromyces finnis; identical to SEQ ID NO: 23375
  Galactose-binding domain-like

SEQ ID NO: 23383 - DNA, 324 bp, Piromyces finnis
  Galactose-binding domain-like
tgctagtttcgcttggcaatatggtattagtgttaagggacaagctgcagttaccactgttaattattctcgtggtggttggactggtgtttccaatgttgctttaggtaatgctcaatctattactcttaaggcttcatctaaatcaggtgctactgttaagatttgtactggtagtgaaaatggtcaagctattggttatgttgatattccagctggtggttctttacaaaatgttactggtagtattagtggtgcttccggtactaaaaatcttttctttgttgcatctggtgatttaagtattgaatcatggcaattagg

SEQ ID NO: 23384 - DNA, 348 bp, Piromyces finnis; identical to SEQ ID NO: 23378
  Galactose-binding domain-like

SEQ ID NO: 23385 - DNA, 288 bp, Piromyces finnis; identical to SEQ ID NO: 23366
  Galactose-binding domain-like

SEQ ID NO: 23386 - DNA, 288 bp, Piromyces finnis; identical to SEQ ID NO: 23366
  Galactose-binding domain-like

SEQ ID NO: 23387 - DNA, 324 bp, Piromyces finnis; identical to SEQ ID NO: 23383
  Galactose-binding domain-like

SEQ ID NO: 23388 - DNA, 363 bp, Piromyces finnis
  Galactose-binding domain-like
taaaaaagtttactatgaagcagaagatggtaaacttgatggaattactgtctataaagatctttcaggattttctggtactggttatgttggtagatttgaaaatccaggaaattcaataacagtaacagtcaatgcaccatcaactggtatgtatgatttatctattatatactgtgctaatatgggtcaaaaaatcaatactcttatggttaatggtcaaagtgcaggtgatgttacattcactgaaaataaaaagtttgaatcaaaagatgttggtgctatttatttaaataaaggaaagaatactattggtcttgtagcttcatggggttggatgtgggttgatgcttttgttattaa

SEQ ID NO: 23389 - DNA, 312 bp, Piromyces finnis
  Galactose-binding domain-like
atacactgtcctttacgctaatactgacgcccttccagataccactagtaatcaatcatggagtgccgaaatttcattcactgataattgtatgactggtgtcattgaagaaaatgcttggggtgctctttctctcaaatacgaaggtgaattatttgaaaatggttctctccgtttcgatattaaatctagtttcgataacgccccagttactgtttatgctcaaaattttgaaactgaagacgcaatcgttattagtaaggttgccgctggaactaaatggaatactgttactgttgatattgaattccc

SEQ ID NO: 23390 - DNA, 63 bp, Neocallimastix californiae
  GDHRDH
aatggttgaattacttaaaccagaatatactgctccacttattagtttccttactcatgaatc

SEQ ID NO: 23391 - DNA, 54 bp, Neocallimastix californiae
  GDHRDH
tgttattattactggtgctggtggtggtctaggtcgtgcttacgctaaacattt

SEQ ID NO: 23392 - DNA, 51 bp, Neocallimastix californiae
  GDHRDH
gatgaaacaaaagtatggtagaattattaatattacttctgcggctggtct

SEQ ID NO: 23393 - DNA, 36 bp, Neocallimastix californiae
  GDHRDH
tcgtgttgatattattattaataatgctggtatttt

SEQ ID NO: 23394 - DNA, 60 bp, Neocallimastix californiae
  GDHRDH
tgctgctgctaaatctggtgttattggtctcactaatgcattagctttagaaggtaaaga

SEQ ID NO: 23395 - DNA, 54 bp, Neocallimastix californiae
  GDHRDH
taatattactgtaaatagtgttgctccaaatgctggtactagaatgacagctac

SEQ ID NO: 23396 - DNA, 54 bp, Neocallimastix californiae
  GDHRDH
agttattgttactggtgctggtggtggtcttggtcgtgcctatgctaagcactt

SEQ ID NO: 23397 - DNA, 60 bp, Neocallimastix californiae
  GDHRDH
tgctgctgctaaatctggtgtcatcggtctcactaatgccctagctttagaaggtaaaga

SEQ ID NO: 23398 - DNA, 36 bp, Neocallimastix californiae; identical to SEQ ID NO: 23393
  GDHRDH

SEQ ID NO: 23399 - DNA, 51 bp, Neocallimastix californiae
  GDHRDH
gatgaagcaaaagtatggtagaattattaatattacctctgctgccggtct

SEQ ID NO: 23400 - DNA, 54 bp, Neocallimastix californiae
  GDHRDH
taatattactataaatagtgttgctccaaatgctggtactagaatgacagctac

SEQ ID NO: 23401 - DNA, 51 bp, Anaeromyces robustus
  GDHRDH
gataaaacaaaaatacggtagaattattaatattacttctgctgctggtct

SEQ ID NO: 23402 - DNA, 54 bp, Anaeromyces robustus
  GDHRDH
caatattactattaacagtgttgctccaaatgctggtactagaatgacagcaac

SEQ ID NO: 23403 - DNA, 36 bp, Anaeromyces robustus
  GDHRDH
ccgtgttgatgtcattataaataatgctggtatttt

SEQ ID NO: 23404 - DNA, 60 bp, Anaeromyces robustus
  GDHRDH
tgctgcagctaaatctggtgttattggttttaccaatgctttagcattagaaggtaagga

SEQ ID NO: 23405 - DNA, 54 bp, Anaeromyces robustus
  GDHRDH
tgttattgtaactggtgctggtggtggtcttggtcgtgcttacgctaagcattt

SEQ ID NO: 23406 - DNA, 54 bp, Piromyces finnis
  GDHRDH
tgttattgttactggtgctggtggtggtcttggtcgtgcttacgccaagcactt

SEQ ID NO: 23407 - DNA, 51 bp, Piromyces finnis
  GDHRDH
ggttaaacaaaagtacggtagaattattaatattacatctgctgccggtct

SEQ ID NO: 23408 - DNA, 60 bp, Piromyces finnis
  GDHRDH
tgctgctgctaaggctggtgttattggtctcactaatactttagccttagaaggtaagga

SEQ ID NO: 23409 - DNA, 36 bp, Piromyces finnis
  GDHRDH
tcgtgttgatgttatcattaacaacgctggtatttt

SEQ ID NO: 23410 - DNA, 54 bp, Piromyces finnis
  GDHRDH
caatattactgttaatagtattgctccaaatgctggtactagaatgacagctac

SEQ ID NO: 23411 - DNA, 1107 bp, Neocallimastix californiae
  GH_fam_N_dom
actttggtatgattctcctgcaagagcttggaccgatgctttaccagtaggtaattctcatcttggtggtatggtttatggtggagctcaacgtgatgaaattcaattgaacgaagatactttctgggccggaggtccacataataatattccaagaaatgctgcttctgctttaccacaagctagaagaatgattttcgaaggtagatttggtcaagctcaagattacattgataaaaacttctttaccggtcaaaatggtatgggttatcttacattaggtagtctctttatcaatttctctgatgtaagtggattctccaattattatcgtgatttagatcttaataatgctatcgctaccagtaaatttactgccaatggatctaatatagaacgttccttatttgcttcaatggctgatgatgttattgtttacaatattgctacggatggtaaacctcttaacttcagtgtcaatcataaatgtccacttcaaacgaatgcttcttcaagtggtaaccgtttaattcttaagattagaggtaaggatcaagaaggtgttggtgctaaacttaatgcctacgttatcgttgaaattgtttctgatggaagagttagtgctagtggttcaagccttaatgtatccaatgctaaggaagctaccatcttaatttccgctgccactaactttgttaactatcatgatgtttctggtgatgctgctaagaaggctgaagccgctctcagtaaagttaagaatgttgattattctaccttaaagagtaaacacattgaagcttacaagaagcaattcgatcgtgtaaagatctctcttccaacaagtagtgcttctgccgatcaaactgtcaatagaattcttaacttcaatagatctgatgatcaagatcttgtcgctttaatgttccaatacggtcgttacctcttgataacttcttctcaaccaggtggtcaagcagctaaccttcaaggtatttggaatgattccactgatgctccatgggatagtaaatacacaatcaatatcaatgcccaaatgaattactggccagctgaagttactaacctcagtgaatgtcatgaacc

SEQ ID NO: 23412 - DNA, 79 bp, Neocallimastix californiae
  GH_fam_N_dom
gctttggtataattctccagctaccacttggacagaagctttaccagtaggtaattcgcaccttggtggtatggtttat

SEQ ID NO: 23413 - DNA, 1104 bp, Anaeromyces robustus
  GH_fam_N_dom
actttggtataataatccagctggagaatggactgaagctcttccagtaggtaattctcatcttggtgctatgatatatggtggtgctcaacgtgatgaattacaattaaatgaagatactttctgggctggtggtccacataacaatattccaggaaatgctgctaatgctttaccacaagctcgtcaaatgattttcgaaggtagatttggtcaagctgaaaattacattaatcaaaatttcttcactggtcaaaatggtatgggttatcttactttaggaagtcttttcattaatttctctgatattaaggattactcaaattactatcgtgaattagatatcagtaatgctattgctactactacctttaatgctaatggaggaagtatggaaagaacattatttgcttctatgactgatgatgttttagtttatcatatttcttctgaaaaagctactagtttctctcttagtcataaatgtgctctttcaacttctgtttcatcctctggtaatcgtttaattattcaagttagaggtaaagatcaagaaggtgttagaggacaactttctgcttacggtattgctgaagttgttactgatggtagagtaagtgctagtggttcatcactttcagtttctggtgctaaggaagctatgattattttctctgctgctactaactttgttaattatcgtgatgtttctggtgatgctaagaagaaggttgaagctactttacaaaaggttaaaaacgttgcttatgaaacattaaaggaaagacatattgaagcttacaagaaacaattcgatcgtgttaagatagctcttccagttaacagtagtgctcaaaacccaactatggatagattagctaatttcaacagatcaggagatcaagatcttgtagctttaatgttccaatatggtcgttatttattaatttcttcttctcaaccaggaggtcaaccagctaatcttcaaggtatttggaatgatagtactgatgctccatgggatagtaaatataccattaacattaatgctcaaatgaattactggccagctgaagttacaaatcttagtgaatgtcatgaacc

SEQ ID NO: 23414 - DNA, 1113 bp, Anaeromyces robustus
  GH_fam_N_dom
actttggtatgatattccagctagagaatggactgaagcacttccagtaggtaactcgcaccttggagcaatgatatatggtggagtacaacgtgatgaattacaattaaatgaagaaactttctggggtggtggtccacataataatgttgtaaataatgcttttccaaaaattcaacaagctcgtcaaatgatttttgatggtaaatttatgcaagctgaaaattacattaatcaaaattgcttatctggtatagatggtatgccatatcttccattgggaagtcttttcattaattattctgatataaaagaatattcaaattattatcgtgaattagatattagtaatgcaatgacaaccactaaatttactgctaatggtgttaatatggaaagaactttatttgcatctatgactgatgatgtattagtttatcatattacatctgatccaaaaaagcctattagtttttctcttagttatcaattcccaagacttacaaactccatttcaacatctggtaaccgtttaattataaaggttaatggtaaggatcatgaaggtgttaaaggacgtgttactgcatatggtattgctgaagttgtcactgatggtaaagtaaatggtaatggttcaacactttctgtatcaggtgctaatgaagctattatctttttctctgctgctactaattttgtaaactataaagatgtttctggtgatccaaagaaaaaagctgaagctgctttagaaaaggtaatcaatacttcttatgaaacattgaagaaaagacatattgaagcttacaaaaagcaatttgatcgtgtaaaattatctcttccaatgaatgcttatgctcttaatccaactatggatagattagctaatttcaataaatctggagatcaagatcttgtaactttaatgttccaatatggtcgttatttattaatttcatcatcacaacctggtggtcaaccagcaactcttcaaggtatttggaatgataatattgatgctccatgggatagtaaatatactattaatattaatattcaaatgaattattggccagctgaagttactaatcttagtgaatgtcatgaacc

SEQ ID NO: 23415 - DNA, 1104 bp, Piromyces finnis
  GH_fam_N_dom
actttggtacaactcacctgctaatgcatggactgaagctcttccagttggtaattcacaccttggtggaatggttttcggaggggcacaaactgatgaaattcaattaaatgaagaaactttctgggccggcggtcctcacaacaatatcccacaaagagctaattcagtcctttcacaagctcgtcaacttattttcagtagcaaatttggtgatgctcaaaatttaattgataaaaacttcttctcaggtcaaaatggtatgggatatcttactttaggtagtctttacattaaattctcagatgttaaagatgtttcaaactattatcgtgatcttgatctcaatactgctattgcaacttccaagtttacttccaatggaatgaatgtagaacgttcattgttcgcttctatggctgacaatgtattagcttacaagattactaatgaaaacaaaccaattagttttactgttagtcataaatgtcaacttagtacttctgtttcaacaagtaataatcgtatgattcttaaaattagaggtaaggatcaagaaggtgttggatcaaaactttctgcttatggtattgtagaaattgttaccgacggtagagtatctgcaagtggttcatcactttctgtttcaggtgcttatgatacagttatttatatcactgctgccaccaactttgtttcttacaacgatgttagtggagatgcccagaaaaaggccgaagccgctattcaaagcgcattaaaatcaacttactcatctcttaaagataaacatcttgctgcttacaaaaagcaatttgatcgtgtaaagatttctcttccagtaaatagcaatgctgaaaatcaaactgtcgatcgtttagccaatttcaatagatctggtgatcaagatcttattgctttaatgttccaatatggtcgttatttattaattacatcatcccaaccaggtggtcaaccagctaatttacaaggtatttggaatgatagtattgatgcaccatgggatagtaaatacactatcaatattaacactgaaatgaactactggcctgctgaagttacaaatcttagtgaatgtcacga

SEQ ID NO: 23416 - DNA, 192 bp, Neocallimastix californiae
  GH04125P-RELATED
aattagtcaagtggtaaggatagaatgtgatgaaaaaggtacaactgctgctgcagttactgaagttcacggctccgctaaagcattacctaaaacccctataatatttaattttatatgtaatcgtccattcatatatgttttatatgataatgtaaatgatgatattggatttgtaggtcaagtcatgac

SEQ ID NO: 23417 - DNA, 286 bp, Neocallimastix californiae
  GH97_C
ttgggatggattaaaacttattaatggcgaggtaggtcgatattataatctggccagaagaactggggatcgctggtttgccgctggtgtgagtgtggaggcaagagatatgaaatggaagcccaccttcctagatagcaataagaagtataccgctactctctatcgagaaaggggtaataatcgtcaagcccttgaaatcgtaactctgaaaaatgttacaccaaacactgaactaaacattcatgttatgaatggtggtggatatgctataaagtttacccca

SEQ ID NO: 23418 - DNA, 756 bp, Neocallimastix californiae
  GH97_N
ttattcgccaaatcaaaagaccttcattacttttgaattagacaatggtaatggtagtctcttctatttagttaaacaggatgataaagatttagttgaacgttctccacttggtataaaaactaatcttggagacttcaccaatggattaaactttaaggaagttcatgtaaaaatcgtcaatgaaaaatatccaacctacagtggtaagaaggatgaatacgttaatcattatgttgaaaaaactataattttcaacagtagcaggaacagcaacgttgatttcggcatagttgccagatcctataatgacggcgttgccttccgttacattattattactggtgatcataaagaacttacgattgaaccgaacgatgaagtgaccggtattaagcttccagacgatgctactgtatgggaaatgtcttataattatgaagaatttatgtatgaggaagaatttgaagaaaagacaatcaatgatatcggaagaaatgtcaaaccaacaatgccaatgctcttcagaactggtgatgataaatatggccttgtgactgaagccgttaaggttggtacgtatgtcggatctcatcttgaagttgactatgatcacgtattaagattcaaattcgatgatcatcaaagaagtgcagtgaagacacaaaccccattccagtccccttggagagcatttgttgttggaggattagatgaaattatggaaaatacgatggtcgaaaacctaagtccgga

SEQ ID NO: 23419 - DNA, 39 bp, Neocallimastix californiae
  GLHYDRLASE10
taatattccaattgatggtgttggtcttcaataccatgt

SEQ ID NO: 23420 - DNA, 36 bp, Neocallimastix californiae
  GLHYDRLASE10
tgatacttgggatgttgttaatgaagctattgatga

SEQ ID NO: 23421 - DNA, 36 bp, Neocallimastix californiae
  GLHYDRLASE10
taaacttttctacaacgattataatactgaaggtat

SEQ ID NO: 23422 - DNA, 39 bp, Neocallimastix californiae
  GLHYDRLASE10
tagaggtcacgctttaatttggcacagtatggctccaaa

SEQ ID NO: 23423 - DNA, 36 bp, Neocallimastix californiae
  GLHYDRLASE10
tatttactgggatgttattaatgaatctgttactga

SEQ ID NO: 23424 - DNA, 39 bp, Neocallimastix californiae
  GLHYDRLASE10
ccgtggtcacaatcttttctggccagcttactctccaca

SEQ ID NO: 23425 - DNA, 36 bp, Neocallimastix californiae
  GLHYDRLASE10
aaagttattctataacgattacaatgccgaagcaaa

SEQ ID NO: 23426 - DNA, 39 bp, Neocallimastix californiae
  GLHYDRLASE10
gggtgtcccaattgatggtgtcggcttacaaatgcacgt

SEQ ID NO: 23427 - DNA, 39 bp, Neocallimastix californiae
  GLHYDRLASE10
cagaggtcacgcccttgtttggcactctatggctccaga

SEQ ID NO: 23428 - DNA, 36 bp, Neocallimastix californiae
  GLHYDRLASE10
taaacttttctacaacgactacaacaccgaaggtat

SEQ ID NO: 23429 - DNA, 39 bp, Neocallimastix californiae
  GLHYDRLASE10
taacattccaattgatggggtcggtattcaataccacgt

SEQ ID NO: 23430 - DNA, 36 bp, Neocallimastix californiae
  GLHYDRLASE10
tgatacctgggatgttgttaatgaagctattgatga

SEQ ID NO: 23431 - DNA, 36 bp, Neocallimastix californiae
  GLHYDRLASE10
tgatgtttgggatgttgttaatgaagctgttgaaat

SEQ ID NO: 23432 - DNA, 36 bp, Neocallimastix californiae
  GLHYDRLASE10
taaacttatttacaatgattacaacacttttatgtc

SEQ ID NO: 23433 - DNA, 39 bp, Neocallimastix californiae
  GLHYDRLASE10
tgaaaacttagttgatggcgttggtcttcaatcttactt

SEQ ID NO: 23434 - DNA, 39 bp, Neocallimastix californiae
  GLHYDRLASE10
gagaggtcacactttagtatggcatgttcaaactccaga

SEQ ID NO: 23435 - DNA, 39 bp, Neocallimastix californiae
  GLHYDRLASE10
gagaggtcacactttagtttggcacactcaagctccaga

SEQ ID NO: 23436 - DNA, 39 bp, Neocallimastix californiae
  GLHYDRLASE10
tgaaaacttaattgatggtgttggtctccaatcttactt

SEQ ID NO: 23437 - DNA, 36 bp, Neocallimastix californiae
  GLHYDRLASE10
caagcttatttacaacgattttaatacattccaata

SEQ ID NO: 23438 - DNA, 36 bp, Neocallimastix californiae
  GLHYDRLASE10
tgatgtatgggatgttgttaatgaagctgttgaaat

SEQ ID NO: 23439 - DNA, 39 bp, Neocallimastix californiae
  GLHYDRLASE10
cagaggtcatgctttaatatggcatgctatggctccagg

SEQ ID NO: 23440 - DNA, 36 bp, Neocallimastix californiae
  GLHYDRLASE10
taaacttttctataacgattataacactgaaggtat

SEQ ID NO: 23441 - DNA, 36 bp, Neocallimastix californiae
  GLHYDRLASE10
tgatacttgggatgtcgttaatgaagctcttgatga

SEQ ID NO: 23442 - DNA, 39 bp, Neocallimastix californiae
  GLHYDRLASE10
taatattccaattgatggtgttggtattcaatatcatgt

SEQ ID NO: 23443 - DNA, 36 bp, Neocallimastix californiae; identical to SEQ ID NO: 23440
  GLHYDRLASE10

SEQ ID NO: 23444 - DNA, 39 bp, Neocallimastix californiae; identical to SEQ ID NO: 23442
  GLHYDRLASE10

SEQ ID NO: 23445 - DNA, 36 bp, Neocallimastix californiae
  GLHYDRLASE10
tgatacttgggatgtcgttaatgaagctattgatga

SEQ ID NO: 23446 - DNA, 39 bp, Neocallimastix californiae
  GLHYDRLASE10
cagaggtcacgctttaatttggcatgctatggctccagg

SEQ ID NO: 23447 - DNA, 39 bp, Neocallimastix californiae
  GLHYDRLASE10
taatattccaattgatggtgttggtattcaatatcacgt

SEQ ID NO: 23448 - DNA, 36 bp, Neocallimastix californiae
  GLHYDRLASE10
tgatacttgggatgttgttaatgaagctatcgatga

SEQ ID NO: 23449 - DNA, 36 bp, Neocallimastix californiae
  GLHYDRLASE10
taaacttttctacaatgattacaacactgaaggtat

SEQ ID NO: 23450 - DNA, 39 bp, Neocallimastix californiae
  GLHYDRLASE10
ccgtggtcactgtcttatctggcacgcttaccaaccatc

SEQ ID NO: 23451 - DNA, 36 bp, Neocallimastix californiae; identical to SEQ ID NO: 23420
  GLHYDRLASE10

SEQ ID NO: 23452 - DNA, 36 bp, Neocallimastix californiae
  GLHYDRLASE10
taaacttttctacaatgattacaatactgaaggtat

SEQ ID NO: 23453 - DNA, 39 bp, Neocallimastix californiae; identical to SEQ ID NO: 23447
  GLHYDRLASE10

SEQ ID NO: 23454 - DNA, 36 bp, Neocallimastix californiae
  GLHYDRLASE10
tgatacttgggatgttgttaacgaagctattgatga

SEQ ID NO: 23455 - DNA, 36 bp, Neocallimastix californiae
  GLHYDRLASE10
taaacttttctataacgattataatactgaaggtat

SEQ ID NO: 23456 - DNA, 39 bp, Neocallimastix californiae
  GLHYDRLASE10
taacattcctattgatggtgtaggtattcaatatcatgt

SEQ ID NO: 23457 - DNA, 39 bp, Neocallimastix californiae
  GLHYDRLASE10
ccgtggtcactgtcttatctggcactcataccaaccatc

SEQ ID NO: 23458 - DNA, 39 bp, Neocallimastix californiae
  GLHYDRLASE10
gagaggtcatgttttagtttggcacaaccaagtcccaag

SEQ ID NO: 23459 - DNA, 36 bp, Neocallimastix californiae
  GLHYDRLASE10
tgatgtttgggatgttgttaatgaagctgttgaagt

SEQ ID NO: 23460 - DNA, 39 bp, Neocallimastix californiae
  GLHYDRLASE10
ggaagatttagttgatgctattggtatgcaatcctacat

SEQ ID NO: 23461 - DNA, 36 bp, Neocallimastix californiae
  GLHYDRLASE10
taaattagtttacaacgattactgtacttatgtcac

SEQ ID NO: 23462 - DNA, 36 bp, Neocallimastix californiae
  GLHYDRLASE10
tgatgtttgggatgttgttaatgaagctattgaaat

SEQ ID NO: 23463 - DNA, 39 bp, Neocallimastix californiae
  GLHYDRLASE10
tagaggtcatgtattagtatggcacacccaaactccaga

SEQ ID NO: 23464 - DNA, 36 bp, Neocallimastix californiae
  GLHYDRLASE10
taaattagtttacaatgattacaatactttccaaac

SEQ ID NO: 23465 - DNA, 39 bp, Neocallimastix californiae
  GLHYDRLASE10
agataatttagttgatgctcttggtatgcaatcttatat

SEQ ID NO: 23466 - DNA, 36 bp, Neocallimastix californiae
  GLHYDRLASE10
tgatgtctgggatgtcgttaatgaagcggtcgaaat

SEQ ID NO: 23467 - DNA, 39 bp, Neocallimastix californiae
  GLHYDRLASE10
gagaggacataccttggtttggcatgttcaagctccaga

SEQ ID NO: 23468 - DNA, 36 bp, Neocallimastix californiae
  GLHYDRLASE10
taaactcgtctataacgacttcaatacttttatgtc

SEQ ID NO: 23469 - DNA, 39 bp, Neocallimastix californiae
  GLHYDRLASE10
tgaaaacttaattgatggtgttggtcttcaatcctactt

SEQ ID NO: 23470 - DNA, 39 bp, Neocallimastix californiae
  GLHYDRLASE10
ccgtggtcacaatcttttctggccagctaattctccaag

SEQ ID NO: 23471 - DNA, 36 bp, Neocallimastix californiae
  GLHYDRLASE10
taaattaatttacaatgattataatgctgaagctaa

SEQ ID NO: 23472 - DNA, 36 bp, Neocallimastix californiae
  GLHYDRLASE10
catttactgggatgttattaatgaatcagttaccga

SEQ ID NO: 23473 - DNA, 39 bp, Neocallimastix californiae
  GLHYDRLASE10
cggtgttccaatcgatggtgttggtttacaaatgcacat

SEQ ID NO: 23474 - DNA, 39 bp, Neocallimastix californiae
  GLHYDRLASE10
gagaggtcatgtcttagtttggcacaaccaagctccaag

SEQ ID NO: 23475 - DNA, 36 bp, Neocallimastix californiae
  GLHYDRLASE10
tgatgtttgggatgttgttaacgaagccattgaagt

SEQ ID NO: 23476 - DNA, 36 bp, Neocallimastix californiae
  GLHYDRLASE10
caaattagtttacaacgattattccaccttcgtcac

SEQ ID NO: 23477 - DNA, 39 bp, Neocallimastix californiae
  GLHYDRLASE10
ggaagatttagttgatgccattggtatgcaatcctatat

SEQ ID NO: 23478 - DNA, 36 bp, Neocallimastix californiae
  GLHYDRLASE10
caaattagtttacaatgatgttgataccttcatgac

SEQ ID NO: 23479 - DNA, 39 bp, Neocallimastix californiae
  GLHYDRLASE10
tgaagatttagttgatgcccttggtatggaatcttacat

SEQ ID NO: 23480 - DNA, 39 bp, Neocallimastix californiae
  GLHYDRLASE10
tagaggtcacgtcttagtttggcacaaacaaactccaga

SEQ ID NO: 23481 - DNA, 36 bp, Neocallimastix californiae
  GLHYDRLASE10
tgatgtctttgatgttgttaatgaagccattgaagt

SEQ ID NO: 23482 - DNA, 36 bp, Neocallimastix californiae
  GLHYDRLASE10
caaattgatttacaatgattattattgtgaagccaa

SEQ ID NO: 23483 - DNA, 39 bp, Neocallimastix californiae
  GLHYDRLASE10
tcgtggtcataatctcttctggccagcaaattcaccaaa

SEQ ID NO: 23484 - DNA, 36 bp, Neocallimastix californiae
  GLHYDRLASE10
tatctattgggatgttattaatgaatcagttatgga

SEQ ID NO: 23485 - DNA, 39 bp, Neocallimastix californiae
  GLHYDRLASE10
ggaggttcctattgatggtgttggtcttcaaatgcatgt

SEQ ID NO: 23486 - DNA, 39 bp, Neocallimastix californiae
  GLHYDRLASE10
gagaggtcacaccttagtttggcacgttcaaacaccaga

SEQ ID NO: 23487 - DNA, 39 bp, Neocallimastix californiae
  GLHYDRLASE10
tgaaaatttaattgatggtgttggtcttcaatcttactt

SEQ ID NO: 23488 - DNA, 36 bp, Neocallimastix californiae
  GLHYDRLASE10
tgatgtttgggatgtcgttaatgaagctgttgaaat

SEQ ID NO: 23489 - DNA, 36 bp, Neocallimastix californiae
  GLHYDRLASE10
taaacttatttacaatgattacaatactttcatgtc

SEQ ID NO: 23490 - DNA, 36 bp, Neocallimastix californiae
  GLHYDRLASE10
agatgtatgggatgttgtcaatgaagccatagaaat

SEQ ID NO: 23491 - DNA, 36 bp, Neocallimastix californiae
  GLHYDRLASE10
gaaattagtgtataacgatttcaatacattccaagt

SEQ ID NO: 23492 - DNA, 39 bp, Neocallimastix californiae
  GLHYDRLASE10
agaagatttaattgatggtattggattacaatcgtattt

SEQ ID NO: 23493 - DNA, 39 bp, Neocallimastix californiae
  GLHYDRLASE10
tagaggacatgtcttgatttggcacactcaaactccaga

SEQ ID NO: 23494 - DNA, 36 bp, Neocallimastix californiae
  GLHYDRLASE10
taaacttttctataatgattataatactgaaggtat

SEQ ID NO: 23495 - DNA, 39 bp, Neocallimastix californiae
  GLHYDRLASE10
cagaggtcatgctttagtttggcatagtatggccccaaa

SEQ ID NO: 23496 - DNA, 39 bp, Neocallimastix californiae; identical to SEQ ID NO: 23447
  GLHYDRLASE10

SEQ ID NO: 23497 - DNA, 36 bp, Neocallimastix californiae
  GLHYDRLASE10
tgatacttgggatgtagttaatgaagctattgatga

SEQ ID NO: 23498 - DNA, 39 bp, Neocallimastix californiae
  GLHYDRLASE10
tagaggtcatgtattagtatggcataaacaaactccaga

SEQ ID NO: 23499 - DNA, 36 bp, Neocallimastix californiae
  GLHYDRLASE10
caagttagtatataatgattataatactttccaaac

SEQ ID NO: 23500 - DNA, 36 bp, Neocallimastix californiae
  GLHYDRLASE10
tgatgtttgggatgttgttaatgaagcagttgaaat

SEQ ID NO: 23501 - DNA, 39 bp, Neocallimastix californiae
  GLHYDRLASE10
agataatttaatcgatgccattggtatgcaatcatacat

SEQ ID NO: 23502 - DNA, 39 bp, Neocallimastix californiae
  GLHYDRLASE10
gagaggacatactttagtatggcacactcaaacaccatc

SEQ ID NO: 23503 - DNA, 36 bp, Neocallimastix californiae
  GLHYDRLASE10
agatgtatgggatgttgttaatgaagcggttgaaat

SEQ ID NO: 23504 - DNA, 39 bp, Neocallimastix californiae
  GLHYDRLASE10
agaaaatttaattgatggaattggaatgcaatcatatct

SEQ ID NO: 23505 - DNA, 36 bp, Neocallimastix californiae
  GLHYDRLASE10
taaattaatatataatgattataatacttttatgag

SEQ ID NO: 23506 - DNA, 39 bp, Neocallimastix californiae
  GLHYDRLASE10
cagaggtcacgctttaatttggcacagtatggctccaaa

SEQ ID NO: 23507 - DNA, 36 bp, Neocallimastix californiae
  GLHYDRLASE10
tgatacatgggatgtagttaatgaagctattgatga

SEQ ID NO: 23508 - DNA, 39 bp, Neocallimastix californiae
  GLHYDRLASE10
taatattcctattgatggtgttggtcttcaataccacgt

SEQ ID NO: 23509 - DNA, 36 bp, Neocallimastix californiae; identical to SEQ ID NO: 23455
  GLHYDRLASE10

SEQ ID NO: 23510 - DNA, 39 bp, Neocallimastix californiae
  GLHYDRLASE10
agatgttccaattgatggtgttggtttacaaatgcacat

SEQ ID NO: 23511 - DNA, 36 bp, Neocallimastix californiae
  GLHYDRLASE10
tatttactgggatgttatcaatgaatctgttactga

SEQ ID NO: 23512 - DNA, 36 bp, Neocallimastix californiae
  GLHYDRLASE10
aaaattattctataatgattataatgctgaaaacaa

SEQ ID NO: 23513 - DNA, 36 bp, Anaeromyces robustus; identical to SEQ ID NO: 23494
  GLHYDRLASE10

SEQ ID NO: 23514 - DNA, 36 bp, Anaeromyces robustus; identical to SEQ ID NO: 23497
  GLHYDRLASE10

SEQ ID NO: 23515 - DNA, 39 bp, Anaeromyces robustus; identical to SEQ ID NO: 23447
  GLHYDRLASE10

SEQ ID NO: 23516 - DNA, 39 bp, Anaeromyces robustus; identical to SEQ ID NO: 23495
  GLHYDRLASE10

SEQ ID NO: 23517 - DNA, 36 bp, Anaeromyces robustus; identical to SEQ ID NO: 23511
  GLHYDRLASE10

SEQ ID NO: 23518 - DNA, 39 bp, Anaeromyces robustus; identical to SEQ ID NO: 23510
  GLHYDRLASE10

SEQ ID NO: 23519 - DNA, 36 bp, Anaeromyces robustus; identical to SEQ ID NO: 23512
  GLHYDRLASE10

SEQ ID NO: 23520 - DNA, 39 bp, Anaeromyces robustus
  GLHYDRLASE10
ccgtggtcacaatcttttctggccagcttactctccatc

SEQ ID NO: 23521 - DNA, 39 bp, Anaeromyces robustus; identical to SEQ ID NO: 23447
  GLHYDRLASE10

SEQ ID NO: 23522 - DNA, 36 bp, Anaeromyces robustus
  GLHYDRLASE10
tgatgcctgggatgttgttaatgaagctattgatga

SEQ ID NO: 23523 - DNA, 36 bp, Anaeromyces robustus
  GLHYDRLASE10
taaacttttctataatgattataatactgaaggtgt

SEQ ID NO: 23524 - DNA, 39 bp, Anaeromyces robustus
  GLHYDRLASE10
ccgtggtcactgtcttatttggcatgcctatcaaccatc

SEQ ID NO: 23525 - DNA, 36 bp, Anaeromyces robustus
  GLHYDRLASE10
taaacttttctataatgattataatacagaaggtat

SEQ ID NO: 23526 - DNA, 39 bp, Anaeromyces robustus
  GLHYDRLASE10
cagaggtcatgctttaatttggcattctatggctccaca

SEQ ID NO: 23527 - DNA, 36 bp, Anaeromyces robustus; identical to SEQ ID NO: 23420
  GLHYDRLASE10

SEQ ID NO: 23528 - DNA, 39 bp, Anaeromyces robustus
  GLHYDRLASE10
taatattccaattgatggtgttggtatacaatatcatgt

SEQ ID NO: 23529 - DNA, 39 bp, Anaeromyces robustus
  GLHYDRLASE10
tgaaaatttagtggatggagttggtcttcaatcttactt

SEQ ID NO: 23530 - DNA, 39 bp, Anaeromyces robustus
  GLHYDRLASE10
gagaggtcatactttagtttggcatactcaaactccttc

SEQ ID NO: 23531 - DNA, 36 bp, Anaeromyces robustus; identical to SEQ ID NO: 23431
  GLHYDRLASE10

SEQ ID NO: 23532 - DNA, 36 bp, Anaeromyces robustus
  GLHYDRLASE10
taaacttatttataatgattataatacttttatgtc

SEQ ID NO: 23533 - DNA, 36 bp, Anaeromyces robustus
  GLHYDRLASE10
taaattagtttataatgattatgatacttggagaac

SEQ ID NO: 23534 - DNA, 39 bp, Anaeromyces robustus
  GLHYDRLASE10
tagaggacatgttttagtttggcataagcaaactccaga

SEQ ID NO: 23535 - DNA, 36 bp, Anaeromyces robustus
  GLHYDRLASE10
agatgttgttgatgttgttaatgaagctgttgaagt

SEQ ID NO: 23536 - DNA, 39 bp, Piromyces finnis
  GLHYDRLASE10
tcgtggtcatgctctagtatggcatactcaagttccaga

SEQ ID NO: 23537 - DNA, 39 bp, Piromyces finnis
  GLHYDRLASE10
agaaaacttaattgatggtattggtatgcaatcttatat

SEQ ID NO: 23538 - DNA, 36 bp, Piromyces finnis
  GLHYDRLASE10
agatgtttgggatgtagttaatgaagcaattgaaat

SEQ ID NO: 23539 - DNA, 36 bp, Piromyces finnis
  GLHYDRLASE10
aaagttaatttataatgatcataatactttccaaat

SEQ ID NO: 23540 - DNA, 39 bp, Piromyces finnis
  GLHYDRLASE10
gggtattccaattgatggtgtaggtttacaaatgcacat

SEQ ID NO: 23541 - DNA, 36 bp, Piromyces finnis
  GLHYDRLASE10
catctactgggatgttgttaatgaatccgtcactga

SEQ ID NO: 23542 - DNA, 36 bp, Piromyces finnis
  GLHYDRLASE10
taaattaatttacaatgattataatgctgaaaacaa

SEQ ID NO: 23543 - DNA, 39 bp, Piromyces finnis
  GLHYDRLASE10
ccgtggacataatcttttctggccagccaactctccaga

SEQ ID NO: 23544 - DNA, 36 bp, Piromyces finnis
  GLHYDRLASE10
tgatacttgggatgttgtcaatgaagctattgatga

SEQ ID NO: 23545 - DNA, 36 bp, Piromyces finnis
  GLHYDRLASE10
taagctcttctacaacgattacaatactgaaggtat

SEQ ID NO: 23546 - DNA, 39 bp, Piromyces finnis
  GLHYDRLASE10
tggtattccaattgatggtgttggtattcaatatcacgt

SEQ ID NO: 23547 - DNA, 39 bp, Piromyces finnis
  GLHYDRLASE10
ccgtggtcatgctcttatctggcacgcatacatgccatc

SEQ ID NO: 23548 - DNA, 39 bp, Piromyces finnis; identical to SEQ ID NO: 23547
  GLHYDRLASE10

SEQ ID NO: 23549 - DNA, 36 bp, Piromyces finnis; identical to SEQ ID NO: 23544
  GLHYDRLASE10

SEQ ID NO: 23550 - DNA, 36 bp, Piromyces finnis; identical to SEQ ID NO: 23545
  GLHYDRLASE10

SEQ ID NO: 23551 - DNA, 39 bp, Piromyces finnis; identical to SEQ ID NO: 23546
  GLHYDRLASE10

SEQ ID NO: 23552 - DNA, 27 bp, Neocallimastix californiae
  GLHYDRLASE11
ggaaaaattaggtcttagaattggttc

SEQ ID NO: 23553 - DNA, 33 bp, Neocallimastix californiae
  GLHYDRLASE11
acaaattgaatactatgttgttgatgactggct

SEQ ID NO: 23554 - DNA, 18 bp, Neocallimastix californiae
  GLHYDRLASE11
atctaccttcactcaaat

SEQ ID NO: 23555 - DNA, 30 bp, Neocallimastix californiae
  GLHYDRLASE11
aattttctccgttcgtactgaacaacgtac

SEQ ID NO: 23556 - DNA, 21 bp, Neocallimastix californiae
  GLHYDRLASE11
tggtggtacatacaaggtttg

SEQ ID NO: 23557 - DNA, 30 bp, Neocallimastix californiae
  GLHYDRLASE11
cgttggtgtctacggttggatggataatcc

SEQ ID NO: 23558 - DNA, 27 bp, Neocallimastix californiae
  GLHYDRLASE11
ggaaaaattaggtttgaaaatgggaaa

SEQ ID NO: 23559 - DNA, 30 bp, Neocallimastix californiae
  GLHYDRLASE11
tgttggtgtttacggttggactttagaatc

SEQ ID NO: 23560 - DNA, 30 bp, Neocallimastix californiae
  GLHYDRLASE11
atacttcagtcttcgtagagaaccacgtac

SEQ ID NO: 23561 - DNA, 33 bp, Neocallimastix californiae
  GLHYDRLASE11
agtctttgaattttacattgtcgataattggct

SEQ ID NO: 23562 - DNA, 30 bp, Neocallimastix californiae
  GLHYDRLASE11
cattggtatctacggttggaccagaaatcc

SEQ ID NO: 23563 - DNA, 33 bp, Neocallimastix californiae
  GLHYDRLASE11
acttgttgaattctacgttgttgataactggct

SEQ ID NO: 23564 - DNA, 21 bp, Neocallimastix californiae
  GLHYDRLASE11
tggtgctagatacactgttta

SEQ ID NO: 23565 - DNA, 30 bp, Neocallimastix californiae
  GLHYDRLASE11
atacttcagtatccgtcaaactgctcgtga

SEQ ID NO: 23566 - DNA, 27 bp, Neocallimastix californiae
  GLHYDRLASE11
ggaaaaacttggtatgactatgggtaa

SEQ ID NO: 23567 - DNA, 21 bp, Neocallimastix californiae
  GLHYDRLASE11
tggtgctacctacactgttta

SEQ ID NO: 23568 - DNA, 33 bp, Neocallimastix californiae
  GLHYDRLASE11
acttgtcgaattctatgttgttgataactggct

SEQ ID NO: 23569 - DNA, 30 bp, Neocallimastix californiae
  GLHYDRLASE11
attcttcagtattcgtaaggaagctcgtga

SEQ ID NO: 23570 - DNA, 27 bp, Neocallimastix californiae
  GLHYDRLASE11
ggaaaaacttggaatgaaattaggtaa

SEQ ID NO: 23571 - DNA, 21 bp, Neocallimastix californiae
  GLHYDRLASE11
tggtgctaaatacacagttta

SEQ ID NO: 23572 - DNA, 27 bp, Neocallimastix californiae
  GLHYDRLASE11
ggaaaaacttggtatgaaattaggtaa

SEQ ID NO: 23573 - DNA, 33 bp, Neocallimastix californiae; identical to SEQ ID NO: 23563
  GLHYDRLASE11

SEQ ID NO: 23574 - DNA, 30 bp, Neocallimastix californiae
  GLHYDRLASE11
attcttcagtatccgtcaaactgctcgtga

SEQ ID NO: 23575 - DNA, 30 bp, Neocallimastix californiae
  GLHYDRLASE11
tgtcggtatttacggttggaccagaaatcc

SEQ ID NO: 23576 - DNA, 33 bp, Neocallimastix californiae
  GLHYDRLASE11
acttgttgaatactatgttgttgataactggct

SEQ ID NO: 23577 - DNA, 30 bp, Neocallimastix californiae
  GLHYDRLASE11
cattggtatttatggttggactcgtgaacc

SEQ ID NO: 23578 - DNA, 30 bp, Neocallimastix californiae
  GLHYDRLASE11
atacttcagtattcgtaaagaagctcgtga

SEQ ID NO: 23579 - DNA, 21 bp, Neocallimastix californiae
  GLHYDRLASE11
tggtgctgaatacactgttta

SEQ ID NO: 23580 - DNA, 33 bp, Neocallimastix californiae
  GLHYDRLASE11
acaaattgaatactatgttgttgatgactggtt

SEQ ID NO: 23581 - DNA, 21 bp, Neocallimastix californiae
  GLHYDRLASE11
tggtggtacatacaaggtttg

SEQ ID NO: 23582 - DNA, 30 bp, Neocallimastix californiae
  GLHYDRLASE11
cattggtatttacggttggatggataaccc

SEQ ID NO: 23583 - DNA, 27 bp, Neocallimastix californiae
  GLHYDRLASE11
ggaaaaattaggtcttagaattggtca

SEQ ID NO: 23584 - DNA, 18 bp, Neocallimastix californiae
  GLHYDRLASE11
atctactttcacacaaat

SEQ ID NO: 23585 - DNA, 30 bp, Neocallimastix californiae
  GLHYDRLASE11
aattttctccgttcgtacttcacaacgtca

SEQ ID NO: 23586 - DNA, 30 bp, Neocallimastix californiae; identical to SEQ ID NO: 23578
  GLHYDRLASE11

SEQ ID NO: 23587 - DNA, 33 bp, Neocallimastix californiae
  GLHYDRLASE11
acttgttgaatattatgttgttgataactggct

SEQ ID NO: 23588 - DNA, 21 bp, Neocallimastix californiae
  GLHYDRLASE11
tggtgctgaatatactgttta

SEQ ID NO: 23589 - DNA, 30 bp, Neocallimastix californiae; identical to SEQ ID NO: 23577
  GLHYDRLASE11

SEQ ID NO: 23590 - DNA, 27 bp, Neocallimastix californiae
  GLHYDRLASE11
ggaagaacttggtttaacccttggtaa

SEQ ID NO: 23591 - DNA, 21 bp, Neocallimastix californiae
  GLHYDRLASE11
tggtgatacttacgaaatttt

SEQ ID NO: 23592 - DNA, 18 bp, Neocallimastix californiae
  GLHYDRLASE11
ttcaaccttcccacaatt

SEQ ID NO: 23593 - DNA, 30 bp, Neocallimastix californiae
  GLHYDRLASE11
tattggtatctatggttggactgtcgatcc

SEQ ID NO: 23594 - DNA, 30 bp, Neocallimastix californiae
  GLHYDRLASE11
attcttcagtgttcgtcgtagtgctcgttc

SEQ ID NO: 23595 - DNA, 33 bp, Neocallimastix californiae
  GLHYDRLASE11
attagtagaatactatattgtagatgactggta

SEQ ID NO: 23596 - DNA, 27 bp, Neocallimastix californiae
  GLHYDRLASE11
ggaatccctcggtatgaaattaggtaa

SEQ ID NO: 23597 - DNA, 30 bp, Neocallimastix californiae
  GLHYDRLASE11
tgttggtgtttacggttggactagaaatcc

SEQ ID NO: 23598 - DNA, 21 bp, Neocallimastix californiae
  GLHYDRLASE11
tggtgctcaatatactgttta

SEQ ID NO: 23599 - DNA, 27 bp, Neocallimastix californiae
  GLHYDRLASE11
ggaaaaacttggtatgaaacttggtaa

SEQ ID NO: 23600 - DNA, 33 bp, Neocallimastix californiae
  GLHYDRLASE11
acttgttgaatattatattgtagataactggct

SEQ ID NO: 23601 - DNA, 30 bp, Neocallimastix californiae
  GLHYDRLASE11
atatttcagtattcgtcaacaagcacgtga

SEQ ID NO: 23602 - DNA, 30 bp, Neocallimastix californiae
  GLHYDRLASE11
atacttcagtcttcgtacaagtccacgtac

SEQ ID NO: 23603 - DNA, 27 bp, Neocallimastix californiae
  GLHYDRLASE11
ggaaaaaattggtttaaagatgggtaa

SEQ ID NO: 23604 - DNA, 33 bp, Neocallimastix californiae
  GLHYDRLASE11
tgtatttgaattttatattgttgataactggct

SEQ ID NO: 23605 - DNA, 30 bp, Neocallimastix californiae
  GLHYDRLASE11
cgttggtgtttacggatggactttaaattc

SEQ ID NO: 23606 - DNA, 30 bp, Anaeromyces robustus; identical to SEQ ID NO: 23593
  GLHYDRLASE11

SEQ ID NO: 23607 - DNA, 27 bp, Anaeromyces robustus
  GLHYDRLASE11
ggaatccctcggtatgaaattaggtaa

SEQ ID NO: 23608 - DNA, 21 bp, Anaeromyces robustus
  GLHYDRLASE11
tggtgatacttacgaaatttt

SEQ ID NO: 23609 - DNA, 30 bp, Anaeromyces robustus; identical to SEQ ID NO: 23594
  GLHYDRLASE11

SEQ ID NO: 23610 - DNA, 18 bp, Anaeromyces robustus
  GLHYDRLASE11
ttcaaccttcccacaatt

SEQ ID NO: 23611 - DNA, 33 bp, Anaeromyces robustus; identical to SEQ ID NO: 23595
  GLHYDRLASE11

SEQ ID NO: 23612 - DNA, 30 bp, Anaeromyces robustus; identical to SEQ ID NO: 23602
  GLHYDRLASE11

SEQ ID NO: 23613 - DNA, 33 bp, Anaeromyces robustus; identical to SEQ ID NO: 23604
  GLHYDRLASE11

SEQ ID NO: 23614 - DNA, 27 bp, Anaeromyces robustus
  GLHYDRLASE11
ggaaaaaattggtttaaagatgggtaa

SEQ ID NO: 23615 - DNA, 30 bp, Anaeromyces robustus; identical to SEQ ID NO: 23605
  GLHYDRLASE11

SEQ ID NO: 23616 - DNA, 30 bp, Anaeromyces robustus
  GLHYDRLASE11
cgttggtatttacggttggactagaaaccc

SEQ ID NO: 23617 - DNA, 21 bp, Anaeromyces robustus
  GLHYDRLASE11
tggtgctaaatatactgttta

SEQ ID NO: 23618 - DNA, 30 bp, Anaeromyces robustus
  GLHYDRLASE11
atacttcagtattcgtcaacaaccacgtga

SEQ ID NO: 23619 - DNA, 27 bp, Anaeromyces robustus
  GLHYDRLASE11
ggaaaaacttggtatgaccatgggtaa

SEQ ID NO: 23620 - DNA, 33 bp, Anaeromyces robustus; identical to SEQ ID NO: 23563
  GLHYDRLASE11

SEQ ID NO: 23621 - DNA, 30 bp, Anaeromyces robustus
  GLHYDRLASE11
atactttagtattcgtcaacaagctcgtga

SEQ ID NO: 23622 - DNA, 33 bp, Anaeromyces robustus
  GLHYDRLASE11
acttgttgaattctacgttgttgataattggct

SEQ ID NO: 23623 - DNA, 27 bp, Anaeromyces robustus
  GLHYDRLASE11
ggaaaaacttggtatgactatgggtaa

SEQ ID NO: 23624 - DNA, 30 bp, Anaeromyces robustus
  GLHYDRLASE11
tgtaggtatttacggttggactagaaaccc

SEQ ID NO: 23625 - DNA, 21 bp, Anaeromyces robustus
  GLHYDRLASE11
tggtgctaaatatactgttta

SEQ ID NO: 23626 - DNA, 30 bp, Anaeromyces robustus; identical to SEQ ID NO: 23624
  GLHYDRLASE11

SEQ ID NO: 23627 - DNA, 33 bp, Anaeromyces robustus; identical to SEQ ID NO: 23622
  GLHYDRLASE11

SEQ ID NO: 23628 - DNA, 27 bp, Anaeromyces robustus
  GLHYDRLASE11
ggaaaaacttggtatgactatgggtaa

SEQ ID NO: 23629 - DNA, 30 bp, Anaeromyces robustus; identical to SEQ ID NO: 23621
  GLHYDRLASE11

SEQ ID NO: 23630 - DNA, 21 bp, Anaeromyces robustus
  GLHYDRLASE11
tggtgctaaatatactgttta

SEQ ID NO: 23631 - DNA, 30 bp, Anaeromyces robustus
  GLHYDRLASE11
atatttcagtattcgtcaacaagctcgtga

SEQ ID NO: 23632 - DNA, 33 bp, Anaeromyces robustus
  GLHYDRLASE11
acttgttgaattttatattgtagataattggct

SEQ ID NO: 23633 - DNA, 30 bp, Anaeromyces robustus
  GLHYDRLASE11
tgttggtatttatggttggacaagaaatcc

SEQ ID NO: 23634 - DNA, 21 bp, Anaeromyces robustus
  GLHYDRLASE11
tggtgctaaatatactgttta

SEQ ID NO: 23635 - DNA, 27 bp, Anaeromyces robustus
  GLHYDRLASE11
ggaaaaattaggtatgcaaatgggtaa

SEQ ID NO: 23636 - DNA, 21 bp, Anaeromyces robustus
  GLHYDRLASE11
tggagctcaatataccgttta

SEQ ID NO: 23637 - DNA, 27 bp, Anaeromyces robustus
  GLHYDRLASE11
ggaaaaacttggtatgacacttggtaa

SEQ ID NO: 23638 - DNA, 30 bp, Anaeromyces robustus; identical to SEQ ID NO: 23601
  GLHYDRLASE11

SEQ ID NO: 23639 - DNA, 30 bp, Anaeromyces robustus
  GLHYDRLASE11
tgttggtatttatggttggactagaaatcc

SEQ ID NO: 23640 - DNA, 33 bp, Anaeromyces robustus
  GLHYDRLASE11
acttgttgaattttatgttgtagataactggct

SEQ ID NO: 23641 - DNA, 30 bp, Piromyces finnis
  GLHYDRLASE11
atacttcagtattcgtcaacaagctcgtga

SEQ ID NO: 23642 - DNA, 21 bp, Piromyces finnis
  GLHYDRLASE11
tggagctacttacactgttta

SEQ ID NO: 23643 - DNA, 33 bp, Piromyces finnis; identical to SEQ ID NO: 23563
  GLHYDRLASE11

SEQ ID NO: 23644 - DNA, 30 bp, Piromyces finnis
  GLHYDRLASE11
tgtaggtatttacggttggactagaagtcc

SEQ ID NO: 23645 - DNA, 27 bp, Piromyces finnis
  GLHYDRLASE11
ggctaaacttggtatgaatcttggtaa

SEQ ID NO: 23646 - DNA, 33 bp, Piromyces finnis; identical to SEQ ID NO: 23563
  GLHYDRLASE11

SEQ ID NO: 23647 - DNA, 30 bp, Piromyces finnis; identical to SEQ ID NO: 23644
  GLHYDRLASE11

SEQ ID NO: 23648 - DNA, 30 bp, Piromyces finnis; identical to SEQ ID NO: 23641
  GLHYDRLASE11

SEQ ID NO: 23649 - DNA, 27 bp, Piromyces finnis
  GLHYDRLASE11
ggaaaagcttggtatgaagcttggtaa

SEQ ID NO: 23650 - DNA, 21 bp, Piromyces finnis
  GLHYDRLASE11
tggagctacttacactgttta

SEQ ID NO: 23651 - DNA, 33 bp, Piromyces finnis; identical to SEQ ID NO: 23563
  GLHYDRLASE11

SEQ ID NO: 23652 - DNA, 30 bp, Piromyces finnis; identical to SEQ ID NO: 23644
  GLHYDRLASE11

SEQ ID NO: 23653 - DNA, 30 bp, Piromyces finnis; identical to SEQ ID NO: 23641
  GLHYDRLASE11

SEQ ID NO: 23654 - DNA, 27 bp, Piromyces finnis
  GLHYDRLASE11
ggaaaagcttggtatgaagcttggtaa

SEQ ID NO: 23655 - DNA, 21 bp, Piromyces finnis
  GLHYDRLASE11
tggagctacttacactgttta

SEQ ID NO: 23656 - DNA, 30 bp, Piromyces finnis
  GLHYDRLASE11
cgttggtatttacggttggaccagaaaccc

SEQ ID NO: 23657 - DNA, 21 bp, Piromyces finnis
  GLHYDRLASE11
tggtgctcaatacactgttta

SEQ ID NO: 23658 - DNA, 30 bp, Piromyces finnis; identical to SEQ ID NO: 23641
  GLHYDRLASE11

SEQ ID NO: 23659 - DNA, 33 bp, Piromyces finnis; identical to SEQ ID NO: 23563
  GLHYDRLASE11

SEQ ID NO: 23660 - DNA, 27 bp, Piromyces finnis
  GLHYDRLASE11
ggaaaagcttggtatgaagcttggtaa

SEQ ID NO: 23661 - DNA, 42 bp, Neocallimastix californiae
  GLHYDRLASE16
gcaaactaatttattcatttatggtaatggtggtcgtgaaca

SEQ ID NO: 23662 - DNA, 69 bp, Neocallimastix californiae
  GLHYDRLASE16
atgttactttattttaactaattggatgtgcgttggttgcgatggttggactggtccagctgattggtc

SEQ ID NO: 23663 - DNA, 57 bp, Neocallimastix californiae
  GLHYDRLASE16
tcgtatgagaactaatgttcgttacaagtctggtaagttcgaagttcgtgctaagat

SEQ ID NO: 23664 - DNA, 54 bp, Neocallimastix californiae
  GLHYDRLASE16
tgttttaaaggttgataaccaagttattcgtaccttcaataatccaatgccaca

SEQ ID NO: 23665 - DNA, 54 bp, Neocallimastix californiae
  GLHYDRLASE16
accaaccgatttatctaaagatttccacctttacacctttgaatggaattcaaa

SEQ ID NO: 23666 - DNA, 42 bp, Neocallimastix californiae
  GLHYDRLASE16
gcaaacaaacttattcattcatggtaatggtggtcgtgaaca

SEQ ID NO: 23667 - DNA, 57 bp, Neocallimastix californiae
  GLHYDRLASE16
tcgtatgagaaccaatgttcgttacaaatctggtaaatttgaagttcgtgctaagat

SEQ ID NO: 23668 - DNA, 69 bp, Neocallimastix californiae
  GLHYDRLASE16
aagttacttcattttaacgaattggatgtgtattggatgtgatggttggactggtcctgcagattggtc

SEQ ID NO: 23669 - DNA, 54 bp, Neocallimastix californiae
  GLHYDRLASE16
accaaccgatttatcgaaggacttccacctctacacctttgaatggagctctaa

SEQ ID NO: 23670 - DNA, 54 bp, Neocallimastix californiae
  GLHYDRLASE16
tgtcttgaaggtggataatgaagttattcgtaccttcaataatccaatgccaga

SEQ ID NO: 23671 - DNA, 54 bp, Anaeromyces robustus
  GLHYDRLASE16
cgttttaaaggttgataatcaagtcgttcgtaccttcaataatccaatgccaac

SEQ ID NO: 23672 - DNA, 42 bp, Anaeromyces robustus
  GLHYDRLASE16
gcaaactaatttattcattaatggtcaaggtggtcgtgaaga

SEQ ID NO: 23673 - DNA, 54 bp, Anaeromyces robustus
  GLHYDRLASE16
accttatgatttatctagagatttccatacttatacttttgaatggacttctaa

SEQ ID NO: 23674 - DNA, 57 bp, Anaeromyces robustus
  GLHYDRLASE16
tcgtatgagaactaatgttcgttacaagtctggtaagtttgaagttcgtgctaagat

SEQ ID NO: 23675 - DNA, 69 bp, Anaeromyces robustus
  GLHYDRLASE16
aagttacttcattttaactaattggatgtgtgttggttgtgatggatggactggtccagctgattggtc

SEQ ID NO: 23676 - DNA, 48 bp, Neocallimastix californiae
  GLHYDRLASE2
agaatcagcttactatgtttatgtcaatggacaagctgtcggatacag

SEQ ID NO: 23677 - DNA, 48 bp, Neocallimastix californiae
  GLHYDRLASE2
gaaaaataatccatcaatctttgcatggtctattggaaatgaaatggc

SEQ ID NO: 23678 - DNA, 48 bp, Neocallimastix californiae
  GLHYDRLASE2
gccttacatcatgtgtgaatatgatattgcttcaggtaatgctatagg

SEQ ID NO: 23679 - DNA, 45 bp, Neocallimastix californiae
  GLHYDRLASE2
caatggtaagagacttcttatcaagggtgtcaatcgtcatgattc

SEQ ID NO: 23680 - DNA, 57 bp, Neocallimastix californiae
  GLHYDRLASE2
tattgctctcatgaaaaagcataatattaatgccataagaacttctcattacagtaa

SEQ ID NO: 23681 - DNA, 57 bp, Neocallimastix californiae
  GLHYDRLASE2
tattactcttatgaaaactaacaacattaatgctattagaacttctcactacagtaa

SEQ ID NO: 23682 - DNA, 48 bp, Neocallimastix californiae
  GLHYDRLASE2
agaatctgcttattatgtttatgttaatggtcaagctattggttacag

SEQ ID NO: 23683 - DNA, 45 bp, Neocallimastix californiae
  GLHYDRLASE2
taatggtaaacgtcttcttcttaaaggtgttaaccgtcacgatac

SEQ ID NO: 23684 - DNA, 48 bp, Neocallimastix californiae
  GLHYDRLASE2
aaagaatcatccatctattgttgcttggtctattggtaatgaaatggc

SEQ ID NO: 23685 - DNA, 48 bp, Neocallimastix californiae
  GLHYDRLASE2
gccatacgttatgtgtgaatatgaccacgctatgggtaattctgttgg

SEQ ID NO: 23686 - DNA, 48 bp, Piromyces finnis
  GLHYDRLASE2
agaatctgcttattatgtttatgttaatggtcaaggtgttggttacag

SEQ ID NO: 23687 - DNA, 48 bp, Piromyces finnis
  GLHYDRLASE2
gccatatgttatgtgtgaatatgatcacgctatgggtaactcagttgg

SEQ ID NO: 23688 - DNA, 57 bp, Piromyces finnis
  GLHYDRLASE2
tattactttaatgaaaaagaataatattaatgccattagaacttcccactatagtaa

SEQ ID NO: 23689 - DNA, 45 bp, Piromyces finnis
  GLHYDRLASE2
aaatggtaaacgtcttcttcttaagggtgtaaatcgccacgacac

SEQ ID NO: 23690 - DNA, 48 bp, Piromyces finnis
  GLHYDRLASE2
aaagaataatccttccattgtagcatggtccattggaaatgaaatggc

SEQ ID NO: 23691 - DNA, 72 bp, Neocallimastix californiae
  GLHYDRLASE26
atggaaaatcttatatgaacgtatggttaactatcatggattaaataatttaatttggctttggaatggtaa

SEQ ID NO: 23692 - DNA, 39 bp, Neocallimastix californiae
  GLHYDRLASE26
aattgaatacattgatattattggtgttgatatctatgc

SEQ ID NO: 23693 - DNA, 54 bp, Neocallimastix californiae
  GLHYDRLASE26
attaatctggcgtcctcttcatgaaaataatggtgactggttctggtggggtaa

SEQ ID NO: 23694 - DNA, 45 bp, Neocallimastix californiae
  GLHYDRLASE26
gaaatatcaaggtaaaggaattatgtctgctcaatggcattggaa

SEQ ID NO: 23695 - DNA, 54 bp, Neocallimastix californiae
  GLHYDRLASE26
attaatctggcgtcctcttcatgaaaataatggagattggttctggtggggtaa

SEQ ID NO: 23696 - DNA, 72 bp, Neocallimastix californiae; identical to SEQ ID NO: 23691
  GLHYDRLASE26

SEQ ID NO: 23697 - DNA, 45 bp, Neocallimastix californiae; identical to SEQ ID NO: 23694
  GLHYDRLASE26

SEQ ID NO: 23698 - DNA, 39 bp, Neocallimastix californiae; identical to SEQ ID NO: 23692
  GLHYDRLASE26

SEQ ID NO: 23699 - DNA, 39 bp, Neocallimastix californiae
  GLHYDRLASE26
tgatgattacattgattacacttctattgatggttacaa

SEQ ID NO: 23700 - DNA, 54 bp, Neocallimastix californiae
  GLHYDRLASE26
aatttggcttcgtcctcttcatgaagccaatggtgattggtacacttggggtac

SEQ ID NO: 23701 - DNA, 39 bp, Neocallimastix californiae
  GLHYDRLASE26
agatgaatatgtcgacataatctcagaagatgtttatga

SEQ ID NO: 23702 - DNA, 45 bp, Neocallimastix californiae
  GLHYDRLASE26
gaaatatgaaggaaaaggaatattacatgctcagtggcattggaa

SEQ ID NO: 23703 - DNA, 72 bp, Neocallimastix californiae
  GLHYDRLASE26
gtataaaatgatgtatgaaagatttaccaaagttcataaattgaataatttaatatggtgttggaatggagg

SEQ ID NO: 23704 - DNA, 54 bp, Neocallimastix californiae
  GLHYDRLASE26
aattatttggagaccattacatgaagcttctggaggttggttttggtggggtgc

SEQ ID NO: 23705 - DNA, 72 bp, Anaeromyces robustus
  GLHYDRLASE26
atggaaaattttatatgaacgtatggttaattatcacggattaaataatttaatttggctttggaatggtaa

SEQ ID NO: 23706 - DNA, 54 bp, Anaeromyces robustus
  GLHYDRLASE26
attactttggcgtccacttcatgaaaataatggtgattggttctggtggggaaa

SEQ ID NO: 23707 - DNA, 45 bp, Anaeromyces robustus
  GLHYDRLASE26
aaaatatcaaggtaagggtattatgtctgctcaatggcattggaa

SEQ ID NO: 23708 - DNA, 39 bp, Anaeromyces robustus
  GLHYDRLASE26
aattgaatatatcgatttaattggtgttgatatttatgc

SEQ ID NO: 23709 - DNA, 54 bp, Piromyces finnis
  GLHYDRLASE26
tttaatatggagacctctccatgaaaacaatggtgattggttctggtggggtaa

SEQ ID NO: 23710 - DNA, 39 bp, Piromyces finnis
  GLHYDRLASE26
agttgactatattgatattattggtgttgatatttatgc

SEQ ID NO: 23711 - DNA, 72 bp, Piromyces finnis
  GLHYDRLASE26
atggaaaatcttatatgaacgtatggttaactatcacggtttaaacaatttaatttggctttggaatggtaa

SEQ ID NO: 23712 - DNA, 45 bp, Piromyces finnis
  GLHYDRLASE26
aaagtatgaaggaaaaggtattatggcagctcaatggcactggaa

SEQ ID NO: 23713 - DNA, 39 bp, Piromyces finnis; identical to SEQ ID NO: 23710
  GLHYDRLASE26

SEQ ID NO: 23714 - DNA, 54 bp, Piromyces finnis; identical to SEQ ID NO: 23709
  GLHYDRLASE26

SEQ ID NO: 23715 - DNA, 72 bp, Piromyces finnis; identical to SEQ ID NO: 23711
  GLHYDRLASE26

SEQ ID NO: 23716 - DNA, 45 bp, Piromyces finnis; identical to SEQ ID NO: 23712
  GLHYDRLASE26

SEQ ID NO: 23717 - DNA, 51 bp, Neocallimastix californiae
  GLHYDRLASE3
tgctggtagaaattgggaaggttatggtgaagatacctatcttgcttcagt

SEQ ID NO: 23718 - DNA, 51 bp, Neocallimastix californiae
  GLHYDRLASE3
ccttgctactattaagcactttgctggtaatgagcaagaaactaaccgtga

SEQ ID NO: 23719 - DNA, 60 bp, Neocallimastix californiae
  GLHYDRLASE3
accatctggtttaaatattgcttctacttttgatccagaaattatgaagaaaattggtgt

SEQ ID NO: 23720 - DNA, 51 bp, Neocallimastix californiae
  GLHYDRLASE3
attaggtttcaagggtatgtgtttccaagatggtccagctggtgttcgtag

SEQ ID NO: 23721 - DNA, 57 bp, Neocallimastix californiae
  GLHYDRLASE3
tttaaagaaacaaatgttattccatggtttcgttaccagtgactggtggggtactaa

SEQ ID NO: 23722 - DNA, 51 bp, Neocallimastix californiae
  GLHYDRLASE3
tattgtttccgcaaagcattatgttgctaatgatgttgaacacaatcgtga

SEQ ID NO: 23723 - DNA, 60 bp, Neocallimastix californiae
  GLHYDRLASE3
gcaagttggtattaataatgctgccacttttaataaggaattattatacaaaattggtaa

SEQ ID NO: 23724 - DNA, 57 bp, Neocallimastix californiae
  GLHYDRLASE3
tttaaaggaaaaaatgaatttccaaggttttgttatgtctgattggtgggctattca

SEQ ID NO: 23725 - DNA, 51 bp, Neocallimastix californiae
  GLHYDRLASE3
aaagaatttcaaaggtatatgtttacaggatggtccagcaggtgttcgttt

SEQ ID NO: 23726 - DNA, 51 bp, Neocallimastix californiae
  GLHYDRLASE3
ttctggaagagtttgggaaaactttggtgaagatccatatttatctggtgt

SEQ ID NO: 23727 - DNA, 51 bp, Neocallimastix californiae
  GLHYDRLASE3
attagacttcaaaggtatgtgcttacaagatggtccagctggtgttcgtaa

SEQ ID NO: 23728 - DNA, 57 bp, Neocallimastix californiae
  GLHYDRLASE3
cttaaagaagcaaatgatgttccacggttttgtcaccagtgattggtggggtactaa

SEQ ID NO: 23729 - DNA, 51 bp, Neocallimastix californiae
  GLHYDRLASE3
acttgctacagttaaacactttgccggtaatgaacaagaaacaagacgtga

SEQ ID NO: 23730 - DNA, 60 bp, Neocallimastix californiae
  GLHYDRLASE3
cccctcaggtttaaatattgcttcaacatttgatccagaaattatgaagaaacttggtgt

SEQ ID NO: 23731 - DNA, 51 bp, Neocallimastix californiae
  GLHYDRLASE3
tgctggtagaaattgggaaggttatggtgaagatacttaccttgcttcagt

SEQ ID NO: 23732 - DNA, 51 bp, Neocallimastix californiae
  GLHYDRLASE3
attaggtttcaagggtctctgtttacaagatggtccagctggtgtacgttc

SEQ ID NO: 23733 - DNA, 60 bp, Neocallimastix californiae
  GLHYDRLASE3
cccatctggtttaaatattgcctctacatttgacccagaactcatgaaaagtcttggtgt

SEQ ID NO: 23734 - DNA, 51 bp, Neocallimastix californiae
  GLHYDRLASE3
tggtggtagaaattgggaaggttatggtgaagatacttatcttgcttcagt

SEQ ID NO: 23735 - DNA, 51 bp, Neocallimastix californiae
  GLHYDRLASE3
tattgctaccattaaacactttgttggtaatgaacaagaaactaaacgtga

SEQ ID NO: 23736 - DNA, 57 bp, Neocallimastix californiae
  GLHYDRLASE3
tttaaagaagcaaatgttattccacggtttcgttacaagtgactggtggggtgttaa

SEQ ID NO: 23737 - DNA, 51 bp, Anaeromyces robustus; identical to SEQ ID NO: 23735
  GLHYDRLASE3

SEQ ID NO: 23738 - DNA, 51 bp, Anaeromyces robustus; identical to SEQ ID NO: 23732
  GLHYDRLASE3

SEQ ID NO: 23739 - DNA, 60 bp, Anaeromyces robustus; identical to SEQ ID NO: 23733
  GLHYDRLASE3

SEQ ID NO: 23740 - DNA, 57 bp, Anaeromyces robustus; identical to SEQ ID NO: 23736
  GLHYDRLASE3

SEQ ID NO: 23741 - DNA, 51 bp, Anaeromyces robustus; identical to SEQ ID NO: 23734
  GLHYDRLASE3

SEQ ID NO: 23742 - DNA, 51 bp, Anaeromyces robustus
  GLHYDRLASE3
tattgtttcagctaaacactatgttgctaatgatattgaacataatcgtga

SEQ ID NO: 23743 - DNA, 57 bp, Anaeromyces robustus
  GLHYDRLASE3
cttaaaggaaggaatgaacttccaaggtttcattgtttctgattggtgggctattca

SEQ ID NO: 23744 - DNA, 51 bp, Anaeromyces robustus
  GLHYDRLASE3
aaaaaattttaagggtttatgtcttcaagatggtccagccggtgttcgttt

SEQ ID NO: 23745 - DNA, 60 bp, Anaeromyces robustus
  GLHYDRLASE3
gcaaactggtattaacagtgcagccacttttaataaggatttattatataaaattggtaa

SEQ ID NO: 23746 - DNA, 51 bp, Anaeromyces robustus
  GLHYDRLASE3
ttctggtagagtttgggaaaactttggtgaagatccatatttatcaggtgt

SEQ ID NO: 23747 - DNA, 51 bp, Piromyces finnis
  GLHYDRLASE3
tgctggtagaaactgggaaggttatggtgaagatactttcctcgctactgt

SEQ ID NO: 23748 - DNA, 57 bp, Piromyces finnis
  GLHYDRLASE3
tttaaagaagcaatttaaattccacggttttgtcactagtgactggtggggtactaa

SEQ ID NO: 23749 - DNA, 51 bp, Piromyces finnis
  GLHYDRLASE3
attaggtttcaaaggtttatgtttacaagatggtccagctggtgttcgttc

SEQ ID NO: 23750 - DNA, 60 bp, Piromyces finnis
  GLHYDRLASE3
cccatctggtttaaatattgcttctacttttgatcaaaatcttatgaagaaacttggtgt

SEQ ID NO: 23751 - DNA, 51 bp, Piromyces finnis
  GLHYDRLASE3
ttttgctactgctaagcactttgctggtaatgaacaagaatacaagcgtga

SEQ ID NO: 23752 - DNA, 51 bp, Piromyces finnis; identical to SEQ ID NO: 23747
  GLHYDRLASE3

SEQ ID NO: 23753 - DNA, 57 bp, Piromyces finnis; identical to SEQ ID NO: 23748
  GLHYDRLASE3

SEQ ID NO: 23754 - DNA, 51 bp, Piromyces finnis; identical to SEQ ID NO: 23749
  GLHYDRLASE3

SEQ ID NO: 23755 - DNA, 60 bp, Piromyces finnis; identical to SEQ ID NO: 23750
  GLHYDRLASE3

SEQ ID NO: 23756 - DNA, 51 bp, Piromyces finnis; identical to SEQ ID NO: 23751
  GLHYDRLASE3

SEQ ID NO: 23757 - DNA, 63 bp, Neocallimastix californiae
  GLHYDRLASE48
agttgtccatgctaccaacttagaatggactggtaacccagatgaatggaagtcctccaactt

SEQ ID NO: 23758 - DNA, 75 bp, Neocallimastix californiae
  GLHYDRLASE48
cttcattaacactttccaacgtggtgcctctgaatccgcttggaaaactgttccacacccatgttgggaatccat

SEQ ID NO: 23759 - DNA, 87 bp, Neocallimastix californiae
  GLHYDRLASE48
ttggactggtaagaatgctcaaggtgctaacatcagaagtggtgttaagttcattgatattcgtccaaagtacaaggaagatccaga

SEQ ID NO: 23760 - DNA, 81 bp, Neocallimastix californiae
  GLHYDRLASE48
agtttaccacgacccaccatccaacaactggactggtatgcaaggttggggtatggaacgtgtctgttccctttactacct

SEQ ID NO: 23761 - DNA, 54 bp, Neocallimastix californiae
  GLHYDRLASE48
cttctgggtttggttagaagctgttaacggtaagcttactggtaactatgatgg

SEQ ID NO: 23762 - DNA, 78 bp, Neocallimastix californiae
  GLHYDRLASE48
tgttccataccactcaattgaaactatgatggttgaagctccagatcatggtcacgaatctgtctctgaaacttactc

SEQ ID NO: 23763 - DNA, 72 bp, Neocallimastix californiae
  GLHYDRLASE48
tcaattagaattattcagatggttacaatctgctgaaggttgtattgctggtggtgccactaactcatggca

SEQ ID NO: 23764 - DNA, 84 bp, Neocallimastix californiae
  GLHYDRLASE48
gcaatggagatacactgctgctccagatgctgatgctcgtgctattcaagctgcttacttcggttacatctgggctgaagaaga

SEQ ID NO: 23765 - DNA, 60 bp, Neocallimastix californiae
  GLHYDRLASE48
tggtaagaactctgctcactaccttatctcttggtacttcgcctggggtggaggtttaca

SEQ ID NO: 23766 - DNA, 84 bp, Neocallimastix californiae; identical to SEQ ID NO: 23764
  GLHYDRLASE48

SEQ ID NO: 23767 - DNA, 54 bp, Neocallimastix californiae
  GLHYDRLASE48
cttctgggtttggttagaagctgttaacggtaaacttactggtaattacgaagg

SEQ ID NO: 23768 - DNA, 87 bp, Neocallimastix californiae
  GLHYDRLASE48
ttggtctggtaagaacgctcaaggtgctcaacttaagagtggtatcaaattcattgatattcgtccaaagtacaaggaagatccaga

SEQ ID NO: 23769 - DNA, 75 bp, Neocallimastix californiae
  GLHYDRLASE48
cttcattaacactttccaacgtggtgcctctgaatccgcttggaaaactgttccacatccatgttgggaaaccat

SEQ ID NO: 23770 - DNA, 60 bp, Neocallimastix californiae; identical to SEQ ID NO: 23765
  GLHYDRLASE48

SEQ ID NO: 23771 - DNA, 72 bp, Neocallimastix californiae; identical to SEQ ID NO: 23763
  GLHYDRLASE48

SEQ ID NO: 23772 - DNA, 81 bp, Neocallimastix californiae; identical to SEQ ID NO: 23760
  GLHYDRLASE48

SEQ ID NO: 23773 - DNA, 63 bp, Neocallimastix californiae
  GLHYDRLASE48
agttgtccacgctaccaacttagaatggtctggtaacccagatgaatggaatgcttccaactt

SEQ ID NO: 23774 - DNA, 78 bp, Neocallimastix californiae
  GLHYDRLASE48
tgttccataccactccattgaaactatgatggttgaagctccagatcaaggtcacgaatctgtatctgaaacttactc

SEQ ID NO: 23775 - DNA, 81 bp, Neocallimastix californiae; identical to SEQ ID NO: 23760
  GLHYDRLASE48

SEQ ID NO: 23776 - DNA, 63 bp, Neocallimastix californiae
  GLHYDRLASE48
aattgtccatgctactaacttagaatggtctggtaatccagatgaatggaaatcttctaactt

SEQ ID NO: 23777 - DNA, 72 bp, Neocallimastix californiae; identical to SEQ ID NO: 23763
  GLHYDRLASE48

SEQ ID NO: 23778 - DNA, 60 bp, Neocallimastix californiae; identical to SEQ ID NO: 23765
  GLHYDRLASE48

SEQ ID NO: 23779 - DNA, 87 bp, Neocallimastix californiae
  GLHYDRLASE48
atggtcaggtaagaacgctcaaggtgccaatattaagagtggagtcaagttcattgatattcgtccaaagtacaaggaagataagga

SEQ ID NO: 23780 - DNA, 81 bp, Neocallimastix californiae; identical to SEQ ID NO: 23760
  GLHYDRLASE48

SEQ ID NO: 23781 - DNA, 63 bp, Neocallimastix californiae
  GLHYDRLASE48
aattgtccatgctaccaacttagcctggactggtaacccagatgaatggaagtcctccaactt

SEQ ID NO: 23782 - DNA, 87 bp, Neocallimastix californiae; identical to SEQ ID NO: 23759
  GLHYDRLASE48

SEQ ID NO: 23783 - DNA, 81 bp, Neocallimastix californiae
  GLHYDRLASE48
agtttaccacgatccaccatccaacaactggactggtatgcaaggttggggtatggaacgtgtttgttctctctactacct

SEQ ID NO: 23784 - DNA, 54 bp, Neocallimastix californiae
  GLHYDRLASE48
tttctggatttggttagaagccgttaatggtaagattaccggtaactacgatgg

SEQ ID NO: 23785 - DNA, 78 bp, Neocallimastix californiae
  GLHYDRLASE48
ggttccatatcactccgttgaaactcttatggttgaagctccagatcatggtcatgaatctgtatctgaaactttctc

SEQ ID NO: 23786 - DNA, 87 bp, Neocallimastix californiae
  GLHYDRLASE48
atggagtggtaagaatgctcaaggtgctaacattagaaatggagttactttcattgatattcgtccaaaatataagcaagatccaga

SEQ ID NO: 23787 - DNA, 60 bp, Neocallimastix californiae
  GLHYDRLASE48
tggtaagaattcagctcactatcttatttcatggtacttcgcttggggtggaggtttaca

SEQ ID NO: 23788 - DNA, 63 bp, Neocallimastix californiae
  GLHYDRLASE48
agttgtccatgctactaacttagaatggtcaggtaatccagatgaatggaattcttccaactt

SEQ ID NO: 23789 - DNA, 75 bp, Neocallimastix californiae
  GLHYDRLASE48
tttcattaacaccttccaacgtggtccttccgaatctacttggaagactgttccacatccatgttgggaatccat

SEQ ID NO: 23790 - DNA, 84 bp, Neocallimastix californiae
  GLHYDRLASE48
acaatggagatacactgcagctccagatgctgatgctcgtgccattcaagctgcttacttcgcttacatttgggctgaagaaga

SEQ ID NO: 23791 - DNA, 72 bp, Neocallimastix californiae
  GLHYDRLASE48
tcaattagaattattcagatggttacaatcagctgaaggttgtattgctggtggagccactaactcatggca

SEQ ID NO: 23792 - DNA, 87 bp, Neocallimastix californiae
  GLHYDRLASE48
atggtctggtaagaacgctcaaggtgcaaacattaagaatggtgttactttcattgatattcgtccaaaatacaaacaagatcctga

SEQ ID NO: 23793 - DNA, 75 bp, Neocallimastix californiae
  GLHYDRLASE48
tttcattaacactttccaacgtggtgcttccgaatctgcttggaagactgttccacatccatgttgggaaacatt

SEQ ID NO: 23794 - DNA, 84 bp, Neocallimastix californiae
  GLHYDRLASE48
gcaatggagatacactgatgcaccagatgctgatgctcgtgctattcaaggtgcttactttgcttggctttgggctaaggagga

SEQ ID NO: 23795 - DNA, 78 bp, Neocallimastix californiae
  GLHYDRLASE48
tgttccataccactctattgaaactcttatggttgaagctccagatcaaggtcacgaatctgtatctgaaactttttc

SEQ ID NO: 23796 - DNA, 72 bp, Neocallimastix californiae
  GLHYDRLASE48
tcaaatagaattattcagatggttacaaacttctgaaggttgtattgctggtggtgccaccaattcatggca

SEQ ID NO: 23797 - DNA, 63 bp, Neocallimastix californiae
  GLHYDRLASE48
aattgttcatgctactaacctttcctgggaaggtagtccagatgaatggaattcttcaaactt

SEQ ID NO: 23798 - DNA, 81 bp, Neocallimastix californiae
  GLHYDRLASE48
agtttaccacgacccaccatccaataactggactggtatgcaaggttggggtatggaacgtacttgttgttactattacct

SEQ ID NO: 23799 - DNA, 54 bp, Neocallimastix californiae
  GLHYDRLASE48
tttctgggtttggttagaagccgttaatggtaaacttacaggtgattactcggg

SEQ ID NO: 23800 - DNA, 60 bp, Neocallimastix californiae
  GLHYDRLASE48
tggtaagaattcagctcactaccttatttcatggtacttctcatggggtggtggtttaca

SEQ ID NO: 23801 - DNA, 63 bp, Neocallimastix californiae
  GLHYDRLASE48
agttgttcatgccactaacttagaatggacaggtaatccagatgaatggaaatcttcaaactt

SEQ ID NO: 23802 - DNA, 87 bp, Neocallimastix californiae
  GLHYDRLASE48
ttggactggtaagaacgctcaaggtgctaacatcagaagtggtgttaagttcattgatattcgtccaaaatacaagcaagataagga

SEQ ID NO: 23803 - DNA, 84 bp, Neocallimastix californiae
  GLHYDRLASE48
gcaatggagatacactgctgctccagatgctgatgctcgtgctattcaagctgcctactttggttatatttgggctaaagaaga

SEQ ID NO: 23804 - DNA, 78 bp, Neocallimastix californiae
  GLHYDRLASE48
tgttccataccactcaattgaaactatgatggttgaagctccagatcatggtcatgaatctgtatctgaaacttactc

SEQ ID NO: 23805 - DNA, 54 bp, Neocallimastix californiae
  GLHYDRLASE48
cttctgggtttggttagaagcagttcatggtaaacttactggtaactatgatgg

SEQ ID NO: 23806 - DNA, 75 bp, Neocallimastix californiae
  GLHYDRLASE48
tttcattaacaccttccaacgtggtgcctctgaatcagcatggaagactgttccacacccatgttgggaaactat

SEQ ID NO: 23807 - DNA, 72 bp, Neocallimastix californiae
  GLHYDRLASE48
tcaattagaattattcagatggttacaatctgctgaaggttgtattgctggtggagccaccaactcatggca

SEQ ID NO: 23808 - DNA, 60 bp, Neocallimastix californiae
  GLHYDRLASE48
cggtaagaactctgctcactaccttatctcatggtactttgcctggggtggaggtattca

SEQ ID NO: 23809 - DNA, 81 bp, Neocallimastix californiae
  GLHYDRLASE48
agtttaccacgatccaccatccaacaattggactggtatgcaaggttggggtatggaacgtgtctgttccctttactacct

SEQ ID NO: 23810 - DNA, 81 bp, Neocallimastix californiae; identical to SEQ ID NO: 23809
  GLHYDRLASE48

SEQ ID NO: 23811 - DNA, 87 bp, Neocallimastix californiae; identical to SEQ ID NO: 23802
  GLHYDRLASE48

SEQ ID NO: 23812 - DNA, 63 bp, Neocallimastix californiae; identical to SEQ ID NO: 23801
  GLHYDRLASE48

SEQ ID NO: 23813 - DNA, 63 bp, Neocallimastix californiae
  GLHYDRLASE48
aattgttcatgccactaacttcgaatggtccggtaacccagatgaatggaaggcctccaactt

SEQ ID NO: 23814 - DNA, 60 bp, Neocallimastix californiae
  GLHYDRLASE48
tggcaaaaactctgctcactaccttatttcttggtacttctcttggggtggtggtctcca

SEQ ID NO: 23815 - DNA, 72 bp, Neocallimastix californiae
  GLHYDRLASE48
tcaattagaattattcagatggttacaagctgccgaaggttgtattgctggtggtgccactaactcatggca

SEQ ID NO: 23816 - DNA, 54 bp, Neocallimastix californiae
  GLHYDRLASE48
cttctgggtttggttagaagctattaatggtaagatgactggtgattacaaggg

SEQ ID NO: 23817 - DNA, 78 bp, Neocallimastix californiae
  GLHYDRLASE48
tgttccataccactcaattgaaaccatgatggttgaagctccagattacggtcatgaatctgtttctgaaacttattc

SEQ ID NO: 23818 - DNA, 84 bp, Neocallimastix californiae
  GLHYDRLASE48
acaatggagatacactgctgctccagatgctgattctcgtgctattcaagctgcttactttgcttacatctgggctaaagaaga

SEQ ID NO: 23819 - DNA, 87 bp, Neocallimastix californiae
  GLHYDRLASE48
ttggactggtaagaatgctcaaggtgctaacatcagaaatggtgtgaagttcattgatattcgtccaaagtataaggaagatccaga

SEQ ID NO: 23820 - DNA, 75 bp, Neocallimastix californiae
  GLHYDRLASE48
cttcattaatactttccaacgtggtgcctctgaatccgcttggaaaactgttccacacccatgttgggaagaaat

SEQ ID NO: 23821 - DNA, 81 bp, Neocallimastix californiae
  GLHYDRLASE48
agtttaccacgatccaccatccaacaactggactggtatgcaaggttggggtatggaacgtgtctgttctctttactacct

SEQ ID NO: 23822 - DNA, 60 bp, Neocallimastix californiae
  GLHYDRLASE48
tggtaagaattctgctcactatcttatttcttggtacttctcttggggtggtggtttaca

SEQ ID NO: 23823 - DNA, 81 bp, Neocallimastix californiae
  GLHYDRLASE48
agtttaccacgatccaccatctaacaactggactggtatgcaaggttggggtatggaacgtgtctgttccctttactacct

SEQ ID NO: 23824 - DNA, 54 bp, Neocallimastix californiae
  GLHYDRLASE48
cttctgggtttggttagaagctattaatggtaagatgaccggtgattacaaagg

SEQ ID NO: 23825 - DNA, 75 bp, Neocallimastix californiae
  GLHYDRLASE48
cttcattaacaccttccaacgtggtgcttcagaatctgcttggaagactgttccacacccatgttgggaaaccat

SEQ ID NO: 23826 - DNA, 84 bp, Neocallimastix californiae
  GLHYDRLASE48
gcaatggagatacactgctgctccagatgctgatgctcgtgctattcaagctgcttacttcgcctacatttgggctaaggaaga

SEQ ID NO: 23827 - DNA, 78 bp, Neocallimastix californiae
  GLHYDRLASE48
tgttccataccactctgttgaaaccatgatggttgaagctccagattatggtcatgaatccgtttctgaaacttattc

SEQ ID NO: 23828 - DNA, 63 bp, Neocallimastix californiae
  GLHYDRLASE48
aattactcatgctactaacttctcctggtccggtaaccctgacgaatggaatccaagtaattt

SEQ ID NO: 23829 - DNA, 87 bp, Neocallimastix californiae
  GLHYDRLASE48
atggactggtaagaatgctcaaggtgccacccttgaacatggtgttaagtttattgatattcgtccaaaatacaaacaagataagga

SEQ ID NO: 23830 - DNA, 72 bp, Neocallimastix californiae
  GLHYDRLASE48
tcaattagaattattcagatggttacaagcttctgaaggttgtattgcaggtggtgccacaaattcatggca

SEQ ID NO: 23831 - DNA, 72 bp, Neocallimastix californiae
  GLHYDRLASE48
tcaattagaattattcagatggttacaagcttctgaaggttgtattgctggtggtgccactaactcatggca

SEQ ID NO: 23832 - DNA, 87 bp, Neocallimastix californiae
  GLHYDRLASE48
ttggactggtaagaatgctcaaggtgctaacattcgtagtggtgttactttcattgatattcgtccaaaatacaagcaagatccaga

SEQ ID NO: 23833 - DNA, 81 bp, Neocallimastix californiae
  GLHYDRLASE48
agtttaccacgatccaccatcaaacaactggactggtatgcaaggttggggtatggaacgtgtctgttctctttactacat

SEQ ID NO: 23834 - DNA, 84 bp, Neocallimastix californiae
  GLHYDRLASE48
gcaatggagatacactgctgctccagatgctgatgctcgtgctattcaagctgcttacttcggttacatgtgggctgaagaaga

SEQ ID NO: 23835 - DNA, 78 bp, Neocallimastix californiae
  GLHYDRLASE48
tgttccatatcactcaattgaaactcttatggttgaagctccagatcatggtcacgaatctgtatctgaaacttactc

SEQ ID NO: 23836 - DNA, 63 bp, Neocallimastix californiae
  GLHYDRLASE48
agttattcactccactaaccttgaatggtctggtaacccagatgaatggaacagcaacaactt

SEQ ID NO: 23837 - DNA, 54 bp, Neocallimastix californiae
  GLHYDRLASE48
tttctggatctggttagaagctgttaacggtaaacttactggtaactacgacgg

SEQ ID NO: 23838 - DNA, 75 bp, Neocallimastix californiae
  GLHYDRLASE48
tttcattaacactttccaacgtggttcttctgaatctacttggaagactgttccacacccatgttgggaagaatt

SEQ ID NO: 23839 - DNA, 60 bp, Neocallimastix californiae
  GLHYDRLASE48
tggtaagaactctgctcactaccttatctcctggtacttcgcttggggtggtggtttaca

SEQ ID NO: 23840 - DNA, 84 bp, Neocallimastix californiae
  GLHYDRLASE48
gcaatggagatacactgctgctccagatgctgatgctcgtgctattcaagctgcttacttcggttacatttgggctgaagaaga

SEQ ID NO: 23841 - DNA, 72 bp, Neocallimastix californiae
  GLHYDRLASE48
tcaattagaattaattagatggttacaagctactgaaggttgtattgctggtggtgccactaattcatggca

SEQ ID NO: 23842 - DNA, 87 bp, Neocallimastix californiae
  GLHYDRLASE48
ttggactggtaagaatgctcaaggtgctaaccttaagagtggtgttactttcattgatattcgtccaaaatacaagcaagatccaga

SEQ ID NO: 23843 - DNA, 54 bp, Neocallimastix californiae
  GLHYDRLASE48
cttctggatctggttagaagctgttaacggtaagcttactggtaactacgacgg

SEQ ID NO: 23844 - DNA, 75 bp, Neocallimastix californiae
  GLHYDRLASE48
tttcattaacactttccaacgtggtgcttctgaatctacttggaagactgttccacatccatcttgggaagaatt

SEQ ID NO: 23845 - DNA, 60 bp, Neocallimastix californiae; identical to SEQ ID NO: 23839
  GLHYDRLASE48

SEQ ID NO: 23846 - DNA, 63 bp, Neocallimastix californiae
  GLHYDRLASE48
agtaattcacgctactaaccttgaatggtctggtaacccagatgaatggaacaagaacaactt

SEQ ID NO: 23847 - DNA, 78 bp, Neocallimastix californiae
  GLHYDRLASE48
tgttccatatcactcaattgaaactcttatggttgaagctccagatcacggtcacgaatctgtatctgaaacttactc

SEQ ID NO: 23848 - DNA, 81 bp, Neocallimastix californiae
  GLHYDRLASE48
agtttaccacgatccaccatcaaacaactggactggtatgcaaggttggggtatggaacgtacttgttctctttactacgt

SEQ ID NO: 23849 - DNA, 75 bp, Neocallimastix californiae; identical to SEQ ID NO: 23838
  GLHYDRLASE48

SEQ ID NO: 23850 - DNA, 72 bp, Neocallimastix californiae; identical to SEQ ID NO: 23831
  GLHYDRLASE48

SEQ ID NO: 23851 - DNA, 60 bp, Neocallimastix californiae; identical to SEQ ID NO: 23839
  GLHYDRLASE48

SEQ ID NO: 23852 - DNA, 81 bp, Neocallimastix californiae
  GLHYDRLASE48
agtttaccacgatccaccatcaaacaattggactggtatgcaaggttggggtatggaacgtgtctgttctctttactacgt

SEQ ID NO: 23853 - DNA, 87 bp, Neocallimastix californiae
  GLHYDRLASE48
ttggactggtaagaacgctcaaggtgctaaccttaagagtggtgttactttcattgacattcgtccaaaatacaagcaagatccaga

SEQ ID NO: 23854 - DNA, 84 bp, Neocallimastix californiae; identical to SEQ ID NO: 23840
  GLHYDRLASE48

SEQ ID NO: 23855 - DNA, 63 bp, Neocallimastix californiae
  GLHYDRLASE48
agtagttcacgctactaaccttgaatggtctggtaacccagatgaatggaacaagagcaactt

SEQ ID NO: 23856 - DNA, 63 bp, Neocallimastix californiae; identical to SEQ ID NO: 23855
  GLHYDRLASE48

SEQ ID NO: 23857 - DNA, 75 bp, Neocallimastix californiae; identical to SEQ ID NO: 23838
  GLHYDRLASE48

SEQ ID NO: 23858 - DNA, 87 bp, Neocallimastix californiae; identical to SEQ ID NO: 23853
  GLHYDRLASE48

SEQ ID NO: 23859 - DNA, 72 bp, Neocallimastix californiae; identical to SEQ ID NO: 23831
  GLHYDRLASE48

SEQ ID NO: 23860 - DNA, 84 bp, Neocallimastix californiae; identical to SEQ ID NO: 23840
  GLHYDRLASE48

SEQ ID NO: 23861 - DNA, 81 bp, Neocallimastix californiae; identical to SEQ ID NO: 23852
  GLHYDRLASE48

SEQ ID NO: 23862 - DNA, 60 bp, Neocallimastix californiae; identical to SEQ ID NO: 23839
  GLHYDRLASE48

SEQ ID NO: 23863 - DNA, 63 bp, Neocallimastix californiae
  GLHYDRLASE48
ttttagaataccaaatagattatcatttgaaggtcaacctgaaaaatggataccaaatacgaa

SEQ ID NO: 23864 - DNA, 87 bp, Neocallimastix californiae
  GLHYDRLASE48
ttttaaaggtgtttatggtagatctacaaaaattaatgataaatctagtttcttgtcaatccgtccatactataaacgcgataaaaa

SEQ ID NO: 23865 - DNA, 72 bp, Neocallimastix californiae
  GLHYDRLASE48
gcaaatagaatttattcgttggttacaaagttcagaaggagccattgttggaaatgctatttatatatcaag

SEQ ID NO: 23866 - DNA, 54 bp, Neocallimastix californiae
  GLHYDRLASE48
atataaactttggatagaagcaatacaagggaaaatatcaggaaaatggaaatc

SEQ ID NO: 23867 - DNA, 87 bp, Neocallimastix californiae
  GLHYDRLASE48
atggactggtaagaatgctcaaggtgctaacatcaggagtggagttaagttcattgatatccgtccaaaatacaaggaagatccaga

SEQ ID NO: 23868 - DNA, 75 bp, Neocallimastix californiae
  GLHYDRLASE48
ctttattaacactttccaacgtggtgcctctgaatccgcttggaaaactgttccacacccatgttgggaagaaat

SEQ ID NO: 23869 - DNA, 81 bp, Neocallimastix californiae
  GLHYDRLASE48
agtttaccatgatccaccatccaacaactggactggtatgcaaggttggggtatggaacgtgtctgttccctttacttcat

SEQ ID NO: 23870 - DNA, 78 bp, Neocallimastix californiae
  GLHYDRLASE48
tgttccataccactcaatcgaaactatgatggttgaagctccagattacggtcatgaatctgtttctgaaacttattc

SEQ ID NO: 23871 - DNA, 84 bp, Neocallimastix californiae
  GLHYDRLASE48
gcaatggagatacactgctgctccagatgctgatgctcgtgctattcaagctgcttatttcgcttatatttgggctgaagaaga

SEQ ID NO: 23872 - DNA, 60 bp, Neocallimastix californiae
  GLHYDRLASE48
tggtaagaactctgctcactaccttatttcctggtacttctcttggggtggtggtttaca

SEQ ID NO: 23873 - DNA, 54 bp, Neocallimastix californiae
  GLHYDRLASE48
cttctgggtttggttagaagctattaatggtaagatgaccggtaattacaaggg

SEQ ID NO: 23874 - DNA, 72 bp, Neocallimastix californiae
  GLHYDRLASE48
tcaattagaattattcagatggttacaagctgctgaaggttgtattgctggtggtgctactaactcatggca

SEQ ID NO: 23875 - DNA, 63 bp, Neocallimastix californiae
  GLHYDRLASE48
aattgttcacgctactaacttcgaatggtctggtaacccagatgaatggaagccttctaactt

SEQ ID NO: 23876 - DNA, 72 bp, Anaeromyces robustus; identical to SEQ ID NO: 23831
  GLHYDRLASE48

SEQ ID NO: 23877 - DNA, 81 bp, Anaeromyces robustus; identical to SEQ ID NO: 23833
  GLHYDRLASE48

SEQ ID NO: 23878 - DNA, 60 bp, Anaeromyces robustus; identical to SEQ ID NO: 23839
  GLHYDRLASE48

SEQ ID NO: 23879 - DNA, 63 bp, Anaeromyces robustus; identical to SEQ ID NO: 23836
  GLHYDRLASE48

SEQ ID NO: 23880 - DNA, 60 bp, Anaeromyces robustus; identical to SEQ ID NO: 23839
  GLHYDRLASE48

SEQ ID NO: 23881 - DNA, 87 bp, Anaeromyces robustus; identical to SEQ ID NO: 23842
  GLHYDRLASE48

SEQ ID NO: 23882 - DNA, 81 bp, Anaeromyces robustus; identical to SEQ ID NO: 23848
  GLHYDRLASE48

SEQ ID NO: 23883 - DNA, 72 bp, Anaeromyces robustus; identical to SEQ ID NO: 23841
  GLHYDRLASE48

SEQ ID NO: 23884 - DNA, 63 bp, Anaeromyces robustus; identical to SEQ ID NO: 23846
  GLHYDRLASE48

SEQ ID NO: 23885 - DNA, 72 bp, Anaeromyces robustus
  GLHYDRLASE48
tcaattagaattattcagatggttacaatcttctgaaggttgtattgctggtggtgccactaactcatggca

SEQ ID NO: 23886 - DNA, 75 bp, Anaeromyces robustus
  GLHYDRLASE48
tttcattaacactttccaacgtggttcctctgaatctacttggaaaactattccacatccatgttgggaagaatt

SEQ ID NO: 23887 - DNA, 87 bp, Anaeromyces robustus
  GLHYDRLASE48
ttggactggtaagaatgctcaaggtgctaacattaagaatggtgttactttcattgatattcgtccaaagtataaacaagatccaga

SEQ ID NO: 23888 - DNA, 78 bp, Anaeromyces robustus
  GLHYDRLASE48
agttccatatcactctgttgaaactcttatggtagaagctccagatcatggtcacgaatctgtatctgaaacttattc

SEQ ID NO: 23889 - DNA, 54 bp, Anaeromyces robustus
  GLHYDRLASE48
tttctggatttggttagaagctgttaatggtaaacttacaggtaattatgaagg

SEQ ID NO: 23890 - DNA, 63 bp, Anaeromyces robustus
  GLHYDRLASE48
aattactcactgtactaatattaaatgggaaggtaatccagatgaatggaattcttctaactt

SEQ ID NO: 23891 - DNA, 60 bp, Anaeromyces robustus
  GLHYDRLASE48
tggtaaaaattctgctcactaccttatttcttggtacttcgcttggggtggtggtttaca

SEQ ID NO: 23892 - DNA, 81 bp, Anaeromyces robustus
  GLHYDRLASE48
agtttatcacgatccaccatccaacaattggtctggtatgcaaggttggggtatggaacgtgtttgttcattatattacct

SEQ ID NO: 23893 - DNA, 84 bp, Anaeromyces robustus
  GLHYDRLASE48
acaatggagatacactgctgctccagatgctgatgctcgtgctattcaagctgcttactttggatatatttgggctaaggaaga

SEQ ID NO: 23894 - DNA, 60 bp, Anaeromyces robustus
  GLHYDRLASE48
cggtaaaaattcagcacattatcttatatcatgggcttattcttggggtggaggtataat

SEQ ID NO: 23895 - DNA, 54 bp, Anaeromyces robustus
  GLHYDRLASE48
ttattggatttggttagaagctgttaatggtaaaattactggtaattatgaagg

SEQ ID NO: 23896 - DNA, 84 bp, Anaeromyces robustus
  GLHYDRLASE48
acaatataaatatacaacttgtcctgatgctgatgctcgtgctattcaagctacctattttgcttatttatgggctaaagaaga

SEQ ID NO: 23897 - DNA, 78 bp, Anaeromyces robustus
  GLHYDRLASE48
tgaaactcttattgttgaagaggataatagtttttccagattagattatggtcacttatctacttctgaaactttatc

SEQ ID NO: 23898 - DNA, 75 bp, Anaeromyces robustus
  GLHYDRLASE48
attaattaatacttttagacgtggtccatctgaatctgtttggcaaactattccacatccatcttttgatgaatt

SEQ ID NO: 23899 - DNA, 72 bp, Anaeromyces robustus
  GLHYDRLASE48
tcaattagaatttatgagatggttacaaactcctgaaggttgtattgctggaggtgcaacaaattcatggga

SEQ ID NO: 23900 - DNA, 81 bp, Anaeromyces robustus
  GLHYDRLASE48
ggtttatcataatccatcctcaaataattggataggtatgcaagctcgaagtatagaacgagtttgttctttgtattatct

SEQ ID NO: 23901 - DNA, 87 bp, Anaeromyces robustus
  GLHYDRLASE48
ttggaagggtagaaatcctcaaggagcttatttaaaaagaggagcttgtttccttgatattcgaccaaaatataaagaagatcctga

SEQ ID NO: 23902 - DNA, 63 bp, Anaeromyces robustus
  GLHYDRLASE48
aattattcatgctacaaaacttacatgggaaggtaatccagatgattgggattcatctagttt

SEQ ID NO: 23903 - DNA, 87 bp, Anaeromyces robustus
  GLHYDRLASE48
tttcaaaggtgtttatggtcaatccgcaaaaattaatgataaatcaacatttatatctattcgtccttattataaaaaagataaaaa

SEQ ID NO: 23904 - DNA, 63 bp, Anaeromyces robustus
  GLHYDRLASE48
atttagaattccaaataaattatcatttgaaggtcatccggaaaaatggaaaccaaatacaag

SEQ ID NO: 23905 - DNA, 72 bp, Anaeromyces robustus
  GLHYDRLASE48
gcaaattgaatttattcgttggttacaaagttcggaaggagcaatagtaggaaacgcaaaatatccttctaa

SEQ ID NO: 23906 - DNA, 60 bp, Anaeromyces robustus
  GLHYDRLASE48
aacggatgaaaataaaaattatctattatcacgttacttttcttggaaaggaagtataca

SEQ ID NO: 23907 - DNA, 54 bp, Piromyces finnis
  GLHYDRLASE48
atataaactatggatagaagcattacaaggaaaaatttcaggaaaatggaaacc

SEQ ID NO: 23908 - DNA, 72 bp, Piromyces finnis
  GLHYDRLASE48
acaaattgaatttatacgatggttacaaagttctgaaggagctattgttggtgtagctcaatacccttcaaa

SEQ ID NO: 23909 - DNA, 63 bp, Piromyces finnis
  GLHYDRLASE48
atttaaaattccaaataagctaacctttgaaggacaaccaaaagattggaatcaaaaggatgg

SEQ ID NO: 23910 - DNA, 87 bp, Piromyces finnis
  GLHYDRLASE48
atttaaaggaatgtatggaagatcatcaaaaattaatgataaatcaacctttatctccatacgtccatactataaaaaggacaaaga

SEQ ID NO: 23911 - DNA, 63 bp, Piromyces finnis
  GLHYDRLASE48
agttatccacgctactaacttaggttgggatggtaatccagatgaatggaaggcctctaactt

SEQ ID NO: 23912 - DNA, 87 bp, Piromyces finnis
  GLHYDRLASE48
ctggagtggtaagaacgctcaaggtgccaacattaagagcggtgctactttcattgacattcgtccaaagtacaaggaagatccaga

SEQ ID NO: 23913 - DNA, 63 bp, Piromyces finnis
  GLHYDRLASE48
aattgttcacgctactaaccttgactggtctggtaacccagatgaatggaattcttccaactt

SEQ ID NO: 23914 - DNA, 87 bp, Piromyces finnis; identical to SEQ ID NO: 23912
  GLHYDRLASE48

SEQ ID NO: 23915 - DNA, 78 bp, Piromyces finnis
  GLHYDRLASE48
ggttccataccactctgttgaaactcttatggttgaagctccagatcatggtcacgaatctgtctctgaaaccttctc

SEQ ID NO: 23916 - DNA, 54 bp, Piromyces finnis
  GLHYDRLASE48
tttctggatttggttagaagctgttaacggtaagatcactggtaactacgatgg

SEQ ID NO: 23917 - DNA, 60 bp, Piromyces finnis
  GLHYDRLASE48
tggtaagaactctgctcactaccttatctcctggtacttcgcctggggtggaggtttaca

SEQ ID NO: 23918 - DNA, 81 bp, Piromyces finnis
  GLHYDRLASE48
agtttaccacgacccaccatccaacaactggactggtatgcaaggttggggtatggaacgtgtctgttccttatactacgt

SEQ ID NO: 23919 - DNA, 72 bp, Piromyces finnis
  GLHYDRLASE48
tcaattagaattattcagatggttacaaactccagaaggttgtattgctggtggtgccactaactcatggca

SEQ ID NO: 23920 - DNA, 75 bp, Piromyces finnis
  GLHYDRLASE48
tttcattaacaccttccaacgtggtgcttccgaatctacttggaagactgttccacacccatgttgggaagccat

SEQ ID NO: 23921 - DNA, 84 bp, Piromyces finnis
  GLHYDRLASE48
gcaatggagatacactgctgctccagatgctgatgctcgtgctgttcaagctgcttacttcgcctacatctgggctgaagaaga

SEQ ID NO: 23922 - DNA, 75 bp, Piromyces finnis; identical to SEQ ID NO: 23920
  GLHYDRLASE48

SEQ ID NO: 23923 - DNA, 81 bp, Piromyces finnis; identical to SEQ ID NO: 23918
  GLHYDRLASE48

SEQ ID NO: 23924 - DNA, 60 bp, Piromyces finnis; identical to SEQ ID NO: 23917
  GLHYDRLASE48

SEQ ID NO: 23925 - DNA, 78 bp, Piromyces finnis; identical to SEQ ID NO: 23915
  GLHYDRLASE48

SEQ ID NO: 23926 - DNA, 72 bp, Piromyces finnis; identical to SEQ ID NO: 23919
  GLHYDRLASE48

SEQ ID NO: 23927 - DNA, 63 bp, Piromyces finnis; identical to SEQ ID NO: 23913
  GLHYDRLASE48

SEQ ID NO: 23928 - DNA, 54 bp, Piromyces finnis; identical to SEQ ID NO: 23916
  GLHYDRLASE48

SEQ ID NO: 23929 - DNA, 87 bp, Piromyces finnis
  GLHYDRLASE48
ctggactggtaagaatgctcaaggtgccaacattaagagtggtgttactttcattgatatccgtccaaagtacaagcaagatccaga

SEQ ID NO: 23930 - DNA, 84 bp, Piromyces finnis; identical to SEQ ID NO: 23921
  GLHYDRLASE48

SEQ ID NO: 23931 - DNA, 87 bp, Piromyces finnis; identical to SEQ ID NO: 23929
  GLHYDRLASE48

SEQ ID NO: 23932 - DNA, 63 bp, Piromyces finnis; identical to SEQ ID NO: 23911
  GLHYDRLASE48

SEQ ID NO: 23933 - DNA, 87 bp, Piromyces finnis; identical to SEQ ID NO: 23912
  GLHYDRLASE48

SEQ ID NO: 23934 - DNA, 63 bp, Piromyces finnis; identical to SEQ ID NO: 23911
  GLHYDRLASE48

SEQ ID NO: 23935 - DNA, 87 bp, Piromyces finnis; identical to SEQ ID NO: 23912
  GLHYDRLASE48

SEQ ID NO: 23936 - DNA, 78 bp, Piromyces finnis; identical to SEQ ID NO: 23915
  GLHYDRLASE48

SEQ ID NO: 23937 - DNA, 54 bp, Piromyces finnis; identical to SEQ ID NO: 23916
  GLHYDRLASE48

SEQ ID NO: 23938 - DNA, 60 bp, Piromyces finnis; identical to SEQ ID NO: 23917
  GLHYDRLASE48

SEQ ID NO: 23939 - DNA, 81 bp, Piromyces finnis; identical to SEQ ID NO: 23918
  GLHYDRLASE48

SEQ ID NO: 23940 - DNA, 72 bp, Piromyces finnis; identical to SEQ ID NO: 23919
  GLHYDRLASE48

SEQ ID NO: 23941 - DNA, 63 bp, Piromyces finnis; identical to SEQ ID NO: 23913
  GLHYDRLASE48

SEQ ID NO: 23942 - DNA, 75 bp, Piromyces finnis; identical to SEQ ID NO: 23920
  GLHYDRLASE48

SEQ ID NO: 23943 - DNA, 84 bp, Piromyces finnis; identical to SEQ ID NO: 23921
  GLHYDRLASE48

SEQ ID NO: 23944 - DNA, 87 bp, Piromyces finnis
  GLHYDRLASE48
ttggactggtaagaatgctcaaggtgccaacattaagagtggtgttactttcattgatatccgtccaaagtacaagcaagatccaga

SEQ ID NO: 23945 - DNA, 63 bp, Piromyces finnis; identical to SEQ ID NO: 23911
  GLHYDRLASE48

SEQ ID NO: 23946 - DNA, 75 bp, Piromyces finnis; identical to SEQ ID NO: 23920
  GLHYDRLASE48

SEQ ID NO: 23947 - DNA, 81 bp, Piromyces finnis; identical to SEQ ID NO: 23918
  GLHYDRLASE48

SEQ ID NO: 23948 - DNA, 60 bp, Piromyces finnis; identical to SEQ ID NO: 23917
  GLHYDRLASE48

SEQ ID NO: 23949 - DNA, 78 bp, Piromyces finnis; identical to SEQ ID NO: 23915
  GLHYDRLASE48

SEQ ID NO: 23950 - DNA, 72 bp, Piromyces finnis; identical to SEQ ID NO: 23919
  GLHYDRLASE48

SEQ ID NO: 23951 - DNA, 63 bp, Piromyces finnis; identical to SEQ ID NO: 23913
  GLHYDRLASE48

SEQ ID NO: 23952 - DNA, 54 bp, Piromyces finnis; identical to SEQ ID NO: 23916
  GLHYDRLASE48

SEQ ID NO: 23953 - DNA, 87 bp, Piromyces finnis; identical to SEQ ID NO: 23944
  GLHYDRLASE48

SEQ ID NO: 23954 - DNA, 84 bp, Piromyces finnis; identical to SEQ ID NO: 23921
  GLHYDRLASE48

SEQ ID NO: 23955 - DNA, 87 bp, Piromyces finnis; identical to SEQ ID NO: 23944
  GLHYDRLASE48

SEQ ID NO: 23956 - DNA, 72 bp, Piromyces finnis; identical to SEQ ID NO: 23919
  GLHYDRLASE48

SEQ ID NO: 23957 - DNA, 75 bp, Piromyces finnis; identical to SEQ ID NO: 23920
  GLHYDRLASE48

SEQ ID NO: 23958 - DNA, 63 bp, Piromyces finnis; identical to SEQ ID NO: 23913
  GLHYDRLASE48

SEQ ID NO: 23959 - DNA, 84 bp, Piromyces finnis; identical to SEQ ID NO: 23921
  GLHYDRLASE48

SEQ ID NO: 23960 - DNA, 60 bp, Piromyces finnis; identical to SEQ ID NO: 23917
  GLHYDRLASE48

SEQ ID NO: 23961 - DNA, 81 bp, Piromyces finnis; identical to SEQ ID NO: 23918
  GLHYDRLASE48

SEQ ID NO: 23962 - DNA, 72 bp, Piromyces finnis; identical to SEQ ID NO: 23919
  GLHYDRLASE48

SEQ ID NO: 23963 - DNA, 75 bp, Piromyces finnis; identical to SEQ ID NO: 23920
  GLHYDRLASE48

SEQ ID NO: 23964 - DNA, 81 bp, Piromyces finnis; identical to SEQ ID NO: 23918
  GLHYDRLASE48

SEQ ID NO: 23965 - DNA, 60 bp, Piromyces finnis; identical to SEQ ID NO: 23917
  GLHYDRLASE48

SEQ ID NO: 23966 - DNA, 87 bp, Piromyces finnis; identical to SEQ ID NO: 23944
  GLHYDRLASE48

SEQ ID NO: 23967 - DNA, 84 bp, Piromyces finnis; identical to SEQ ID NO: 23921
  GLHYDRLASE48

SEQ ID NO: 23968 - DNA, 63 bp, Piromyces finnis; identical to SEQ ID NO: 23913
  GLHYDRLASE48

SEQ ID NO: 23969 - DNA, 54 bp, Piromyces finnis; identical to SEQ ID NO: 23916
  GLHYDRLASE48

SEQ ID NO: 23970 - DNA, 78 bp, Piromyces finnis; identical to SEQ ID NO: 23915
  GLHYDRLASE48

SEQ ID NO: 23971 - DNA, 42 bp, Neocallimastix californiae
  GLHYDRLASE6
tgttgctatgtatcttgatattggtcacgccttctggttagg

SEQ ID NO: 23972 - DNA, 60 bp, Neocallimastix californiae
  GLHYDRLASE6
ttcttcccttattgctaaggctgaaaagatgaagacctactctaatgctatctggttaga

SEQ ID NO: 23973 - DNA, 33 bp, Neocallimastix californiae
  GLHYDRLASE6
tcgtggtttcactgataatgttgctaactacac

SEQ ID NO: 23974 - DNA, 45 bp, Neocallimastix californiae
  GLHYDRLASE6
tgatgctttctactggattaagccacttggtgaatctgatggtac

SEQ ID NO: 23975 - DNA, 42 bp, Neocallimastix californiae
  GLHYDRLASE6
tttaactgttttcgtcgtttacgatttaccaggtcgtgattg

SEQ ID NO: 23976 - DNA, 48 bp, Neocallimastix californiae
  GLHYDRLASE6
gtctgaatacattgatgtcattgaaggtcacttaaagacttacaaatc

SEQ ID NO: 23977 - DNA, 42 bp, Neocallimastix californiae
  GLHYDRLASE6
ttacttcgtttgtgatacttctcgtaatggtaagaaggttga

SEQ ID NO: 23978 - DNA, 63 bp, Neocallimastix californiae
  GLHYDRLASE6
aggagaatggtgtaaccaaactggagttggtattggagccagaccacaagccagtccagtttc

SEQ ID NO: 23979 - DNA, 45 bp, Neocallimastix californiae; identical to SEQ ID NO: 23974
  GLHYDRLASE6

SEQ ID NO: 23980 - DNA, 63 bp, Neocallimastix californiae
  GLHYDRLASE6
aggagaatggtgtaaccaaactggagttggtattggtgccagaccacaagctagtccagtttc

SEQ ID NO: 23981 - DNA, 33 bp, Neocallimastix californiae; identical to SEQ ID NO: 23973
  GLHYDRLASE6

SEQ ID NO: 23982 - DNA, 42 bp, Neocallimastix californiae; identical to SEQ ID NO: 23977
  GLHYDRLASE6

SEQ ID NO: 23983 - DNA, 48 bp, Neocallimastix californiae
  GLHYDRLASE6
gtctgaatacattgatgttattgaaggtcacttaaagacttataaatc

SEQ ID NO: 23984 - DNA, 42 bp, Neocallimastix californiae
  GLHYDRLASE6
tttaaccgtttttgtggtttacgatttaccaggtcgtgattg

SEQ ID NO: 23985 - DNA, 60 bp, Neocallimastix californiae
  GLHYDRLASE6
ttcttcccttatcgctaaggctgaaaagatgaagacatactctaatgctatttggttaga

SEQ ID NO: 23986 - DNA, 42 bp, Neocallimastix californiae; identical to SEQ ID NO: 23971
  GLHYDRLASE6

SEQ ID NO: 23987 - DNA, 42 bp, Neocallimastix californiae
  GLHYDRLASE6
tgttgctatgtatcttgatattggtcacgctttctggttagg

SEQ ID NO: 23988 - DNA, 33 bp, Neocallimastix californiae
  GLHYDRLASE6
tcgtggtttcactgataatgtttctaactacac

SEQ ID NO: 23989 - DNA, 60 bp, Neocallimastix californiae
  GLHYDRLASE6
ctcttccctcattgctaaggctgaaaagatgaagacttactctaatgctatttggttaga

SEQ ID NO: 23990 - DNA, 48 bp, Neocallimastix californiae
  GLHYDRLASE6
gtctgaatatattgatgttattgaaggtcacttaaagacttacaaatc

SEQ ID NO: 23991 - DNA, 42 bp, Neocallimastix californiae
  GLHYDRLASE6
ttactttgtttctgatagttctcgtaatggtaagaaggttga

SEQ ID NO: 23992 - DNA, 63 bp, Neocallimastix californiae
  GLHYDRLASE6
aggagaatggtgtaaccaaactggtgttggtgttggtgccagaccacaagccagtccaatttc

SEQ ID NO: 23993 - DNA, 42 bp, Neocallimastix californiae
  GLHYDRLASE6
cttaacagttttcgttgtttatgatttaccaggtcgtgattg

SEQ ID NO: 23994 - DNA, 45 bp, Neocallimastix californiae
  GLHYDRLASE6
tgatgctttctactggattaagccacttggtgaatccgatggtac

SEQ ID NO: 23995 - DNA, 60 bp, Neocallimastix californiae
  GLHYDRLASE6
tggtgaattacaacaacaagctaacagagtaaaatacactccaactgctgtttggttagc

SEQ ID NO: 23996 - DNA, 48 bp, Neocallimastix californiae
  GLHYDRLASE6
caagaattacgttgacagtgtttacaattcattcagatcctatggtaa

SEQ ID NO: 23997 - DNA, 63 bp, Neocallimastix californiae
  GLHYDRLASE6
taagacctggtgtaactttgttggtactggttttggtgaacgtccaaagggtaatccagaccc

SEQ ID NO: 23998 - DNA, 42 bp, Neocallimastix californiae
  GLHYDRLASE6
cactgctgtcttcatgatgtactggatcccaactcgtgattg

SEQ ID NO: 23999 - DNA, 42 bp, Neocallimastix californiae
  GLHYDRLASE6
gagattcatcgttgatactagtcgtaatggtgttgatatcag

SEQ ID NO: 24000 - DNA, 33 bp, Neocallimastix californiae
  GLHYDRLASE6
tcgtggtttctccactaatgtatctaacttcca

SEQ ID NO: 24001 - DNA, 45 bp, Neocallimastix californiae
  GLHYDRLASE6
agatgcttatatgtggttaaagccaccagcagaatctgacggttc

SEQ ID NO: 24002 - DNA, 42 bp, Neocallimastix californiae
  GLHYDRLASE6
tgttcaagtctaccttgatgccggtcacagtcaatggttaac

SEQ ID NO: 24003 - DNA, 60 bp, Neocallimastix californiae
  GLHYDRLASE6
ctcttcccttattgctaaggctgaaaagatgaagacttactccaatgctatttggttaga

SEQ ID NO: 24004 - DNA, 48 bp, Neocallimastix californiae
  GLHYDRLASE6
gtcagaatatattgatgttattgaaggtcacttaaagacttacaagtc

SEQ ID NO: 24005 - DNA, 42 bp, Neocallimastix californiae
  GLHYDRLASE6
tttaactgtctttgttgtttatgatttaccaggtcgtgattg

SEQ ID NO: 24006 - DNA, 63 bp, Neocallimastix californiae
  GLHYDRLASE6
aggtgaatggtgtaaccaaaccggttgtggtattggtgccagaccaaaagccagtccaatctc

SEQ ID NO: 24007 - DNA, 42 bp, Neocallimastix californiae
  GLHYDRLASE6
ctacttcttctctgattcctctcgtaacggtaagaagactga

SEQ ID NO: 24008 - DNA, 42 bp, Neocallimastix californiae
  GLHYDRLASE6
tgtagccttatatcttgatattggtcacgccttctggttagg

SEQ ID NO: 24009 - DNA, 33 bp, Neocallimastix californiae
  GLHYDRLASE6
tcgtggtttcgttgataacgttgctaactacac

SEQ ID NO: 24010 - DNA, 45 bp, Neocallimastix californiae
  GLHYDRLASE6
tgatgccttctactgggttaagccaattggtgaatctgatggtac

SEQ ID NO: 24011 - DNA, 60 bp, Neocallimastix californiae
  GLHYDRLASE6
ttcttctcttattgctaaggctgaaaagatgaaaacttactctaatgctatttggttaga

SEQ ID NO: 24012 - DNA, 48 bp, Neocallimastix californiae
  GLHYDRLASE6
gtctgaatacattgatgtcattgaaggtcacttaaaggaatataactc

SEQ ID NO: 24013 - DNA, 42 bp, Neocallimastix californiae
  GLHYDRLASE6
tttaactgttttcgttgtttacgatttaccaggtcgtgattg

SEQ ID NO: 24014 - DNA, 42 bp, Neocallimastix californiae; identical to SEQ ID NO: 23971
  GLHYDRLASE6

SEQ ID NO: 24015 - DNA, 48 bp, Neocallimastix californiae
  GLHYDRLASE6
gaccgaatacattgatgtcattgaaggtcacttaaagaaatacaagtc

SEQ ID NO: 24016 - DNA, 42 bp, Neocallimastix californiae; identical to SEQ ID NO: 23971
  GLHYDRLASE6

SEQ ID NO: 24017 - DNA, 37 bp, Neocallimastix californiae
  GLHYDRLASE6
aggagaatggtgtaaccaaacaggagttggtattgga

SEQ ID NO: 24018 - DNA, 60 bp, Neocallimastix californiae
  GLHYDRLASE6
ttcttctcttattgctaaggctgaaaagatgaagacttactctaatgctatttggttaga

SEQ ID NO: 24019 - DNA, 42 bp, Neocallimastix californiae; identical to SEQ ID NO: 24013
  GLHYDRLASE6

SEQ ID NO: 24020 - DNA, 33 bp, Neocallimastix californiae
  GLHYDRLASE6
tcgtggtttcaccgataatgtttcaaactacac

SEQ ID NO: 24021 - DNA, 42 bp, Neocallimastix californiae
  GLHYDRLASE6
ttactttgtttccgatacttctcgtaatggacacaagactga

SEQ ID NO: 24022 - DNA, 60 bp, Neocallimastix californiae
  GLHYDRLASE6
tccagaattacaagcaaaagccaagaatgttgaaaaggtttcttctgctgtttggttagc

SEQ ID NO: 24023 - DNA, 63 bp, Neocallimastix californiae
  GLHYDRLASE6
ccaaacctggtgtaatttaatttatgctggtttaggtgaaccatcacgtggaagtccagatcc

SEQ ID NO: 24024 - DNA, 45 bp, Neocallimastix californiae
  GLHYDRLASE6
agatgctttcatgtggctcaaaccaccaggtgaagctgatggttc

SEQ ID NO: 24025 - DNA, 48 bp, Neocallimastix californiae
  GLHYDRLASE6
caagggttatgttgacaagattgctaacactattaagaaattcccaga

SEQ ID NO: 24026 - DNA, 33 bp, Neocallimastix californiae
  GLHYDRLASE6
tcgtggttttagtactaatgtttctaattacat

SEQ ID NO: 24027 - DNA, 42 bp, Neocallimastix californiae
  GLHYDRLASE6
aagattcattgttgatactggtcgtagtggtgttgatgtacg

SEQ ID NO: 24028 - DNA, 42 bp, Neocallimastix californiae
  GLHYDRLASE6
tgttagtgcttatcttgatgctgctcatagtaaatggttagg

SEQ ID NO: 24029 - DNA, 42 bp, Neocallimastix californiae
  GLHYDRLASE6
gactgttactttcattctttatatgattccaactcgtgattg

SEQ ID NO: 24030 - DNA, 45 bp, Neocallimastix californiae
  GLHYDRLASE6
tgatgccttctattgggttaagccaatcggtgaatctgatggtac

SEQ ID NO: 24031 - DNA, 42 bp, Neocallimastix californiae
  GLHYDRLASE6
ctacttcttctctgattcatctcgtaacggtaagaagactga

SEQ ID NO: 24032 - DNA, 60 bp, Neocallimastix californiae
  GLHYDRLASE6
ctcttcccttattgctaaggccgaaaagatgaagacctactctaatgctatttggttaga

SEQ ID NO: 24033 - DNA, 63 bp, Neocallimastix californiae
  GLHYDRLASE6
aggtgaatggtgtaaccaaactggttgtggtgtcggtgcaagaccaaaagcaagtccaatctc

SEQ ID NO: 24034 - DNA, 48 bp, Neocallimastix californiae
  GLHYDRLASE6
gtcagaatacattgatgtcattgaaggccacttaaagacttacaagtc

SEQ ID NO: 24035 - DNA, 42 bp, Neocallimastix californiae
  GLHYDRLASE6
tttaactgtctttgtcgtttacgatttaccaggtcgtgattg

SEQ ID NO: 24036 - DNA, 42 bp, Neocallimastix californiae
  GLHYDRLASE6
tgtagccttatatcttgatattggtcatgccttctggttagg

SEQ ID NO: 24037 - DNA, 33 bp, Neocallimastix californiae
  GLHYDRLASE6
tcgtggtttcgttgataatgttgctaactacac

SEQ ID NO: 24038 - DNA, 48 bp, Neocallimastix californiae
  GLHYDRLASE6
gtctgaatacattgatgttattgaaggtcacttaaagacttacaaatc

SEQ ID NO: 24039 - DNA, 60 bp, Neocallimastix californiae
  GLHYDRLASE6
cgcttctcttattgctaaggctgaaaaaatgaaggaattctcaaatgccatttggttaga

SEQ ID NO: 24040 - DNA, 42 bp, Neocallimastix californiae
  GLHYDRLASE6
taaattcgttactgatacttcacataatggtaagaagtttga

SEQ ID NO: 24041 - DNA, 45 bp, Neocallimastix californiae
  GLHYDRLASE6
tgatgctttctattggattaagccatttggtaacgtatctgaatt

SEQ ID NO: 24042 - DNA, 42 bp, Neocallimastix californiae
  GLHYDRLASE6
cgttgctctatatcttgatattggtcatgcctatttattagg

SEQ ID NO: 24043 - DNA, 63 bp, Neocallimastix californiae
  GLHYDRLASE6
ggaattatggtgtaaatcaacatctgctggtgttggtgctagaccaatggctattccaattac

SEQ ID NO: 24044 - DNA, 42 bp, Neocallimastix californiae
  GLHYDRLASE6
tttaaccgtttttgttgtttacaatttaccaggtcgtgattg

SEQ ID NO: 24045 - DNA, 33 bp, Neocallimastix californiae
  GLHYDRLASE6
tcgtggttttgctgataatattggtggcttcgt

SEQ ID NO: 24046 - DNA, 63 bp, Neocallimastix californiae
  GLHYDRLASE6
cggtacctggtgtaacttcaagggtgccggtttaggtgaacgtccaaagggtaatccaaaccc

SEQ ID NO: 24047 - DNA, 45 bp, Neocallimastix californiae
  GLHYDRLASE6
tgatgcctacatgtggattaagactccaggagaagctgatggttc

SEQ ID NO: 24048 - DNA, 42 bp, Neocallimastix californiae
  GLHYDRLASE6
gaccgtggtcttcgtcttatatatgattccaactcgtgattg

SEQ ID NO: 24049 - DNA, 48 bp, Neocallimastix californiae
  GLHYDRLASE6
caagtcctacgtggataagatttacaacaccattaacaaatatccaaa

SEQ ID NO: 24050 - DNA, 60 bp, Neocallimastix californiae
  GLHYDRLASE6
tggtaatgttaagcaaaaggccgaaaaggtaaaatatgttccaacggctgcttggttagc

SEQ ID NO: 24051 - DNA, 42 bp, Neocallimastix californiae
  GLHYDRLASE6
aaagtttattgttgatacctctcgtaacggtgctaacgttga

SEQ ID NO: 24052 - DNA, 42 bp, Neocallimastix californiae
  GLHYDRLASE6
tgtaagagtctatcttgatgccgctcacggtgcctggttaaa

SEQ ID NO: 24053 - DNA, 33 bp, Neocallimastix californiae
  GLHYDRLASE6
tcgtggtatcagtaccaatgtttctaactacca

SEQ ID NO: 24054 - DNA, 63 bp, Neocallimastix californiae
  GLHYDRLASE6
taagacctggtgtaactttgttggtactggttttggtgaacgtccaaagggtaatccagatcc

SEQ ID NO: 24055 - DNA, 42 bp, Neocallimastix californiae
  GLHYDRLASE6
cactgctgtcttcataatgtactggattccaactcgtgattg

SEQ ID NO: 24056 - DNA, 42 bp, Neocallimastix californiae
  GLHYDRLASE6
tgttcaagtttatcttgatgccggtcacagccaatggttaac

SEQ ID NO: 24057 - DNA, 48 bp, Neocallimastix californiae
  GLHYDRLASE6
caagaattatgtcgatagtgtttataacaccttcagatctaacggtaa

SEQ ID NO: 24058 - DNA, 33 bp, Neocallimastix californiae
  GLHYDRLASE6
tcgtggattctccactaatatttctaacttcca

SEQ ID NO: 24059 - DNA, 45 bp, Neocallimastix californiae
  GLHYDRLASE6
agatgcttacatgtggttaaagccaccagcagaatctgatggttc

SEQ ID NO: 24060 - DNA, 42 bp, Neocallimastix californiae
  GLHYDRLASE6
gagatttattgttgatactagtcgtaatggggttgatatcag

SEQ ID NO: 24061 - DNA, 60 bp, Neocallimastix californiae
  GLHYDRLASE6
tggtgaattacagcaacaagcttctagagtaaaatacaccccaaccgctgtttggttagc

SEQ ID NO: 24062 - DNA, 45 bp, Neocallimastix californiae
  GLHYDRLASE6
tgatgccttttattggattaagccacttggtgaatctgatggtac

SEQ ID NO: 24063 - DNA, 33 bp, Neocallimastix californiae
  GLHYDRLASE6
tcgtggtttcacggataatgtggctaactacac

SEQ ID NO: 24064 - DNA, 63 bp, Neocallimastix californiae
  GLHYDRLASE6
aggagaatggtgtaaccaaactggagttggtattggtgccagaccacaagccagtccaatttc

SEQ ID NO: 24065 - DNA, 48 bp, Neocallimastix californiae
  GLHYDRLASE6
gtccgaatatattgatgtcattgaagaaaagttaagaacttacaaatc

SEQ ID NO: 24066 - DNA, 42 bp, Neocallimastix californiae
  GLHYDRLASE6
tttaacggttttcgttgtttacgatttaccaggtcgtgattg

SEQ ID NO: 24067 - DNA, 42 bp, Neocallimastix californiae
  GLHYDRLASE6
tgttgctatgtatcttgatattggtcatgccttctggttagg

SEQ ID NO: 24068 - DNA, 60 bp, Neocallimastix californiae
  GLHYDRLASE6
tgcttctcttatttcaaaggctgaaaaaatgaagactttctcaaatgctatttggcttga

SEQ ID NO: 24069 - DNA, 42 bp, Neocallimastix californiae
  GLHYDRLASE6
ttactttgtttgtgatacttctcgtaatggtaaaaaggttga

SEQ ID NO: 24070 - DNA, 33 bp, Neocallimastix californiae
  GLHYDRLASE6
tcgtggtttcgcttccaacgtcgctaactacac

SEQ ID NO: 24071 - DNA, 45 bp, Neocallimastix californiae
  GLHYDRLASE6
agatgctttctactgggttaaaccatacggtgaatctgatggtac

SEQ ID NO: 24072 - DNA, 60 bp, Neocallimastix californiae
  GLHYDRLASE6
cagttcacttaaatttaaggccgaaaagatgaaggaatactctaacgctatttggttaga

SEQ ID NO: 24073 - DNA, 42 bp, Neocallimastix californiae
  GLHYDRLASE6
cgttgccatgtacctcgatattggtcacgctttctggttagg

SEQ ID NO: 24074 - DNA, 42 bp, Neocallimastix californiae
  GLHYDRLASE6
ttacttcattgaagatacttctcgtaatggtcacaagactta

SEQ ID NO: 24075 - DNA, 42 bp, Neocallimastix californiae
  GLHYDRLASE6
tttaactgtcttcgtcgtttacgatttaccaggccgtgactg

SEQ ID NO: 24076 - DNA, 63 bp, Neocallimastix californiae
  GLHYDRLASE6
aggtgaatggtgtaaccaaatgggatctggtattggtgccagaccaaaggcttatccagtttc

SEQ ID NO: 24077 - DNA, 42 bp, Neocallimastix californiae
  GLHYDRLASE6
cttaactgtctttgttgtttacgatttaccaggtcgtgattg

SEQ ID NO: 24078 - DNA, 42 bp, Neocallimastix californiae
  GLHYDRLASE6
cgttgctatgtaccttgatattggtcacgctttctggttagg

SEQ ID NO: 24079 - DNA, 48 bp, Neocallimastix californiae
  GLHYDRLASE6
gaccgaatacattgatgttattgaatctcacttaaagcaatacactgc

SEQ ID NO: 24080 - DNA, 63 bp, Neocallimastix californiae
  GLHYDRLASE6
aggtgaatggtgtaaccaaactggtgttggtgttggtgctcgtccacaagctagtccagtttc

SEQ ID NO: 24081 - DNA, 60 bp, Neocallimastix californiae
  GLHYDRLASE6
ttcttctcttagatcaaaggttgaaaagatgaagactttctctaatgctatctggcttga

SEQ ID NO: 24082 - DNA, 45 bp, Neocallimastix californiae; identical to SEQ ID NO: 23974
  GLHYDRLASE6

SEQ ID NO: 24083 - DNA, 33 bp, Neocallimastix californiae; identical to SEQ ID NO: 24037
  GLHYDRLASE6

SEQ ID NO: 24084 - DNA, 42 bp, Neocallimastix californiae
  GLHYDRLASE6
ttacttcgtcagtgatacttctcgtaatggtcacaagaccga

SEQ ID NO: 24085 - DNA, 60 bp, Neocallimastix californiae
  GLHYDRLASE6
ctcttctcttaaggctaaggctgaaaagatgaagacttactctaacgccatctggcttga

SEQ ID NO: 24086 - DNA, 42 bp, Neocallimastix californiae; identical to SEQ ID NO: 24078
  GLHYDRLASE6

SEQ ID NO: 24087 - DNA, 33 bp, Neocallimastix californiae; identical to SEQ ID NO: 24009
  GLHYDRLASE6

SEQ ID NO: 24088 - DNA, 48 bp, Neocallimastix californiae
  GLHYDRLASE6
gactgaatacattgatgttattgaaagtcacttaaagaaatacactgc

SEQ ID NO: 24089 - DNA, 63 bp, Neocallimastix californiae
  GLHYDRLASE6
aggtgaatggtgtaaccaaactggtgttggtattggtgctcgtccacaagctagtccaatctc

SEQ ID NO: 24090 - DNA, 42 bp, Neocallimastix californiae
  GLHYDRLASE6
ttacttcgtcagtgactcttctcgtaatggtcacaagactga

SEQ ID NO: 24091 - DNA, 45 bp, Neocallimastix californiae; identical to SEQ ID NO: 23974
  GLHYDRLASE6

SEQ ID NO: 24092 - DNA, 42 bp, Neocallimastix californiae; identical to SEQ ID NO: 24077
  GLHYDRLASE6

SEQ ID NO: 24093 - DNA, 48 bp, Neocallimastix californiae
  GLHYDRLASE6
gactgaatacattgatgttattgaaaaacaattaaagcaatacactgc

SEQ ID NO: 24094 - DNA, 60 bp, Neocallimastix californiae; identical to SEQ ID NO: 24085
  GLHYDRLASE6

SEQ ID NO: 24095 - DNA, 42 bp, Neocallimastix californiae; identical to SEQ ID NO: 24078
  GLHYDRLASE6

SEQ ID NO: 24096 - DNA, 33 bp, Neocallimastix californiae; identical to SEQ ID NO: 24009
  GLHYDRLASE6

SEQ ID NO: 24097 - DNA, 63 bp, Neocallimastix californiae; identical to SEQ ID NO: 24089
  GLHYDRLASE6

SEQ ID NO: 24098 - DNA, 42 bp, Neocallimastix californiae; identical to SEQ ID NO: 24090
  GLHYDRLASE6

SEQ ID NO: 24099 - DNA, 45 bp, Neocallimastix californiae; identical to SEQ ID NO: 23974
  GLHYDRLASE6

SEQ ID NO: 24100 - DNA, 42 bp, Neocallimastix californiae; identical to SEQ ID NO: 24077
  GLHYDRLASE6

SEQ ID NO: 24101 - DNA, 33 bp, Neocallimastix californiae
  GLHYDRLASE6
tcgtggtttcactgataatgttgctaattatac

SEQ ID NO: 24102 - DNA, 63 bp, Neocallimastix californiae
  GLHYDRLASE6
aggagaatggtgtaaccaaacaggagttggtgttggtgctagaccacaagctaatccagtttc

SEQ ID NO: 24103 - DNA, 60 bp, Neocallimastix californiae
  GLHYDRLASE6
ttcttctcttatttctaaagctgaaaaaatgaaaactttttcaaatgctatttggttaga

SEQ ID NO: 24104 - DNA, 42 bp, Neocallimastix californiae
  GLHYDRLASE6
ttacttcgttagtgatacttcacgtaatggtaagaaggttga

SEQ ID NO: 24105 - DNA, 48 bp, Neocallimastix californiae
  GLHYDRLASE6
aactgaatatattgatgtcattgaagaaaaattgaaaacttacaaatc

SEQ ID NO: 24106 - DNA, 42 bp, Neocallimastix californiae
  GLHYDRLASE6
tgttgctatgtatcttgatattggacatgctttctggttagg

SEQ ID NO: 24107 - DNA, 42 bp, Neocallimastix californiae
  GLHYDRLASE6
tttaaccgttttcgttgtttatgatttaccaggtcgtgattg

SEQ ID NO: 24108 - DNA, 45 bp, Neocallimastix californiae
  GLHYDRLASE6
tgatgcattctattggattaaaccacttggagaatcagatggtac

SEQ ID NO: 24109 - DNA, 42 bp, Neocallimastix californiae; identical to SEQ ID NO: 24107
  GLHYDRLASE6

SEQ ID NO: 24110 - DNA, 45 bp, Neocallimastix californiae; identical to SEQ ID NO: 24108
  GLHYDRLASE6

SEQ ID NO: 24111 - DNA, 42 bp, Neocallimastix californiae; identical to SEQ ID NO: 24104
  GLHYDRLASE6

SEQ ID NO: 24112 - DNA, 48 bp, Neocallimastix californiae; identical to SEQ ID NO: 24105
  GLHYDRLASE6

SEQ ID NO: 24113 - DNA, 42 bp, Neocallimastix californiae; identical to SEQ ID NO: 24106
  GLHYDRLASE6

SEQ ID NO: 24114 - DNA, 33 bp, Neocallimastix californiae; identical to SEQ ID NO: 24101
  GLHYDRLASE6

SEQ ID NO: 24115 - DNA, 60 bp, Neocallimastix californiae; identical to SEQ ID NO: 24103
  GLHYDRLASE6

SEQ ID NO: 24116 - DNA, 63 bp, Neocallimastix californiae; identical to SEQ ID NO: 24102
  GLHYDRLASE6

SEQ ID NO: 24117 - DNA, 42 bp, Neocallimastix californiae
  GLHYDRLASE6
ttacttcgtttgtgactcttctcgtaatggtaagaaagttga

SEQ ID NO: 24118 - DNA, 42 bp, Neocallimastix californiae
  GLHYDRLASE6
tttaactgttttcgttgtctacgatttaccaggtcgtgattg

SEQ ID NO: 24119 - DNA, 60 bp, Neocallimastix californiae
  GLHYDRLASE6
ttcttccttgatttctaaggctgaaaagatgaagacttactccaatgctatctggcttga

SEQ ID NO: 24120 - DNA, 45 bp, Neocallimastix californiae; identical to SEQ ID NO: 23994
  GLHYDRLASE6

SEQ ID NO: 24121 - DNA, 63 bp, Neocallimastix californiae
  GLHYDRLASE6
aggtgaatggtgtaaccaaactggtgctggtgttggttatagaccacaagccaatccaatttc

SEQ ID NO: 24122 - DNA, 42 bp, Neocallimastix californiae
  GLHYDRLASE6
cgttgctatgtatcttgatattggtcacgccttctggttagg

SEQ ID NO: 24123 - DNA, 33 bp, Neocallimastix californiae
  GLHYDRLASE6
tcgtggattcactgataatgttgctaactacac

SEQ ID NO: 24124 - DNA, 48 bp, Neocallimastix californiae
  GLHYDRLASE6
caagggttatgtcgacaacatttacaacactattaacagatatccaaa

SEQ ID NO: 24125 - DNA, 45 bp, Neocallimastix californiae
  GLHYDRLASE6
tgatgcttacatgtggattaaaactccaggtgaagctgatggttc

SEQ ID NO: 24126 - DNA, 33 bp, Neocallimastix californiae
  GLHYDRLASE6
tcgtggtattagtactaacatttctaactacca

SEQ ID NO: 24127 - DNA, 42 bp, Neocallimastix californiae
  GLHYDRLASE6
tgttagagtttatcttgatgctgctcacggtgcttggttaaa

SEQ ID NO: 24128 - DNA, 42 bp, Neocallimastix californiae
  GLHYDRLASE6
gaaattcattgttgatacttctcgtaatggtcaaaatgttac

SEQ ID NO: 24129 - DNA, 42 bp, Neocallimastix californiae
  GLHYDRLASE6
gactgttgtctttgtcttatatatgattccaactcgtgattg

SEQ ID NO: 24130 - DNA, 60 bp, Neocallimastix californiae
  GLHYDRLASE6
tggtcaattacaagaaaaggctaaaaaggttaagtacgttccaactgctgcttggttagc

SEQ ID NO: 24131 - DNA, 63 bp, Neocallimastix californiae
  GLHYDRLASE6
caacacctggtgtaacttcaagggtgctggtttaggtccacgtccacaagccaatccaaatcc

SEQ ID NO: 24132 - DNA, 60 bp, Neocallimastix californiae
  GLHYDRLASE6
tccagaattacaagctaaggctaagaatgttgaaaaggttgcaactgctgtttggttagc

SEQ ID NO: 24133 - DNA, 45 bp, Neocallimastix californiae
  GLHYDRLASE6
agatgccttcatgtggcttaaaccaccagcagaatctgatggttc

SEQ ID NO: 24134 - DNA, 42 bp, Neocallimastix californiae
  GLHYDRLASE6
gactattacctttattctttacatgattccaactcgtgactg

SEQ ID NO: 24135 - DNA, 63 bp, Neocallimastix californiae
  GLHYDRLASE6
ccaaacctggtgtaaccttatctacgctggtttaggtgaaaaatctcgtggtaacccagatcc

SEQ ID NO: 24136 - DNA, 33 bp, Neocallimastix californiae
  GLHYDRLASE6
tcgtggtattagtactaatgtttctaactacca

SEQ ID NO: 24137 - DNA, 42 bp, Neocallimastix californiae
  GLHYDRLASE6
tgttaatgcttatcttgatgctgcccaccacaaatggttagg

SEQ ID NO: 24138 - DNA, 48 bp, Neocallimastix californiae
  GLHYDRLASE6
ccaaggttatgttgacagtattgctgctactattaagaaatacccaga

SEQ ID NO: 24139 - DNA, 42 bp, Neocallimastix californiae
  GLHYDRLASE6
gaaattcattgttgataccggtcgtagtggtgttgatgttac

SEQ ID NO: 24140 - DNA, 42 bp, Anaeromyces robustus; identical to SEQ ID NO: 24090
  GLHYDRLASE6

SEQ ID NO: 24141 - DNA, 60 bp, Anaeromyces robustus
  GLHYDRLASE6
ctcatctcttaaggctaaggctgaaaagatgaagactttctctaacgctatttggctcga

SEQ ID NO: 24142 - DNA, 42 bp, Anaeromyces robustus; identical to SEQ ID NO: 24078
  GLHYDRLASE6

SEQ ID NO: 24143 - DNA, 42 bp, Anaeromyces robustus; identical to SEQ ID NO: 24013
  GLHYDRLASE6

SEQ ID NO: 24144 - DNA, 63 bp, Anaeromyces robustus; identical to SEQ ID NO: 24089
  GLHYDRLASE6

SEQ ID NO: 24145 - DNA, 33 bp, Anaeromyces robustus; identical to SEQ ID NO: 24009
  GLHYDRLASE6

SEQ ID NO: 24146 - DNA, 45 bp, Anaeromyces robustus; identical to SEQ ID NO: 23974
  GLHYDRLASE6

SEQ ID NO: 24147 - DNA, 42 bp, Anaeromyces robustus; identical to SEQ ID NO: 24127
  GLHYDRLASE6

SEQ ID NO: 24148 - DNA, 42 bp, Anaeromyces robustus; identical to SEQ ID NO: 24128
  GLHYDRLASE6

SEQ ID NO: 24149 - DNA, 48 bp, Anaeromyces robustus; identical to SEQ ID NO: 24124
  GLHYDRLASE6

SEQ ID NO: 24150 - DNA, 63 bp, Anaeromyces robustus; identical to SEQ ID NO: 24131
  GLHYDRLASE6

SEQ ID NO: 24151 - DNA, 60 bp, Anaeromyces robustus; identical to SEQ ID NO: 24130
  GLHYDRLASE6

SEQ ID NO: 24152 - DNA, 42 bp, Anaeromyces robustus; identical to SEQ ID NO: 24129
  GLHYDRLASE6

SEQ ID NO: 24153 - DNA, 45 bp, Anaeromyces robustus; identical to SEQ ID NO: 24125
  GLHYDRLASE6

SEQ ID NO: 24154 - DNA, 33 bp, Anaeromyces robustus; identical to SEQ ID NO: 24126
  GLHYDRLASE6

SEQ ID NO: 24155 - DNA, 48 bp, Anaeromyces robustus; identical to SEQ ID NO: 24138
  GLHYDRLASE6

SEQ ID NO: 24156 - DNA, 45 bp, Anaeromyces robustus; identical to SEQ ID NO: 24133
  GLHYDRLASE6

SEQ ID NO: 24157 - DNA, 33 bp, Anaeromyces robustus; identical to SEQ ID NO: 24136
  GLHYDRLASE6

SEQ ID NO: 24158 - DNA, 60 bp, Anaeromyces robustus; identical to SEQ ID NO: 24132
  GLHYDRLASE6

SEQ ID NO: 24159 - DNA, 42 bp, Anaeromyces robustus; identical to SEQ ID NO: 24137
  GLHYDRLASE6

SEQ ID NO: 24160 - DNA, 63 bp, Anaeromyces robustus; identical to SEQ ID NO: 24135
  GLHYDRLASE6

SEQ ID NO: 24161 - DNA, 42 bp, Anaeromyces robustus; identical to SEQ ID NO: 24139
  GLHYDRLASE6

SEQ ID NO: 24162 - DNA, 42 bp, Anaeromyces robustus; identical to SEQ ID NO: 24134
  GLHYDRLASE6

SEQ ID NO: 24163 - DNA, 60 bp, Anaeromyces robustus
  GLHYDRLASE6
ttcttctcttaaagctaaagctgaaaaaatgaaaacttatccaaatgctatttggcttga

SEQ ID NO: 24164 - DNA, 33 bp, Anaeromyces robustus; identical to SEQ ID NO: 24009
  GLHYDRLASE6

SEQ ID NO: 24165 - DNA, 42 bp, Anaeromyces robustus
  GLHYDRLASE6
tgttgctatgtaccttgatattggtcacgctttctggttagg

SEQ ID NO: 24166 - DNA, 42 bp, Anaeromyces robustus; identical to SEQ ID NO: 24013
  GLHYDRLASE6

SEQ ID NO: 24167 - DNA, 48 bp, Anaeromyces robustus
  GLHYDRLASE6
gactgaatacattgatgttattgaagaacaattaaagaaatacaaatc

SEQ ID NO: 24168 - DNA, 42 bp, Anaeromyces robustus
  GLHYDRLASE6
tgtacaagtttatcttgatgctggtcacagtcaatggttaac

SEQ ID NO: 24169 - DNA, 42 bp, Anaeromyces robustus
  GLHYDRLASE6
gagatttgttattgatactagtcgtaatggtcaagatattag

SEQ ID NO: 24170 - DNA, 48 bp, Anaeromyces robustus
  GLHYDRLASE6
caaatcttatgttgatgatgttgctaatacctttagatctaatcaagg

SEQ ID NO: 24171 - DNA, 33 bp, Anaeromyces robustus
  GLHYDRLASE6
tcgtggtttctctactaatgtttctaacttcca

SEQ ID NO: 24172 - DNA, 60 bp, Anaeromyces robustus
  GLHYDRLASE6
tggtaatttacaacaacaagctaatagagttaaatacgttccaactgctgtttggttagc

SEQ ID NO: 24173 - DNA, 45 bp, Anaeromyces robustus
  GLHYDRLASE6
agatgcttacatgtggttaaaaccaccagcagaatctgatggttc

SEQ ID NO: 24174 - DNA, 42 bp, Anaeromyces robustus
  GLHYDRLASE6
tactgctgtctttattatgtactggattccaactcgtgattg

SEQ ID NO: 24175 - DNA, 63 bp, Anaeromyces robustus
  GLHYDRLASE6
taaaacttggtgtaatttagttggtactggttttggtgaacgtccaaagggtaatccagatcc

SEQ ID NO: 24176 - DNA, 45 bp, Anaeromyces robustus
  GLHYDRLASE6
tgatgctgtttattggtttaaaccaccaggtgaatctgatggtag

SEQ ID NO: 24177 - DNA, 48 bp, Anaeromyces robustus
  GLHYDRLASE6
taaggaatggattgatgaaattgcaggttatttcaaaaatcatgaagg

SEQ ID NO: 24178 - DNA, 42 bp, Anaeromyces robustus
  GLHYDRLASE6
tggttgggtagttgatacttctcgtaatggtgtatctaatat

SEQ ID NO: 24179 - DNA, 63 bp, Anaeromyces robustus
  GLHYDRLASE6
tgaatcatggtgtaatattaaaggtgcaggtataggtagaagaccagaagctaatccaccaga

SEQ ID NO: 24180 - DNA, 33 bp, Anaeromyces robustus
  GLHYDRLASE6
acgtggtttcacttctaatatttctaattatca

SEQ ID NO: 24181 - DNA, 42 bp, Anaeromyces robustus
  GLHYDRLASE6
tttaacttctttcattatttataatttaccaaacagagattg

SEQ ID NO: 24182 - DNA, 60 bp, Anaeromyces robustus
  GLHYDRLASE6
accagaaattgctgaaattgttgctaaagttgctaaatatccaactccaacctggttaac

SEQ ID NO: 24183 - DNA, 42 bp, Anaeromyces robustus
  GLHYDRLASE6
tgttggtgtttatttagatcttgctcaagttggttggttagg

SEQ ID NO: 24184 - DNA, 63 bp, Anaeromyces robustus
  GLHYDRLASE6
tgaagattggtgttataatgctcctcttggtattggtgctcgtccacaagctaatccagtttc

SEQ ID NO: 24185 - DNA, 42 bp, Anaeromyces robustus
  GLHYDRLASE6
tttaactacttttgttctttataatttaccaggtcgtgattg

SEQ ID NO: 24186 - DNA, 33 bp, Anaeromyces robustus
  GLHYDRLASE6
tcgtggttttgctgataatatttcaaattatgt

SEQ ID NO: 24187 - DNA, 60 bp, Anaeromyces robustus
  GLHYDRLASE6
tccaactgttattgaaaaagttgaaaaaatgaaacaatattctactggtatttggttaga

SEQ ID NO: 24188 - DNA, 45 bp, Anaeromyces robustus
  GLHYDRLASE6
tgatgcttttgtttggattaaaccattctatggtgataaaccata

SEQ ID NO: 24189 - DNA, 42 bp, Anaeromyces robustus
  GLHYDRLASE6
tgtctttttatatcttgatgttggtcatgctttctggttagg

SEQ ID NO: 24190 - DNA, 42 bp, Anaeromyces robustus
  GLHYDRLASE6
aacagccgttttcattttatattggattccaactcgtgattg

SEQ ID NO: 24191 - DNA, 48 bp, Anaeromyces robustus
  GLHYDRLASE6
tcacacttatgttaacagaattgttaacggtttcaaaagtcatccaaa

SEQ ID NO: 24192 - DNA, 42 bp, Anaeromyces robustus
  GLHYDRLASE6
gaaatttattgttgatactgcccgtaatggtgtagatgtcgc

SEQ ID NO: 24193 - DNA, 63 bp, Anaeromyces robustus
  GLHYDRLASE6
tggcacttggtgtaatgttaaaggtacaggttttggtgaacgtccaagaggttccccagaccc

SEQ ID NO: 24194 - DNA, 60 bp, Anaeromyces robustus
  GLHYDRLASE6
tggtgaattaaaagctaaagcccaaaaaatccaagacgccccaacagctatttggttatc

SEQ ID NO: 24195 - DNA, 45 bp, Anaeromyces robustus
  GLHYDRLASE6
agatgcttacatgtggttaaaaccaggaggtgattctgatggttc

SEQ ID NO: 24196 - DNA, 42 bp, Anaeromyces robustus
  GLHYDRLASE6
tgttcgtacttatattgatgctgctcatggtagatggttagg

SEQ ID NO: 24197 - DNA, 33 bp, Anaeromyces robustus
  GLHYDRLASE6
tcgtggtttatctactaatgtttctaactacca

SEQ ID NO: 24198 - DNA, 48 bp, Piromyces finnis
  GLHYDRLASE6
caaggaatggattgatgaaattgcaggatactttgcagctcacgaagg

SEQ ID NO: 24199 - DNA, 60 bp, Piromyces finnis
  GLHYDRLASE6
aaatgaagttgccgaaattgttgctaaggttgctagatacccaactccaacttggttagc

SEQ ID NO: 24200 - DNA, 28 bp, Piromyces finnis
  GLHYDRLASE6
tgttggtgtttacatggatcttgcacaa

SEQ ID NO: 24201 - DNA, 42 bp, Piromyces finnis
  GLHYDRLASE6
tttaacttccttcattatctacaatttaccaaacagagattg

SEQ ID NO: 24202 - DNA, 42 bp, Piromyces finnis
  GLHYDRLASE6
gactattactttcattctttacatgattccaactcgtgattg

SEQ ID NO: 24203 - DNA, 42 bp, Piromyces finnis
  GLHYDRLASE6
cgttagtgcttaccttgatgctgctcatggtaagtggttagg

SEQ ID NO: 24204 - DNA, 33 bp, Piromyces finnis
  GLHYDRLASE6
tcgtggtttcagtaccaatgtttctaactatca

SEQ ID NO: 24205 - DNA, 48 bp, Piromyces finnis
  GLHYDRLASE6
ccaaggtattgttgacaagatcgctaataccattagcaagtacccaga

SEQ ID NO: 24206 - DNA, 60 bp, Piromyces finnis
  GLHYDRLASE6
cgatgaattaaaggctaaggctaagaatgtcatgaatgtttcttctgctgtttggttagc

SEQ ID NO: 24207 - DNA, 42 bp, Piromyces finnis; identical to SEQ ID NO: 24139
  GLHYDRLASE6

SEQ ID NO: 24208 - DNA, 33 bp, Piromyces finnis; identical to SEQ ID NO: 24204
  GLHYDRLASE6

SEQ ID NO: 24209 - DNA, 45 bp, Piromyces finnis
  GLHYDRLASE6
agatgcttacatgtggctcaagccaccaggtgaagctgatggttc

SEQ ID NO: 24210 - DNA, 48 bp, Piromyces finnis; identical to SEQ ID NO: 24205
  GLHYDRLASE6

SEQ ID NO: 24211 - DNA, 42 bp, Piromyces finnis; identical to SEQ ID NO: 24203
  GLHYDRLASE6

SEQ ID NO: 24212 - DNA, 63 bp, Piromyces finnis
  GLHYDRLASE6
ccaaacctggtgtaacttcgtttacgctggtttaggtgaaccatctcgcggaagtccagattt

SEQ ID NO: 24213 - DNA, 60 bp, Piromyces finnis
  GLHYDRLASE6
tggtgatttagctgctaaggccgaaaaggtcaagcaagttccaactgctgtttggttagc

SEQ ID NO: 24214 - DNA, 42 bp, Piromyces finnis
  GLHYDRLASE6
gactgttgtcttcattctttacatgattccaactcgtgattg

SEQ ID NO: 24215 - DNA, 33 bp, Piromyces finnis; identical to SEQ ID NO: 24204
  GLHYDRLASE6

SEQ ID NO: 24216 - DNA, 45 bp, Piromyces finnis; identical to SEQ ID NO: 24209
  GLHYDRLASE6

SEQ ID NO: 24217 - DNA, 48 bp, Piromyces finnis; identical to SEQ ID NO: 24205
  GLHYDRLASE6

SEQ ID NO: 24218 - DNA, 42 bp, Piromyces finnis; identical to SEQ ID NO: 24202
  GLHYDRLASE6

SEQ ID NO: 24219 - DNA, 63 bp, Piromyces finnis; identical to SEQ ID NO: 24212
  GLHYDRLASE6

SEQ ID NO: 24220 - DNA, 60 bp, Piromyces finnis
  GLHYDRLASE6
cgatgaattaaaggctaaggctaataatgtcatgaatgtttcttctgctgtttggttagc

SEQ ID NO: 24221 - DNA, 42 bp, Piromyces finnis; identical to SEQ ID NO: 24139
  GLHYDRLASE6

SEQ ID NO: 24222 - DNA, 42 bp, Piromyces finnis; identical to SEQ ID NO: 24203
  GLHYDRLASE6

SEQ ID NO: 24223 - DNA, 33 bp, Piromyces finnis; identical to SEQ ID NO: 24204
  GLHYDRLASE6

SEQ ID NO: 24224 - DNA, 63 bp, Piromyces finnis; identical to SEQ ID NO: 24212
  GLHYDRLASE6

SEQ ID NO: 24225 - DNA, 42 bp, Piromyces finnis; identical to SEQ ID NO: 24203
  GLHYDRLASE6

SEQ ID NO: 24226 - DNA, 48 bp, Piromyces finnis; identical to SEQ ID NO: 24205
  GLHYDRLASE6

SEQ ID NO: 24227 - DNA, 60 bp, Piromyces finnis; identical to SEQ ID NO: 24220
  GLHYDRLASE6

SEQ ID NO: 24228 - DNA, 42 bp, Piromyces finnis; identical to SEQ ID NO: 24139
  GLHYDRLASE6

SEQ ID NO: 24229 - DNA, 45 bp, Piromyces finnis; identical to SEQ ID NO: 24209
  GLHYDRLASE6

SEQ ID NO: 24230 - DNA, 42 bp, Piromyces finnis; identical to SEQ ID NO: 24202
  GLHYDRLASE6

SEQ ID NO: 24231 - DNA, 42 bp, Piromyces finnis
  GLHYDRLASE6
tgtcagtgtttaccttgatgctgctcacggtaaatggttagg

SEQ ID NO: 24232 - DNA, 45 bp, Piromyces finnis; identical to SEQ ID NO: 24209
  GLHYDRLASE6

SEQ ID NO: 24233 - DNA, 33 bp, Piromyces finnis
  GLHYDRLASE6
tcgtggtttaagtactaatgtttctaactacca

SEQ ID NO: 24234 - DNA, 63 bp, Piromyces finnis
  GLHYDRLASE6
cgaaacctggtgtaactttgttggtactggttttggtgaacgtccacaaggtaacccatctgg

SEQ ID NO: 24235 - DNA, 42 bp, Piromyces finnis
  GLHYDRLASE6
gcacttcattgttgataccggtcgtaatggtgttgatgtttc

SEQ ID NO: 24236 - DNA, 63 bp, Piromyces finnis
  GLHYDRLASE6
aggagaatggtgtaaccaaatgggatctggtattggtgctcgtccacaagccagtccaattgc

SEQ ID NO: 24237 - DNA, 45 bp, Piromyces finnis
  GLHYDRLASE6
tgatgctttctactgggttaagccatacggtgaatctgatggtac

SEQ ID NO: 24238 - DNA, 42 bp, Piromyces finnis
  GLHYDRLASE6
tttaactgtcttcgttgtttacgatttaccaggtcgtgattg

SEQ ID NO: 24239 - DNA, 42 bp, Piromyces finnis
  GLHYDRLASE6
ctacttcattgaagatacttctcgtaatggtgttaagaacga

SEQ ID NO: 24240 - DNA, 60 bp, Piromyces finnis
  GLHYDRLASE6
ctcttcccttattgctaaggctgaaaagatgaaggaatactctaacgctatctggttaga

SEQ ID NO: 24241 - DNA, 33 bp, Piromyces finnis
  GLHYDRLASE6
tcgtggtttcgcttccaacgttgctaactacac

SEQ ID NO: 24242 - DNA, 42 bp, Piromyces finnis
  GLHYDRLASE6
cattgctatgtaccttgatattggtcacgctttctggttagg

SEQ ID NO: 24243 - DNA, 42 bp, Piromyces finnis; identical to SEQ ID NO: 24239
  GLHYDRLASE6

SEQ ID NO: 24244 - DNA, 60 bp, Piromyces finnis
  GLHYDRLASE6
ctcctctcttattgctaaggctgaaaagatgaaggaatactctaacgctatctggttaga

SEQ ID NO: 24245 - DNA, 42 bp, Piromyces finnis; identical to SEQ ID NO: 24238
  GLHYDRLASE6

SEQ ID NO: 24246 - DNA, 45 bp, Piromyces finnis; identical to SEQ ID NO: 24237
  GLHYDRLASE6

SEQ ID NO: 24247 - DNA, 63 bp, Piromyces finnis; identical to SEQ ID NO: 24236
  GLHYDRLASE6

SEQ ID NO: 24248 - DNA, 33 bp, Piromyces finnis; identical to SEQ ID NO: 24241
  GLHYDRLASE6

SEQ ID NO: 24249 - DNA, 42 bp, Piromyces finnis; identical to SEQ ID NO: 24242
  GLHYDRLASE6

SEQ ID NO: 24250 - DNA, 33 bp, Piromyces finnis; identical to SEQ ID NO: 24241
  GLHYDRLASE6

SEQ ID NO: 24251 - DNA, 42 bp, Piromyces finnis; identical to SEQ ID NO: 24242
  GLHYDRLASE6

SEQ ID NO: 24252 - DNA, 42 bp, Piromyces finnis; identical to SEQ ID NO: 24238
  GLHYDRLASE6

SEQ ID NO: 24253 - DNA, 45 bp, Piromyces finnis; identical to SEQ ID NO: 24237
  GLHYDRLASE6

SEQ ID NO: 24254 - DNA, 60 bp, Piromyces finnis; identical to SEQ ID NO: 24240
  GLHYDRLASE6

SEQ ID NO: 24255 - DNA, 42 bp, Piromyces finnis; identical to SEQ ID NO: 24239
  GLHYDRLASE6

SEQ ID NO: 24256 - DNA, 63 bp, Piromyces finnis; identical to SEQ ID NO: 24236
  GLHYDRLASE6

SEQ ID NO: 24257 - DNA, 45 bp, Piromyces finnis; identical to SEQ ID NO: 24237
  GLHYDRLASE6

SEQ ID NO: 24258 - DNA, 60 bp, Piromyces finnis; identical to SEQ ID NO: 24240
  GLHYDRLASE6

SEQ ID NO: 24259 - DNA, 42 bp, Piromyces finnis; identical to SEQ ID NO: 24242
  GLHYDRLASE6

SEQ ID NO: 24260 - DNA, 42 bp, Piromyces finnis; identical to SEQ ID NO: 24239
  GLHYDRLASE6

SEQ ID NO: 24261 - DNA, 42 bp, Piromyces finnis; identical to SEQ ID NO: 24238
  GLHYDRLASE6

SEQ ID NO: 24262 - DNA, 33 bp, Piromyces finnis; identical to SEQ ID NO: 24241
  GLHYDRLASE6

SEQ ID NO: 24263 - DNA, 63 bp, Piromyces finnis; identical to SEQ ID NO: 24236
  GLHYDRLASE6

SEQ ID NO: 24264 - DNA, 63 bp, Piromyces finnis; identical to SEQ ID NO: 24236
  GLHYDRLASE6

SEQ ID NO: 24265 - DNA, 33 bp, Piromyces finnis; identical to SEQ ID NO: 24241
  GLHYDRLASE6

SEQ ID NO: 24266 - DNA, 45 bp, Piromyces finnis; identical to SEQ ID NO: 24237
  GLHYDRLASE6

SEQ ID NO: 24267 - DNA, 60 bp, Piromyces finnis
  GLHYDRLASE6
ctcttcccttattgctaaggctgaaaagatgaaggaatactctaacgctatttggttaga

SEQ ID NO: 24268 - DNA, 42 bp, Piromyces finnis; identical to SEQ ID NO: 24242
  GLHYDRLASE6

SEQ ID NO: 24269 - DNA, 42 bp, Piromyces finnis; identical to SEQ ID NO: 24239
  GLHYDRLASE6

SEQ ID NO: 24270 - DNA, 42 bp, Piromyces finnis
  GLHYDRLASE6
cttaaccgttttcgttgtttacgatttaccaggtcgtgattg

SEQ ID NO: 24271 - DNA, 63 bp, Piromyces finnis; identical to SEQ ID NO: 24236
  GLHYDRLASE6

SEQ ID NO: 24272 - DNA, 45 bp, Piromyces finnis; identical to SEQ ID NO: 24237
  GLHYDRLASE6

SEQ ID NO: 24273 - DNA, 42 bp, Piromyces finnis; identical to SEQ ID NO: 24238
  GLHYDRLASE6

SEQ ID NO: 24274 - DNA, 42 bp, Piromyces finnis; identical to SEQ ID NO: 24239
  GLHYDRLASE6

SEQ ID NO: 24275 - DNA, 60 bp, Piromyces finnis; identical to SEQ ID NO: 24240
  GLHYDRLASE6

SEQ ID NO: 24276 - DNA, 33 bp, Piromyces finnis; identical to SEQ ID NO: 24241
  GLHYDRLASE6

SEQ ID NO: 24277 - DNA, 42 bp, Piromyces finnis; identical to SEQ ID NO: 24242
  GLHYDRLASE6

SEQ ID NO: 24278 - DNA, 63 bp, Piromyces finnis; identical to SEQ ID NO: 24236
  GLHYDRLASE6

SEQ ID NO: 24279 - DNA, 33 bp, Piromyces finnis; identical to SEQ ID NO: 24241
  GLHYDRLASE6

SEQ ID NO: 24280 - DNA, 45 bp, Piromyces finnis; identical to SEQ ID NO: 24237
  GLHYDRLASE6

SEQ ID NO: 24281 - DNA, 60 bp, Piromyces finnis; identical to SEQ ID NO: 24267
  GLHYDRLASE6

SEQ ID NO: 24282 - DNA, 42 bp, Piromyces finnis; identical to SEQ ID NO: 24242
  GLHYDRLASE6

SEQ ID NO: 24283 - DNA, 42 bp, Piromyces finnis; identical to SEQ ID NO: 24239
  GLHYDRLASE6

SEQ ID NO: 24284 - DNA, 42 bp, Piromyces finnis; identical to SEQ ID NO: 24270
  GLHYDRLASE6

SEQ ID NO: 24285 - DNA, 42 bp, Piromyces finnis; identical to SEQ ID NO: 24239
  GLHYDRLASE6

SEQ ID NO: 24286 - DNA, 60 bp, Piromyces finnis; identical to SEQ ID NO: 24244
  GLHYDRLASE6

SEQ ID NO: 24287 - DNA, 42 bp, Piromyces finnis; identical to SEQ ID NO: 24238
  GLHYDRLASE6

SEQ ID NO: 24288 - DNA, 45 bp, Piromyces finnis; identical to SEQ ID NO: 24237
  GLHYDRLASE6

SEQ ID NO: 24289 - DNA, 63 bp, Piromyces finnis; identical to SEQ ID NO: 24236
  GLHYDRLASE6

SEQ ID NO: 24290 - DNA, 33 bp, Piromyces finnis; identical to SEQ ID NO: 24241
  GLHYDRLASE6

SEQ ID NO: 24291 - DNA, 42 bp, Piromyces finnis; identical to SEQ ID NO: 24242
  GLHYDRLASE6

SEQ ID NO: 24292 - DNA, 45 bp, Piromyces finnis; identical to SEQ ID NO: 24237
  GLHYDRLASE6

SEQ ID NO: 24293 - DNA, 42 bp, Piromyces finnis; identical to SEQ ID NO: 24238
  GLHYDRLASE6

SEQ ID NO: 24294 - DNA, 33 bp, Piromyces finnis; identical to SEQ ID NO: 24241
  GLHYDRLASE6

SEQ ID NO: 24295 - DNA, 42 bp, Piromyces finnis; identical to SEQ ID NO: 24239
  GLHYDRLASE6

SEQ ID NO: 24296 - DNA, 60 bp, Piromyces finnis; identical to SEQ ID NO: 24244
  GLHYDRLASE6

SEQ ID NO: 24297 - DNA, 63 bp, Piromyces finnis; identical to SEQ ID NO: 24236
  GLHYDRLASE6

SEQ ID NO: 24298 - DNA, 42 bp, Piromyces finnis; identical to SEQ ID NO: 24242
  GLHYDRLASE6

SEQ ID NO: 24299 - DNA, 42 bp, Piromyces finnis; identical to SEQ ID NO: 24239
  GLHYDRLASE6

SEQ ID NO: 24300 - DNA, 60 bp, Piromyces finnis; identical to SEQ ID NO: 24244
  GLHYDRLASE6

SEQ ID NO: 24301 - DNA, 42 bp, Piromyces finnis; identical to SEQ ID NO: 24238
  GLHYDRLASE6

SEQ ID NO: 24302 - DNA, 45 bp, Piromyces finnis; identical to SEQ ID NO: 24237
  GLHYDRLASE6

SEQ ID NO: 24303 - DNA, 63 bp, Piromyces finnis; identical to SEQ ID NO: 24236
  GLHYDRLASE6

SEQ ID NO: 24304 - DNA, 33 bp, Piromyces finnis; identical to SEQ ID NO: 24241
  GLHYDRLASE6

SEQ ID NO: 24305 - DNA, 42 bp, Piromyces finnis; identical to SEQ ID NO: 24242
  GLHYDRLASE6

SEQ ID NO: 24306 - DNA, 63 bp, Piromyces finnis; identical to SEQ ID NO: 24236
  GLHYDRLASE6

SEQ ID NO: 24307 - DNA, 45 bp, Piromyces finnis; identical to SEQ ID NO: 24237
  GLHYDRLASE6

SEQ ID NO: 24308 - DNA, 42 bp, Piromyces finnis; identical to SEQ ID NO: 24238
  GLHYDRLASE6

SEQ ID NO: 24309 - DNA, 42 bp, Piromyces finnis; identical to SEQ ID NO: 24239
  GLHYDRLASE6

SEQ ID NO: 24310 - DNA, 60 bp, Piromyces finnis; identical to SEQ ID NO: 24240
  GLHYDRLASE6

SEQ ID NO: 24311 - DNA, 33 bp, Piromyces finnis; identical to SEQ ID NO: 24241
  GLHYDRLASE6

SEQ ID NO: 24312 - DNA, 42 bp, Piromyces finnis; identical to SEQ ID NO: 24242
  GLHYDRLASE6

SEQ ID NO: 24313 - DNA, 45 bp, Piromyces finnis; identical to SEQ ID NO: 24237
  GLHYDRLASE6

SEQ ID NO: 24314 - DNA, 42 bp, Piromyces finnis; identical to SEQ ID NO: 24238
  GLHYDRLASE6

SEQ ID NO: 24315 - DNA, 33 bp, Piromyces finnis; identical to SEQ ID NO: 24241
  GLHYDRLASE6

SEQ ID NO: 24316 - DNA, 42 bp, Piromyces finnis; identical to SEQ ID NO: 24239
  GLHYDRLASE6

SEQ ID NO: 24317 - DNA, 60 bp, Piromyces finnis; identical to SEQ ID NO: 24244
  GLHYDRLASE6

SEQ ID NO: 24318 - DNA, 63 bp, Piromyces finnis; identical to SEQ ID NO: 24236
  GLHYDRLASE6

SEQ ID NO: 24319 - DNA, 42 bp, Piromyces finnis; identical to SEQ ID NO: 24242
  GLHYDRLASE6

SEQ ID NO: 24320 - DNA, 45 bp, Piromyces finnis; identical to SEQ ID NO: 24237
  GLHYDRLASE6

SEQ ID NO: 24321 - DNA, 60 bp, Piromyces finnis; identical to SEQ ID NO: 24240
  GLHYDRLASE6

SEQ ID NO: 24322 - DNA, 42 bp, Piromyces finnis; identical to SEQ ID NO: 24242
  GLHYDRLASE6

SEQ ID NO: 24323 - DNA, 42 bp, Piromyces finnis; identical to SEQ ID NO: 24239
  GLHYDRLASE6

SEQ ID NO: 24324 - DNA, 42 bp, Piromyces finnis; identical to SEQ ID NO: 24238
  GLHYDRLASE6

SEQ ID NO: 24325 - DNA, 33 bp, Piromyces finnis; identical to SEQ ID NO: 24241
  GLHYDRLASE6

SEQ ID NO: 24326 - DNA, 63 bp, Piromyces finnis; identical to SEQ ID NO: 24236
  GLHYDRLASE6

SEQ ID NO: 24327 - DNA, 33 bp, Piromyces finnis; identical to SEQ ID NO: 24241
  GLHYDRLASE6

SEQ ID NO: 24328 - DNA, 42 bp, Piromyces finnis; identical to SEQ ID NO: 24242
  GLHYDRLASE6

SEQ ID NO: 24329 - DNA, 42 bp, Piromyces finnis; identical to SEQ ID NO: 24238
  GLHYDRLASE6

SEQ ID NO: 24330 - DNA, 45 bp, Piromyces finnis; identical to SEQ ID NO: 24237
  GLHYDRLASE6

SEQ ID NO: 24331 - DNA, 60 bp, Piromyces finnis; identical to SEQ ID NO: 24240
  GLHYDRLASE6

SEQ ID NO: 24332 - DNA, 42 bp, Piromyces finnis; identical to SEQ ID NO: 24239
  GLHYDRLASE6

SEQ ID NO: 24333 - DNA, 63 bp, Piromyces finnis; identical to SEQ ID NO: 24236
  GLHYDRLASE6

SEQ ID NO: 24334 - DNA, 45 bp, Piromyces finnis; identical to SEQ ID NO: 24237
  GLHYDRLASE6

SEQ ID NO: 24335 - DNA, 60 bp, Piromyces finnis; identical to SEQ ID NO: 24240
  GLHYDRLASE6

SEQ ID NO: 24336 - DNA, 42 bp, Piromyces finnis; identical to SEQ ID NO: 24242
  GLHYDRLASE6

SEQ ID NO: 24337 - DNA, 42 bp, Piromyces finnis; identical to SEQ ID NO: 24239
  GLHYDRLASE6

SEQ ID NO: 24338 - DNA, 42 bp, Piromyces finnis; identical to SEQ ID NO: 24238
  GLHYDRLASE6

SEQ ID NO: 24339 - DNA, 33 bp, Piromyces finnis; identical to SEQ ID NO: 24241
  GLHYDRLASE6

SEQ ID NO: 24340 - DNA, 63 bp, Piromyces finnis; identical to SEQ ID NO: 24236
  GLHYDRLASE6

SEQ ID NO: 24341 - DNA, 45 bp, Piromyces finnis; identical to SEQ ID NO: 24237
  GLHYDRLASE6

SEQ ID NO: 24342 - DNA, 42 bp, Piromyces finnis; identical to SEQ ID NO: 24238
  GLHYDRLASE6

SEQ ID NO: 24343 - DNA, 33 bp, Piromyces finnis; identical to SEQ ID NO: 24241
  GLHYDRLASE6

SEQ ID NO: 24344 - DNA, 42 bp, Piromyces finnis; identical to SEQ ID NO: 24239
  GLHYDRLASE6

SEQ ID NO: 24345 - DNA, 60 bp, Piromyces finnis; identical to SEQ ID NO: 24244
  GLHYDRLASE6

SEQ ID NO: 24346 - DNA, 63 bp, Piromyces finnis; identical to SEQ ID NO: 24236
  GLHYDRLASE6

SEQ ID NO: 24347 - DNA, 42 bp, Piromyces finnis; identical to SEQ ID NO: 24242
  GLHYDRLASE6

SEQ ID NO: 24348 - DNA, 33 bp, Piromyces finnis; identical to SEQ ID NO: 24241
  GLHYDRLASE6

SEQ ID NO: 24349 - DNA, 42 bp, Piromyces finnis; identical to SEQ ID NO: 24242
  GLHYDRLASE6

SEQ ID NO: 24350 - DNA, 42 bp, Piromyces finnis; identical to SEQ ID NO: 24238
  GLHYDRLASE6

SEQ ID NO: 24351 - DNA, 45 bp, Piromyces finnis; identical to SEQ ID NO: 24237
  GLHYDRLASE6

SEQ ID NO: 24352 - DNA, 60 bp, Piromyces finnis; identical to SEQ ID NO: 24240
  GLHYDRLASE6

SEQ ID NO: 24353 - DNA, 42 bp, Piromyces finnis; identical to SEQ ID NO: 24239
  GLHYDRLASE6

SEQ ID NO: 24354 - DNA, 63 bp, Piromyces finnis; identical to SEQ ID NO: 24236
  GLHYDRLASE6

SEQ ID NO: 24355 - DNA, 63 bp, Piromyces finnis; identical to SEQ ID NO: 24236
  GLHYDRLASE6

SEQ ID NO: 24356 - DNA, 33 bp, Piromyces finnis; identical to SEQ ID NO: 24241
  GLHYDRLASE6

SEQ ID NO: 24357 - DNA, 45 bp, Piromyces finnis; identical to SEQ ID NO: 24237
  GLHYDRLASE6

SEQ ID NO: 24358 - DNA, 60 bp, Piromyces finnis; identical to SEQ ID NO: 24267
  GLHYDRLASE6

SEQ ID NO: 24359 - DNA, 42 bp, Piromyces finnis; identical to SEQ ID NO: 24242
  GLHYDRLASE6

SEQ ID NO: 24360 - DNA, 42 bp, Piromyces finnis; identical to SEQ ID NO: 24239
  GLHYDRLASE6

SEQ ID NO: 24361 - DNA, 42 bp, Piromyces finnis; identical to SEQ ID NO: 24270
  GLHYDRLASE6

SEQ ID NO: 24362 - DNA, 42 bp, Piromyces finnis
  GLHYDRLASE6
gaaattcattgttgatacttcccgtaacggtgctaacatttc

SEQ ID NO: 24363 - DNA, 45 bp, Piromyces finnis
  GLHYDRLASE6
tgatgcttacatgtggattaagactccaggtgaagctgatggttc

SEQ ID NO: 24364 - DNA, 42 bp, Piromyces finnis
  GLHYDRLASE6
cactgttgttttcgtcttatatatgattccaactcgtgattg

SEQ ID NO: 24365 - DNA, 42 bp, Piromyces finnis
  GLHYDRLASE6
cgtcagagtttaccttgatgctgctcacggtgcttggttatc

SEQ ID NO: 24366 - DNA, 48 bp, Piromyces finnis
  GLHYDRLASE6
caagggttacgttgacaagatctacaacactattaaccaatatccaaa

SEQ ID NO: 24367 - DNA, 60 bp, Piromyces finnis
  GLHYDRLASE6
tggttccttagctgaaaaggctaagaaggttaagtacgtcccaactgctgcttggttagc

SEQ ID NO: 24368 - DNA, 63 bp, Piromyces finnis
  GLHYDRLASE6
tggtacctggtgtaacttcaagggtgctggtttaggtgctcgtccacaaggtagcccagaccc

SEQ ID NO: 24369 - DNA, 33 bp, Piromyces finnis
  GLHYDRLASE6
tcgtggtatcagtactaacgtttctaactacca

SEQ ID NO: 24370 - DNA, 63 bp, Piromyces finnis
  GLHYDRLASE6
aggagaatggtgtaaccaaatgggatctggtattggtgcccgtccacaagccaacccaattgc

SEQ ID NO: 24371 - DNA, 42 bp, Piromyces finnis; identical to SEQ ID NO: 24077
  GLHYDRLASE6

SEQ ID NO: 24372 - DNA, 42 bp, Piromyces finnis; identical to SEQ ID NO: 24239
  GLHYDRLASE6

SEQ ID NO: 24373 - DNA, 33 bp, Piromyces finnis; identical to SEQ ID NO: 24241
  GLHYDRLASE6

SEQ ID NO: 24374 - DNA, 60 bp, Piromyces finnis; identical to SEQ ID NO: 24244
  GLHYDRLASE6

SEQ ID NO: 24375 - DNA, 42 bp, Piromyces finnis
  GLHYDRLASE6
cattgctatgtaccttgatattggtcacgccttctggttagg

SEQ ID NO: 24376 - DNA, 45 bp, Piromyces finnis; identical to SEQ ID NO: 24237
  GLHYDRLASE6

SEQ ID NO: 24377 - DNA, 63 bp, Piromyces finnis; identical to SEQ ID NO: 24370
  GLHYDRLASE6

SEQ ID NO: 24378 - DNA, 60 bp, Piromyces finnis; identical to SEQ ID NO: 24244
  GLHYDRLASE6

SEQ ID NO: 24379 - DNA, 42 bp, Piromyces finnis; identical to SEQ ID NO: 24239
  GLHYDRLASE6

SEQ ID NO: 24380 - DNA, 42 bp, Piromyces finnis; identical to SEQ ID NO: 24077
  GLHYDRLASE6

SEQ ID NO: 24381 - DNA, 42 bp, Piromyces finnis
  GLHYDRLASE6
cgtttctatgtaccttgatattggtcacgctttctggttagg

SEQ ID NO: 24382 - DNA, 45 bp, Piromyces finnis; identical to SEQ ID NO: 24237
  GLHYDRLASE6

SEQ ID NO: 24383 - DNA, 33 bp, Piromyces finnis; identical to SEQ ID NO: 24241
  GLHYDRLASE6

SEQ ID NO: 24384 - DNA, 63 bp, Piromyces finnis; identical to SEQ ID NO: 24370
  GLHYDRLASE6

SEQ ID NO: 24385 - DNA, 60 bp, Piromyces finnis; identical to SEQ ID NO: 24244
  GLHYDRLASE6

SEQ ID NO: 24386 - DNA, 42 bp, Piromyces finnis; identical to SEQ ID NO: 24239
  GLHYDRLASE6

SEQ ID NO: 24387 - DNA, 42 bp, Piromyces finnis; identical to SEQ ID NO: 24077
  GLHYDRLASE6

SEQ ID NO: 24388 - DNA, 42 bp, Piromyces finnis; identical to SEQ ID NO: 24375
  GLHYDRLASE6

SEQ ID NO: 24389 - DNA, 45 bp, Piromyces finnis; identical to SEQ ID NO: 24237
  GLHYDRLASE6

SEQ ID NO: 24390 - DNA, 33 bp, Piromyces finnis; identical to SEQ ID NO: 24241
  GLHYDRLASE6

SEQ ID NO: 24391 - DNA, 63 bp, Piromyces finnis; identical to SEQ ID NO: 24370
  GLHYDRLASE6

SEQ ID NO: 24392 - DNA, 42 bp, Piromyces finnis; identical to SEQ ID NO: 24381
  GLHYDRLASE6

SEQ ID NO: 24393 - DNA, 42 bp, Piromyces finnis; identical to SEQ ID NO: 24077
  GLHYDRLASE6

SEQ ID NO: 24394 - DNA, 42 bp, Piromyces finnis; identical to SEQ ID NO: 24239
  GLHYDRLASE6

SEQ ID NO: 24395 - DNA, 33 bp, Piromyces finnis; identical to SEQ ID NO: 24241
  GLHYDRLASE6

SEQ ID NO: 24396 - DNA, 60 bp, Piromyces finnis; identical to SEQ ID NO: 24244
  GLHYDRLASE6

SEQ ID NO: 24397 - DNA, 45 bp, Piromyces finnis; identical to SEQ ID NO: 24237
  GLHYDRLASE6

SEQ ID NO: 24398 - DNA, 33 bp, Piromyces finnis; identical to SEQ ID NO: 24241
  GLHYDRLASE6

SEQ ID NO: 24399 - DNA, 60 bp, Piromyces finnis; identical to SEQ ID NO: 24244
  GLHYDRLASE6

SEQ ID NO: 24400 - DNA, 42 bp, Piromyces finnis; identical to SEQ ID NO: 24077
  GLHYDRLASE6

SEQ ID NO: 24401 - DNA, 45 bp, Piromyces finnis; identical to SEQ ID NO: 24237
  GLHYDRLASE6

SEQ ID NO: 24402 - DNA, 63 bp, Piromyces finnis; identical to SEQ ID NO: 24370
  GLHYDRLASE6

SEQ ID NO: 24403 - DNA, 42 bp, Piromyces finnis; identical to SEQ ID NO: 24239
  GLHYDRLASE6

SEQ ID NO: 24404 - DNA, 42 bp, Piromyces finnis; identical to SEQ ID NO: 24381
  GLHYDRLASE6

SEQ ID NO: 24405 - DNA, 33 bp, Piromyces finnis; identical to SEQ ID NO: 24241
  GLHYDRLASE6

SEQ ID NO: 24406 - DNA, 42 bp, Piromyces finnis; identical to SEQ ID NO: 24375
  GLHYDRLASE6

SEQ ID NO: 24407 - DNA, 45 bp, Piromyces finnis; identical to SEQ ID NO: 24237
  GLHYDRLASE6

SEQ ID NO: 24408 - DNA, 60 bp, Piromyces finnis; identical to SEQ ID NO: 24244
  GLHYDRLASE6

SEQ ID NO: 24409 - DNA, 42 bp, Piromyces finnis; identical to SEQ ID NO: 24239
  GLHYDRLASE6

SEQ ID NO: 24410 - DNA, 63 bp, Piromyces finnis; identical to SEQ ID NO: 24370
  GLHYDRLASE6

SEQ ID NO: 24411 - DNA, 42 bp, Piromyces finnis; identical to SEQ ID NO: 24077
  GLHYDRLASE6

SEQ ID NO: 24412 - DNA, 33 bp, Piromyces finnis; identical to SEQ ID NO: 24241
  GLHYDRLASE6

SEQ ID NO: 24413 - DNA, 42 bp, Piromyces finnis; identical to SEQ ID NO: 24375
  GLHYDRLASE6

SEQ ID NO: 24414 - DNA, 42 bp, Piromyces finnis; identical to SEQ ID NO: 24239
  GLHYDRLASE6

SEQ ID NO: 24415 - DNA, 45 bp, Piromyces finnis; identical to SEQ ID NO: 24237
  GLHYDRLASE6

SEQ ID NO: 24416 - DNA, 60 bp, Piromyces finnis; identical to SEQ ID NO: 24244
  GLHYDRLASE6

SEQ ID NO: 24417 - DNA, 63 bp, Piromyces finnis; identical to SEQ ID NO: 24370
  GLHYDRLASE6

SEQ ID NO: 24418 - DNA, 42 bp, Piromyces finnis; identical to SEQ ID NO: 24077
  GLHYDRLASE6

SEQ ID NO: 24419 - DNA, 33 bp, Piromyces finnis; identical to SEQ ID NO: 24241
  GLHYDRLASE6

SEQ ID NO: 24420 - DNA, 60 bp, Piromyces finnis; identical to SEQ ID NO: 24244
  GLHYDRLASE6

SEQ ID NO: 24421 - DNA, 42 bp, Piromyces finnis; identical to SEQ ID NO: 24077
  GLHYDRLASE6

SEQ ID NO: 24422 - DNA, 45 bp, Piromyces finnis; identical to SEQ ID NO: 24237
  GLHYDRLASE6

SEQ ID NO: 24423 - DNA, 63 bp, Piromyces finnis; identical to SEQ ID NO: 24370
  GLHYDRLASE6

SEQ ID NO: 24424 - DNA, 42 bp, Piromyces finnis; identical to SEQ ID NO: 24375
  GLHYDRLASE6

SEQ ID NO: 24425 - DNA, 42 bp, Piromyces finnis; identical to SEQ ID NO: 24239
  GLHYDRLASE6

SEQ ID NO: 24426 - DNA, 60 bp, Piromyces finnis; identical to SEQ ID NO: 24244
  GLHYDRLASE6

SEQ ID NO: 24427 - DNA, 42 bp, Piromyces finnis; identical to SEQ ID NO: 24077
  GLHYDRLASE6

SEQ ID NO: 24428 - DNA, 33 bp, Piromyces finnis; identical to SEQ ID NO: 24241
  GLHYDRLASE6

SEQ ID NO: 24429 - DNA, 42 bp, Piromyces finnis; identical to SEQ ID NO: 24375
  GLHYDRLASE6

SEQ ID NO: 24430 - DNA, 42 bp, Piromyces finnis; identical to SEQ ID NO: 24239
  GLHYDRLASE6

SEQ ID NO: 24431 - DNA, 45 bp, Piromyces finnis; identical to SEQ ID NO: 24237
  GLHYDRLASE6

SEQ ID NO: 24432 - DNA, 63 bp, Piromyces finnis; identical to SEQ ID NO: 24370
  GLHYDRLASE6

SEQ ID NO: 24433 - DNA, 42 bp, Piromyces finnis; identical to SEQ ID NO: 24375
  GLHYDRLASE6

SEQ ID NO: 24434 - DNA, 60 bp, Piromyces finnis; identical to SEQ ID NO: 24244
  GLHYDRLASE6

SEQ ID NO: 24435 - DNA, 33 bp, Piromyces finnis; identical to SEQ ID NO: 24241
  GLHYDRLASE6

SEQ ID NO: 24436 - DNA, 45 bp, Piromyces finnis; identical to SEQ ID NO: 24237
  GLHYDRLASE6

SEQ ID NO: 24437 - DNA, 63 bp, Piromyces finnis; identical to SEQ ID NO: 24370
  GLHYDRLASE6

SEQ ID NO: 24438 - DNA, 42 bp, Piromyces finnis; identical to SEQ ID NO: 24077
  GLHYDRLASE6

SEQ ID NO: 24439 - DNA, 42 bp, Piromyces finnis; identical to SEQ ID NO: 24239
  GLHYDRLASE6

SEQ ID NO: 24440 - DNA, 60 bp, Piromyces finnis; identical to SEQ ID NO: 24244
  GLHYDRLASE6

SEQ ID NO: 24441 - DNA, 33 bp, Piromyces finnis; identical to SEQ ID NO: 24241
  GLHYDRLASE6

SEQ ID NO: 24442 - DNA, 45 bp, Piromyces finnis; identical to SEQ ID NO: 24237
  GLHYDRLASE6

SEQ ID NO: 24443 - DNA, 63 bp, Piromyces finnis; identical to SEQ ID NO: 24370
  GLHYDRLASE6

SEQ ID NO: 24444 - DNA, 42 bp, Piromyces finnis; identical to SEQ ID NO: 24077
  GLHYDRLASE6

SEQ ID NO: 24445 - DNA, 42 bp, Piromyces finnis; identical to SEQ ID NO: 24239
  GLHYDRLASE6

SEQ ID NO: 24446 - DNA, 42 bp, Piromyces finnis; identical to SEQ ID NO: 24381
  GLHYDRLASE6

SEQ ID NO: 24447 - DNA, 42 bp, Piromyces finnis; identical to SEQ ID NO: 24077
  GLHYDRLASE6

SEQ ID NO: 24448 - DNA, 33 bp, Piromyces finnis; identical to SEQ ID NO: 24241
  GLHYDRLASE6

SEQ ID NO: 24449 - DNA, 45 bp, Piromyces finnis; identical to SEQ ID NO: 24237
  GLHYDRLASE6

SEQ ID NO: 24450 - DNA, 63 bp, Piromyces finnis; identical to SEQ ID NO: 24370
  GLHYDRLASE6

SEQ ID NO: 24451 - DNA, 42 bp, Piromyces finnis; identical to SEQ ID NO: 24239
  GLHYDRLASE6

SEQ ID NO: 24452 - DNA, 60 bp, Piromyces finnis; identical to SEQ ID NO: 24244
  GLHYDRLASE6

SEQ ID NO: 24453 - DNA, 42 bp, Piromyces finnis; identical to SEQ ID NO: 24375
  GLHYDRLASE6

SEQ ID NO: 24454 - DNA, 57 bp, Neocallimastix californiae
  GLHYDRLASE8
accagatggtgaaatgtatttcatgatgtctcttctctttgctgctaaccgttggaa

SEQ ID NO: 24455 - DNA, 30 bp, Neocallimastix californiae
  GLHYDRLASE8
tatgtacgatgccatgcgttgtgctatgaa

SEQ ID NO: 24456 - DNA, 42 bp, Neocallimastix californiae
  GLHYDRLASE8
tcgttccgaaggtatgtcttatggtatgatgatctgtgtaca

SEQ ID NO: 24457 - DNA, 45 bp, Neocallimastix californiae
  GLHYDRLASE8
ctacgatggtttagtccactacttatctatgcttcatcttactgg

SEQ ID NO: 24458 - DNA, 54 bp, Neocallimastix californiae
  GLHYDRLASE8
tccatcttacgatttaccagcctttgttgatctcttctctcgttggtcaacaac

SEQ ID NO: 24459 - DNA, 30 bp, Neocallimastix californiae
  GLHYDRLASE8
catgtacgatgctatgcgttgtgctatgaa

SEQ ID NO: 24460 - DNA, 42 bp, Neocallimastix californiae
  GLHYDRLASE8
tcgttctgaaggtatgtcttatggtatgatgattgctgttca

SEQ ID NO: 24461 - DNA, 57 bp, Neocallimastix californiae
  GLHYDRLASE8
tccagatggtgaaatgtactttatgatgtcacttctctttgccgctaaccgttggaa

SEQ ID NO: 24462 - DNA, 45 bp, Neocallimastix californiae
  GLHYDRLASE8
ctatgatggtttagttcactacttagctatgcttcaccttctcgg

SEQ ID NO: 24463 - DNA, 30 bp, Anaeromyces robustus; identical to SEQ ID NO: 24459
  GLHYDRLASE8

SEQ ID NO: 24464 - DNA, 42 bp, Anaeromyces robustus; identical to SEQ ID NO: 24460
  GLHYDRLASE8

SEQ ID NO: 24465 - DNA, 57 bp, Anaeromyces robustus; identical to SEQ ID NO: 24461
  GLHYDRLASE8

SEQ ID NO: 24466 - DNA, 45 bp, Anaeromyces robustus; identical to SEQ ID NO: 24462
  GLHYDRLASE8

SEQ ID NO: 24467 - DNA, 57 bp, Piromyces finnis
  GLHYDRLASE8
tccagatggtgaaatgtacttcatgatgtcattactttttgccgctaaccgttggaa

SEQ ID NO: 24468 - DNA, 54 bp, Piromyces finnis
  GLHYDRLASE8
tccatcctacgatttaccagctttcgtagatctcttctctcgttggtctactac

SEQ ID NO: 24469 - DNA, 30 bp, Piromyces finnis; identical to SEQ ID NO: 24459
  GLHYDRLASE8

SEQ ID NO: 24470 - DNA, 42 bp, Piromyces finnis
  GLHYDRLASE8
tcgttctgaaggtatgtcttacggtatgatgatcgctgttca

SEQ ID NO: 24471 - DNA, 45 bp, Piromyces finnis
  GLHYDRLASE8
ctacgatggtttagttcactacttatctatgcttcatcttcttgg

SEQ ID NO: 24472 - DNA, 54 bp, Piromyces finnis; identical to SEQ ID NO: 24468
  GLHYDRLASE8

SEQ ID NO: 24473 - DNA, 42 bp, Piromyces finnis; identical to SEQ ID NO: 24470
  GLHYDRLASE8

SEQ ID NO: 24474 - DNA, 57 bp, Piromyces finnis; identical to SEQ ID NO: 24467
  GLHYDRLASE8

SEQ ID NO: 24475 - DNA, 45 bp, Piromyces finnis; identical to SEQ ID NO: 24471
  GLHYDRLASE8

SEQ ID NO: 24476 - DNA, 30 bp, Piromyces finnis; identical to SEQ ID NO: 24459
  GLHYDRLASE8

SEQ ID NO: 24477 - DNA, 57 bp, Piromyces finnis; identical to SEQ ID NO: 24467
  GLHYDRLASE8

SEQ ID NO: 24478 - DNA, 30 bp, Piromyces finnis; identical to SEQ ID NO: 24459
  GLHYDRLASE8

SEQ ID NO: 24479 - DNA, 54 bp, Piromyces finnis; identical to SEQ ID NO: 24468
  GLHYDRLASE8

SEQ ID NO: 24480 - DNA, 45 bp, Piromyces finnis; identical to SEQ ID NO: 24471
  GLHYDRLASE8

SEQ ID NO: 24481 - DNA, 148 bp, Neocallimastix californiae
  GLUCOSE-METHANOL-CHOLINE (GMC) OXIDOREDUCTASE
aactgttactgttacagtaaaatctattagtaacaatcaatgtgccgaaaaatggactcaatgtggtggacaaggatatacaggaccaacttgttgtaaatcaggatcaacttgtcatgaaattaataaatattattctcaatgtatt

SEQ ID NO: 24482 - DNA, 103 bp, Piromyces finnis; identical to SEQ ID NO: 19912
  GLUCOSE-METHANOL-CHOLINE (GMC) OXIDOREDUCTASE

SEQ ID NO: 24483 - DNA, 1428 bp, Neocallimastix californiae
  GLUCOSYLCERAMIDASE
aatttatgcgactaatttcaataatcgtaaattcgaaggttttggtaccagtttttgttggtgggcgaacagacttggttactctgatattttatctgaaaaggctgctaccctcttctacgataaaaaggaaggtttaggtcttactattattcgttataatattggtggtggtgataatccatctcataatcatattactagaacggattctaacatgccaggttatgccattaatccacgttataacggtaatggttcctacacctgggattacaattggaatagtgatttcaatcaaagaaatgctctacttaaagctatcgctaagaacaaggaagaaatcatcgttgaaggtttctctaattctccaccatactttatgactaattctggttgttcaaccggtaatactgatcctaataaggataacctaaagagtgacgcctatcctgcttttgctaaatatcttgcggatgttgcggagcacttcagcaaaagttggggagttaccttccaaagtatgaccccagtcaatgaaccatttactaattactggggagcaaatagtaaaaaacaggaaggatgtcactttgatcaaggaaattctgaatcaaaaattattgtagaacttcgtaaagccattgatcaaaagggcttaaagagtattcaaattagtggtacggatgaaactagtatcgatactcaaattacttcatatgaaaaacttagcaatgaagctaagaatattattactagaattgatacgcatacctatagtggtagtaaacgttatgaattaagagttcttgctgaaaatagtaagaagaatctttggatgtctgaagtcgatggtggaggtgttgcaggaacaaatgctggagaaatgggtgccggtttatggcttgctaaccgtattattgaagatttgaatggtcttagatcctctgcttgggtcttatggcaagtgattgataatcatattagtaagaatggatacaatggtaaaaaggatagtggtatggttaatttgaatggtggttactggggtattgctgttgccgatcatgataagaatgatattattcttacgcaaaagtactatgcttttggtcaattctctagatacattcgtccaggttacactatcattggttgttacaacaactctgttgcagcttatgatagtgtcggtaagaagcttgtgattgttgccactaatacagctaatactactaagacggttgatttcaacctctctgaattcactagtgttggttacaacattagagtcattagaaccagtggttctgttagtaatggtgaaaagtgggctgaacttaagccactcataccctacggtaaaggtttcaatgctgatttaaagggtaattctattactacttttattgttgatgatgttgaatg

SEQ ID NO: 24484 - DNA, 1425 bp, Anaeromyces robustus
  GLUCOSYLCERAMIDASE
aatctatgcttctaattttaataatcgtaaatttgaaggtttcggtacaagtttctgttggtgggctaatcgacttggttattctgattctttatctgaaaaagcagctactctattttatgataaagaaaaaggtttaggtcttactgttattcgttataatatcggtggtggtgatgatccaactcataatcatattactagaacagattctaacatgccaggttatgctattaatccaaaatacgatggtagatcttacacttgggattataattggaatagtgatagtaatcaaagaaatgttttattaaaatctgtagctaagaataaagatgaaattattgtggaagcattctctaattctcctccatattttatgacatattctggttgttctactggtaattttgatccaggtaaagataatcttagaagtgatgcttatccagctttcgctaaatatcttgctgatgttgctgaacatttcaaaactcattggggtgtttatttccaaagtattactcctactaatgaaccatacactaatttctggggagcaaatagttataaacaagaaggttgtcattttgatcaaggagaatctgaatcaaaaattattgttgaacttcgtaaagctattgatcaaaaaggattaaaagaaatgcaaattagtggtacagatgaaactagtattgatactcaaattacttcttttgaaaaacttagtaatgaagctaaaaatattattacaagaattgatactcatacatatggtggatggaaacgtgatgaattaagacttcttgctgaaaataatcataaaaacctttggatgtctgaagttgatggtaaaggtactgaaggtactaatgccggtgaaatgggtgcagctatttggttagctaatcgtattataggtgatttaaatggtcttagagcctctgcttgggttctttggcaagttattgataatcatattagtaaaaatggttataatggcagaaaagattctggtatgataaatattaatgaaggttactggggagttgccgttgctgatcatgataatgataatattattcttactcaaaaatattatggttttggtcaattcagtagatatattcgtccaggttatactattattggtagttataataattcagttgctgcttacgataatgaaggtaaaaaattagttattgtagcaaccaatacagctggttctaataaaattgttgattttgatctttctacctttactagtgttggttataatgttagagttattagaactagtggttcaatgagtaatggtgaacattgggctgaacttacacctcttattccatatggtaaaggtttcaatgctgaattaaaagctaattctattactacttttattgttgatgatgttgaatg

SEQ ID NO: 24485 - DNA, 816 bp, Anaeromyces robustus
  GLUCOSYLCERAMIDASE
aatttacgcttctaactttaataatcgtagatttgaaggttttggtacaagtttctgttggtgggctaatcgtcttggttattcagattctttagctgaaaaagctgctactctcttttatgataaagtcaatggtttaggtcttaccgttattcgttataatattggtggtggtgatgatccaactcatcatcatattactagaacagattcaaatatgccaggttatgctattaatccaagatatgatggtagatcatatacttgggattataattggaatagtgatgctaatcaaagaaatgttttattaaaatctgttgctaaaaatagagatgaaattattgtagaagctttctctaattctccaccatactttatgacgaattctggttgttccacaggtaattttgatgctaataaggataatcttaaaagtgatgcttaccctgcttttgctaaatatcttgctgatgttgctgaacatttcaaaacaagttggggtgttggtttccaaagtattacccctgttaatgaacccttcactaattattggggagctaatagtaaaaaacaagaaggttgtcactttgatcaaggtaattctgaatccaaaattattgttgaacttaaaaaagctattgatcaaagaggtttaagagatatgcaaattagtggtacagatgaaactagtattgatactcaaattacttcattccaaaaacttagtaatgaagctaaaaatattattactagaattgatacccatacttatggtggaagtaaacgtgatgaattaagacttcttgctgaaaa

SEQ ID NO: 24486 - DNA, 807 bp, Neocallimastix californiae
  Glyco_10
taagttcgttagtattcaaggtactaagggtagattcaatttcaatgattgtgatgcccactacaacaaagcaaaggaattaggtatggactttagaggtcacgctttaatttggcacagtatggctccaaagtggcttgaatacgaagattctaatactatgagaaattccatagttaatcacattacaactgtcttaaagcactacgaaggtaaaattgatacttgggatgttgttaatgaagctattgatgatgattccaatggtaatggttggaagtatcgtaattcattcctttaccaaaagaacagagatttcattgatcttgctttcaagactgctcgtcaagtagctccaaaggttaaacttttctacaacgattataatactgaaggtatttggggtaagagtgaatctgtttaccaatttgttgctgatttaaagaaacgtaatattccaattgatggtgttggtcttcaataccatgtcagtgttcaaaatcaaccacaattcaacaaaattaacgatttaattggtcgttactgtaagttaggccttgaagttcacattactgaattagatgtcagttgtgttaattcttgtaatgctggagatgttgaaagcagacaatcccaagttttcactaatgctttaaaggcttgtcttaacaactcctgttgtactgctttccttgtctggggtattggtgatccagacagttggttaggtaatgataagaagggtttacttttcaatggtaattaccaaccaaaatctcaatacaatgctctcttaaacgtcttaaa

SEQ ID NO: 24487 - DNA, 837 bp, Neocallimastix californiae
  Glyco_10
taaattctatacttttaacggttctcaaactttcaacacaaagccatgtgatgacactgttgctttcgctaagaagtatggagctaagttccgtggtcacaatcttttctggccagcttactctccacaatggttccaagatgctcatgatggtagtgacccagaagctgtaaaagaatacattcttgactatgttgctaaggttttagatcattacaaggatgaagaagatattatttactgggatgttattaatgaatctgttactgacgattctactgctaagaacatcaagttacgtactggttctgataacagtaatgaattcgaaggttgggatacttacacagaagatattttcaaggttgctcgtgaacacaccaacgaaaatgtaaagttattctataacgattacaatgccgaagcaaacaatggaaactttgatggaaaaactggtgctgttttcgaatacatcagatctatgagagaaaagggtgtcccaattgatggtgtcggcttacaaatgcacgtttcctgtaattggactccaaattatgaacaacttacaaagttaatttctcaatatgaagaaattggcgttgaagttcatattactgaaattgatgttaaaagaactcaatgtaaatctgctgaagctcaaaaagaagttttcatgaacgtcttcaaagcttgtttcgatcatgaaaactgtaaggtcttcactgtttggggttcctacgatgaagaatcctgggttggtgttgaaaatgaaccagttctttttgatgttgatatgtatccaaaggacatttactttgatatgttggactacgtttt

SEQ ID NO: 24488 - DNA, 807 bp, Neocallimastix californiae
  Glyco_10
taagtttgttagtattcaaggtacaaagggtaaattcaacttcaatgactgtgataatcacctcaagaaagctaaggaattaggtatggacttcagaggtcacgcccttgtttggcactctatggctccagattggcttaaaaatgaagattcaaaaactatgagacaatccatcgttaaccacattactaaggtcttacaacactatgacggtaagattgatacctgggatgttgttaatgaagctattgatgatgattccaatggtaatggctggaaataccgtaactccttcctttaccaaaagaacagagatttcattgatcttgctttcaagaccgctcgtcaagttgctccaaaggttaaacttttctacaacgactacaacaccgaaggtatttggggcaagagtgaatctgtctaccaatttattgctgacttaaagaagcgtaacattccaattgatggggtcggtattcaataccacgtcagtgtcaagaaccaaccccaattaaacaaaattactgacttaattggccgttactgtaagttaggccttgaggttcacattaccgaaattgatgtcagttgtgaaggtgcctgtaacaacggtgatgttcaaaaccgtcaagctcaagtcttcacaaatgccttaaaggcttgtcttgccaactcctgctgtaccgcttatcttgtttggggtattggggataatgacagttggttaggtgctgataagaagggtttacttttcgatggtagttacaagccaaaagctcaatacactgccctcttaaacaccttaaa

SEQ ID NO: 24489 - DNA, 915 bp, Neocallimastix californiae
  Glyco_10
gaaggctgaaaatattttagataaagccgcttcccaagctaatgcaaaaaaaggtgatgatatgccagttttaaaatttgatacaattgttgatggtttagaattctgtaaagaaaataacattaaaatgagaggtcacactttagtatggcatgttcaaactccagaatggttcttccgtactgactttagtgatagtggttcatatgtcaatgcagccaagatggaaaagcgtatggaaagttatattaaacaaatgttagaattcgttcaatattattatccaggtattgttgatgtttgggatgttgttaatgaagctgttgaaattgaaggtggtagttatgatgcctcaactggttggaatactcgtactagatataatggtagtccaaatccatggtatactactatgggcgctgactatgttattaaggctttccgtattgctcgtaaatatgctgacaaaaatgttaaacttatttacaatgattacaacacttttatgtcacaaaagactactgctatttgtaatcttattaaaaaattaaaggctgaaaacttagttgatggcgttggtcttcaatcttacttaaatgccgactggccaaatcgtaatgactataagactgctattcaaaagtttgctgctcttggtgttgaagttcaagctacagaattaactattagaactgatggtactgcaaataaatataatactcaagctaaacattatgaagaagttttcaagatttacaaagatttgaagaagagtggtgtcaatattactagtgttacagtctttggcttacaagatggttatttattttataataatgattcaactgatacacgtttatgggaccataatcttaagaaaaaaccagtttacaattctattatgaaagtattatc

SEQ ID NO: 24490 - DNA, 918 bp, Neocallimastix californiae
  Glyco_10
gaaagctgaatttatgttagataaaagtgcttctcaagccaacgctagaaatggtaatgatatgccagttttaaagtttgatacaattgttgatggtttagaattctgtaaggaaaataatattaagatgagaggtcacactttagtttggcacactcaagctccagaatggttcttccgtactggatttaatgataacggtagttatgttgataagaacaaaatggaaaaacgtatggaaagttacattaaacaaatgttagaatttattcaatattactatccaggtgtcattgatgtatgggatgttgttaatgaagctgttgaaattgctaacggtagttatgatgcttcatccggatggaatactcgtactaagtttgataacaacaagactaatccatggtatgcaactatgggtcctgactatgtatttaaggctttccgttttgctcgtaaatatgctgataagaatgtcaagcttatttacaacgattttaatacattccaatatccaaaaactgataatatctgtaaccttgttaagaaattaaaggctgaaaacttaattgatggtgttggtctccaatcttacttaggtccaagttggccaaatcgtaacgattacaagaacgctattcaaaagttcggtgctcttggtgttgaagttcaaattactgaattaactattagtgttgaaaatggtaataacaaattcactacccaagctaatcaatatagagatgttttcaagatctataaggacttaaagaaaagtggtgttaacatcactagtgttactgtcttcggtttacaagatcattacttattctatgataatgataatactgaaactcgtttatgggatggtaatcttaagaagaagccagtatacaatgctattatgaatgtattaaa

SEQ ID NO: 24491 - DNA, 810 bp, Neocallimastix californiae
  Glyco_10
taaatttgtaagtattcaatacactaaaggtaaatttaactttgacgattgtgataatcacttaaagaaagctaaggaattaggtatggctttcagaggtcatgctttaatatggcatgctatggctccaggttggcttgaacgtgaagatggaaatactatgaaacaatctattattaatcatattaccactgtattaaagcattatgaaggtaaaattgatacttgggatgtcgttaatgaagctcttgatgatagttctaatggtaatggttggaaacttcgtaattctttcctttatcaaaaggttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaaattcgaaaaaattaacaatttaattagtcgttactgtaaattaggtgttgaagttcacatcactgaattagatgtcagttgcgatgacaactgtcgtgacgcagacggtggtgagagcaagcaaggacaagtttacactaatgccctaaaggcttgtcttaataattcttgttgtactggtttccttgtttggggtattggtgataaggatagttggagaggtgttgaaagtaaaccattacttttcgatgctaactaccaaccaaagggtcaatacactgctatattaaacactttaaa

SEQ ID NO: 24492 - DNA, 693 bp, Neocallimastix californiae; identical to SEQ ID NO: 22919
  Glyco_10

SEQ ID NO: 24493 - DNA, 810 bp, Neocallimastix californiae
  Glyco_10
taaattcgttagtattcaatataataaaggtagatacaactttgatgattgtgataatcatttaaagaaagctcaagaattaggtatggctttcagaggtcacgctttaatttggcatgctatggctccaggatggcttgaacgtgaagatggtaacactatgaagcaatctattattgatcacattactactgtattaaaacattatgaaggtaaaattgatacttgggatgttgttaatgaagctatcgatgatggttctaatggtaatggttggaaattacgtaattctttcctttaccaaaaggttccaaactttattgatattgctttccaaactgctcgtaaggtctcaccaaaaactaaacttttctacaatgattacaacactgaaggtatttgggccaagagtgaatctgtttatcaatttgttgctgatatgaaaagacgtaatattccaattgatggtgttggtattcaatatcacgttggtatcaatgttcaaccacaattccaaaagattaatgatttaattggtcgttactgtaagttaggagttgaagttcatatcactgaattagatgtcagttgtgatgataattgtcgtgattgggatggtggtgaaagtaaacaaggacaagtttacactaatgctttaaaggcttgtcttggtaattcttgttgtaccggtttccttgtttggggtattggtgataaggatagttggagaggtgaagaaaacaagccattacttttcaattctaactatcaaccaaagggtcaatacacagctatcttaaatactttaaa

SEQ ID NO: 24494 - DNA, 807 bp, Neocallimastix californiae
  Glyco_10
taagctttcaggtattcaacaacaaaaaggtgtttacaatttcaatgattgcgataatcacttaaagaaggctcaagaattaggtatggatttccgtggtcactgtcttatctggcacgcttaccaaccatcttggttcgaaaatgctgatgctaatactttaaagaacgctattgttgatcatattactaagactttacaacattatgaaggaaagattgatacttgggatgttgttaatgaagctattgatgatagttctaatggtaatggttggaaaatgcgtaactccttcctttatcaaaaggttccaaactttattgatttagctttccaaactgcacgtaaggtttctccaaacactaaacttttctacaatgattacaatactgaaggtatttatggaaaatctgaatctgtttaccaattcgttaaagatttagtttcacgtaatattccaattgatggtgttggtattcaatatcacgtttctgtccaaagtcaaccacaatataacaagattaacgatttaatttctcgttactgtaaacttggacttgaagttcacattactgaacttgatgttaaatgtgataatcaatgttatagtggtaatgttgaacaacaacaagctacagtctttactaatgccttaaaggcttgtcttagtaactcttgttgtactggttaccttgtttggggtgttggtgacaacaattcatggttaggtagtgataagaagggtttacttttcgacggtaactacagaccaaaatctcaatacactgctgtccttaacatgttaaa

SEQ ID NO: 24495 - DNA, 807 bp, Neocallimastix californiae
  Glyco_10
taaattgtctggtattcaacagcaaaaaggtgtttacaacttcagtgattgtgataaccacttaaagaaagctaaagaattaggcatggacttccgtggtcactgtcttatctggcactcataccaaccatcttggttcgaaaatgctgatgcaaacaccttaaagaatgctatcgttgatcacattactaagactttacaacactatgaaggaaagattgatacttgggatgttgttaacgaagctattgatgacagttctaatggaaatggttggaaaatgcgtaactccttcctttaccaaaaagttccaaactttgttgatttagctttccaaactgctcgtaaagtttctccaaatactaaacttttctataacgattataatactgaaggtatttatggtaaatctgaatcggtataccaatttgtaaaagatatgatttctcgtaacattcctattgatggtgtaggtattcaatatcatgtttctgtttcaagtcagccaaaatacgaaaaaattaatgatttaatttcccgttactgtaaacttggtattgaagttcatattactgaactcgatgttaaatgtgataatcaatgcaacagcaataatgttgaacaacaacaagctacagtcttcactaatgctttaaaggcttgtttcagtaattcatgctgtaccggttatcttgtttggggtgtaggtgataatgatagttggttaggttctgacaagaaaggtttacttttcaatagtaactacaagccaaagtctcaatacaccgctattcttaatttcttaaa

SEQ ID NO: 24496 - DNA, 924 bp, Neocallimastix californiae
  Glyco_10
gaaatcattatttattcttaatcaagaaggtagtattaagaatcttaaagaaggtaaacaagatccagctttagatttcagtggtattgttgatggtttagatttctgtcaaaagaatggtattcacatgagaggtcatgttttagtttggcacaaccaagtcccaagatggttcttcaccaaagattattctgaagatggtgaatttgttgatccagaaactatggaataccgtttagatagtttcattagacaatatcttggttttgttcaatactactacccaggtgttgttgatgtttgggatgttgttaatgaagctgttgaagttgttggtgaacaatatgataattctactggttggtacactcgtactttatatgatgaagttaaaccaaacatgtggtatgatatgtttggtccagattacgttgttaaaactttccgtattgctcgtaagtatgcccttccaaatgttaaattagtttacaacgattactgtacttatgtcactaaaccaattagtaagagagatgctattgttaaacttcttggtattttacaaaaggaagatttagttgatgctattggtatgcaatcctacatcaacccagaagaagatgttaatgaccatttagcagctattgaagtataccaacaaaccggattagaaattcaaattactgaattaactattcgtgttaagaatactgatgactgggaagaatacaatattcaacaatacagtcaactctttgaaggtattatgaaatatgttagaaagggttacaatattggtagtgttactgttttcggtttacaagatggatacagattctatgaaaacgattccaccaagactcgtctcttcgatcacgatcttcaaaagaagaaggtttaccgtgctattatggatatcattaa

SEQ ID NO: 24497 - DNA, 924 bp, Neocallimastix californiae
  Glyco_10
gaaaccagaatttgttcttgataaggaaggttgtctcaaaaacgctgaaaatggatctgaagaagtcgtattaaaatttgatgatattgttgacggtttagattttgctttaaagaataatattcacgttagaggtcatgtattagtatggcacacccaaactccagattggttcttcagaaaaggattcaattctgaaaatgaatttgctgatgttgaaactatctatcaacgtttagaaagttatattcgtcaatatcttggatttgttcaacacaattatccaggtgtcattgatgtttgggatgttgttaatgaagctattgaaattaatgatggatatttcgataactctactggatggtataccagagtctctactcaaactgaagaaagtttatggtataagattgttggaccagattatgttaagaaaacatttgaaattgctcgtaaatacgctcttccaaatgttaaattagtttacaatgattacaatactttccaaacctatccacatgataaaactcaagccatcattgatcttatgaatattttaagaaaagataatttagttgatgctcttggtatgcaatcttatattggtgaaacttggccaaagattgaagaatatgttagagccattgaacgtttcactgaagctggtttagaacttcaaattaccgaattaaccattaccccaccaagtggagaaggttggttagaaaaacaagctcaacaatatcgtgaattctttgaaaaagttatggaacaaattaataagggagctaatattaccagtgttactgtatttggtattcaagatggatatagattctacacctctgacagtactaagactcgtcttttagatcatgatcttcaaaagaaaccaaattacgaagccattatggaagttttaaa

SEQ ID NO: 24498 - DNA, 918 bp, Neocallimastix californiae
  Glyco_10
gaaagctgatcaaatgttggataaggccgcctctcaagctaacgccagaagtggtaatgatatgccagttttaaaatttgattccatcgtggatggtttagaatactgtaaagcgaataacatcaagatgagaggacataccttggtttggcatgttcaagctccagaatggttcttccgtactggatttaacgataatggtaactatgtggataaaaataaaatggaaaaacgtatggaaagttacattaaacaaatgtttgaatttgttcagcactactatcctggtgtagttgatgtctgggatgtcgttaatgaagcggtcgaaattactaatggtagttttgatgcttcctccggttggaatactcgtactaaatatgataataataaaacaaatccatggtatgctaccatgggtcctgattatgtcttcaaagctttccgttttgctcgtaaatacgccaataaagatgttaaactcgtctataacgacttcaatacttttatgtctcaaaagacaaatgccatctgtaatcttgtaaagaaattaaaggctgaaaacttaattgatggtgttggtcttcaatcctacttaggtccaagctggccaaatcgtaatgactataagaatgccattcaaaagtttagtgctctcggtgttgaaattcaaattaccgaattaaccattagtgtcgaagaatccaataataaattcaatgctcaagctaatcactacagagatgtcttcaagatttataaggatttaaagaaaagtggtgttaacattaccagtgtcactgttttcggtttacaagatcactacttattctatgataatgataagacagaaactcgtttatgggaccgcaatcttaagaagaaacaagcttacaattctgtcatgagtgtcttaaa

SEQ ID NO: 24499 - DNA, 837 bp, Neocallimastix californiae
  Glyco_10
taaattctatactataaatggatctgaaactttcaacactaaggcttgtgatgaatctattgcttttgctaagaaacaaggtgctaagtaccgtggtcacaatcttttctggccagctaattctccaagttggtttaagagtgcttacgatggtaaagacccagaagaagttaaggaatacattcttgactacattacaaaggttttagatcattacaaggatgaagaagatatcatttactgggatgttattaatgaatcagttaccgatgattctaccccagaaaatattaaattacgtaccggatccgatactagtaatgaatttaagggttgggatacctatactgaagatatcttcaaacttgctcgtgaacacactaatgaaaatgttaaattaatttacaatgattataatgctgaagctaatggtggaaacttcggtggtaagactggtgctgtattccaatacattaaatccatgaaagaaaacggtgttccaatcgatggtgttggtttacaaatgcacatttcttgtaattggactccaaattacgaagaacttactaaattaatttctcagtatgaagaaattggtgttgaagttcatgttactgaaattgatgttaaaatggagaactgtaaaactcatgatgatcaaaggaaggtatacatgaacatcttcaaagcttgtttcgatcatgaaaactgtaaagtcttcactgtttggggtgcttacgattctgaatcatgggttggtgctgaaaacgaaccacttattttcgatgaagatatgtatccaaaggacatttactttgacatgttagattacgttat

SEQ ID NO: 24500 - DNA, 924 bp, Neocallimastix californiae
  Glyco_10
gaaagcagtatttgtacttaatcaagaaggtagtattaagaatcttaagaaaggtaaacaagatccagttttagatttcagtacttttgtggatggtttagatttctgtcaaaagaatggtattcacatgagaggtcatgtcttagtttggcacaaccaagctccaagatggttcttcacgaagaactatgaagaagatggtgaatatgtagatgctaaaacgatggaataccgtttagagagttacattaagcaatatcttagctttgttcaattcaattacccaggggttgttgatgtttgggatgttgttaacgaagccattgaagttgttgataatcaatatgataaatctactggttggtacactcgtaccttatacggtaataactcaccaaacatgtggtatgatatatttggtccagattacgttgtgaagaccttccgtattgctcgtaagtacgctcttccaaatgtcaaattagtttacaacgattattccaccttcgtcaccaagccagtgagtaagagagatgctatcattaaacttcttggtattttaaagaaggaagatttagttgatgccattggtatgcaatcctatattaatcccgatgaagatattaatgaatatttagctgctgtggatgaataccaaaaaactgggttagaaattcaaattactgaattaaccattcgtgtgaagagtacggatgattgggaagaatacaatattcaacaatactctcagctctttgaaggtcttatgaaacgtgttaagaaaggttacaatattggaagtgttactgttttcggtttacaagatggttacagattctatgaaaacgatactcaaaaattccgtcttttcgatcacgatcttaaaaagaagaaggtctaccatgccatcatgaaaatacttaa

SEQ ID NO: 24501 - DNA, 939 bp, Neocallimastix californiae
  Glyco_10
gaaaagtattaaaattatggatgaagaaggatctcgtaagaatatagccgaaggtagagaagaagttgctgttgacttttctggaattattgatggtcttgaatttgccaagaaaaatggtattcacattagaggtcacgtcttagtttggcacaaacaaactccagactggttcttcagaaaagattttgatactgaaaaggaatatgctgatgttgaaactatctttgttcgtttagaaagctacatgaaagctttctttgacttccttaacttcaattacccaggtgttgttgatgtctttgatgttgttaatgaagccattgaagtcagagaaggaaaattcgataactcaactggttggtacactcgtactgaatctcttgaaggtgatgacaatatttggaatactcttgttggtccaagttacgttgttagagctttccgtattgctcgtaaatacgctcttccaactaccaaattagtttacaatgatgttgataccttcatgactaagccacatgacaagacccaagctgttattgatctcatgaacatattaagagctgaagatttagttgatgcccttggtatggaatcttacattgatcaagacttagttaatgtagatgccccagaagactacgctcgtgccattgaacgtttcaccgaagctggtttagaaattcaaattacagaatttactatctacaatgatgatagagaagattggttagaaactcaaactaagagatacagagacttcttccaagttgttatagatcatgttaagaagggatatgataatatttctagtttcactgttttcggtttacaagatggatacagattctacgataatgatactcaaaaaactcgtctcttcgatcatgatcttcaaaagaagccaaactactatgccatcatggaaattttaaa

SEQ ID NO: 24502 - DNA, 831 bp, Neocallimastix californiae
  Glyco_10
taaattctataccattcaagcttctaaaacccgaaatttctatcaatgtgatcagtcattgtcctacgcaaaaaaatttggagccaagtatcgtggtcataatctcttctggccagcaaattcaccaaattggtttaagacctacagtgatgatattgaagttactaaaagctatattattgactacattaaaagtgttttaaatcattatcgtgatgatgatagtattatctattgggatgttattaatgaatcagttatggatgaatccacctccaatgatattcaattacgtacaggttcaaaaactagtgatgaatttttgggatgggatacgtataccgaggatatctttaaattagcaagagataatatcaatgaaaatgtcaaattgatttacaatgattattattgtgaagccaataatggtaattttgatggaaaaacaggtgcagttttcaattacattaaaaatatgaaggaaaaggaggttcctattgatggtgttggtcttcaaatgcatgtttcttgtaatgacgcaccatcatatgatgatctttacctgttgatttcacgatatgaagaaattggagttgaagttcacgttactgaaattgacgtaaccatggctcgttgtaacagtctcaaagatcaaaaggatgtctatatgaatattttcaaggcttgttttaatcataacaactgtaaagttttcactgtctggggagcctatgatacagaatcatggattggagctgagaatactccattaatatttgattcagatatgtatcccaaagatatctattttgaaatgttagattatgtttt

SEQ ID NO: 24503 - DNA, 915 bp, Neocallimastix californiae
  Glyco_10
gaaggctgaacatattttagataaatctgcttcccaagctaatgctaataaaggtaatgatatgccagtcttaaaatttgacactattattgatggtttagaattctgtaaggaaaacaatattaaaatgagaggtcacaccttagtttggcacgttcaaacaccagaatggttcttccgtacaaactttagcgatagtggttcatatgttaatgcccaaaaaatggaaaagcgtatggaaagttatattaaacaaatgctagagtttgttcaatactactacccaggtgttgttgatgtttgggatgtcgttaatgaagctgttgaaattgaaggtggtagttacgatagttctactggttggaacacacgtactaagtacaatggaagtgcaaatccatggtatgctactatgggtcctgattatgtcttcaaggcattccgatttgctcgtaaatacgctgacaaaaatgttaaacttatttacaatgattacaatactttcatgtcacaaaagactaatgctatttataatcttgtaaaaaaattaaagtctgaaaatttaattgatggtgttggtcttcaatcttacttaaacgctgactggccaaatcgtaacgattacaagaatgctatgcaaaggtttgcatctcttggtgtagaaattcaagctactgaattaactattaaaactgatggatctagtaataagttcaataatcaagctaaacactaccaagaagtcttcaagatttacaaagatttgaagaagagcggtgttaacattactagtgttacagtcttcggcttacaagatggctacttattctatagtaatgattcaaccgatactcgtttatgggaccataatcttaagaaaaagccagtttactattctattatgaatgctttaaa

SEQ ID NO: 24504 - DNA, 924 bp, Neocallimastix californiae
  Glyco_10
gaagcctctctacattttagataaggaaggaagtatccaaaatattaagaatggcattcaagatccaaagttaaactttactagtatcgtcgatggattagaatttgcttataaaaatggtatccacattagaggacatgtcttgatttggcacactcaaactccagattggttctttaatgaaggctatactgacgatggaaaaaaagtcagtccagaggttatggaatctcgtttagatagttatataaaacaatatcttagttttgtacaatttaattatccaggagtagtagatgtatgggatgttgtcaatgaagccatagaaattactgatggacaatatgatgccaatacaggatggtatacccgtaccatgttaaacaatacccctaatccatattacgatatgtttggaccagattacgtcattaaagccttccgtatagctcgtaaatatgctcttccaaatgtgaaattagtgtataacgatttcaatacattccaagtatggccccacaataagacacaagccattatggatttagccggaattttacagaaagaagatttaattgatggtattggattacaatcgtatttaggagtcacctggccatcccttgatgaatactttagaggtgtcgaaagattagccaccacaggacttgagcttcaaattaccgaattaactattaccgccccagatggagataattggttagaagcacaagcagaacaatacagagatttctttgaaagattaatgaagcatgttgaagaaggatacaatattggcagtgtcaccgtatttggacttcaagatggctatctcttctacgctagtgattcgacaaaaacaagacttcttgatcatgatcttcaaaagaagccaaactttgaggcgattatgagcattttaaa

SEQ ID NO: 24505 - DNA, 807 bp, Neocallimastix californiae
  Glyco_10
taaatttgttagtattcaaggtaccaagggaaaattcaactttaatgattgtgataatcatttaaagaaagctcaagaattaggtatggatttcagaggtcatgctttagtttggcatagtatggccccaaaatggcttgaaaacgaagatgcaaatactatgaaaaactctataattaatcatattactactgtattaaagcattatgaaggaaaaattgatacttgggatgtagttaatgaagctattgatgatagttctaatggtaatggatggaatatgcgtaaatccttcctttacaataaagttccaaactttattgatattgctttccaaactgctcgtcaagtatctccaaaaactaaacttttctataatgattataatactgaaggtatttggggaaagagtgaatctgtttaccaatttgttgctgatttaaagaaacgtaatattccaattgatggtgttggtattcaatatcacgttagtcttgaaaataatccacgtttcgacaaaattaatgatttaattagtcgttattgtaaattaggtgttgaagttcacattactgaaatggatgtcagttgtgacaaaaactgttgggccagtgatgttgaacaacaacaaggtaaagtttttactaatgctttacaagcttgtcttaacaattcttgttgtaccggtttccttgtttggggtattggtgataacgatagttggattggtggtgataagaaaggtttacttttcaattccaattaccaaccaaagtctcaatacactgctgtcttaaatctcttaaa

SEQ ID NO: 24506 - DNA, 924 bp, Neocallimastix californiae
  Glyco_10
gaaacctgaatatatttttgataaagaaggatgtctcaaaaatgcagaaaatggttcagaagaaatggctttaaaatttgatgatattgtggatggtttagattttgctttaaagaataatattcatattagaggtcatgtattagtatggcataaacaaactccagattggttcttcagaaaaggatttaattctgaaaatgaatttgccgatgtcgatacgatctattatcgtttagaaagtttcattaaacaatatcttggatttattcaatttaattatccaggagtcattgatgtttgggatgttgttaatgaagcagttgaaattaatgatggcagctttgataattctacaggatggtacactagaactatgacaggagatgaagaaagtttatggtataaagtagtaggaccagattatgttaagaaaacatttgaaattgctcgtaaatatgcacttccaaatgtcaagttagtatataatgattataatactttccaaacttatccacatgataaaactcaagccatcattgatctcatagatattttaagaaaagataatttaatcgatgccattggtatgcaatcatacattggagtgaattggccaagtgttgatgaatatataagagccattgaacgtttcactgaagccggattagaaattcaaattaccgaattaaccattacagcaccaagtggcgatgattggttagaaaaacaagctcaacaatatggagaattatttgaaagaatcatggaacaaattaaaaagggagctaatatttctagtgtaacagtttttggattacaagatggatatagattctattcctctgatagtactaaaactcgtcttttagatcatgatcttcaaaagaaaccaaattacgaagctattatgaaagttttaaa

SEQ ID NO: 24507 - DNA, 924 bp, Neocallimastix californiae
  Glyco_10
gaaaccttcgtatttactagatcaaaatggaagtcaaaaaaatattatgaaaggaatacaagatccatcagtaaatttccaatcggcaatagatactttagaatattgtaaaaagaataatataaaaatgagaggacatactttagtatggcacactcaaacaccatcatggttctttaaaaaagattatgatgataaaaatgattatgttgattctgaagtaatggaattgcgtatagaaagttatataaaacaggttatgcaattcgttcaatattattatccaggcgttgtagatgtatgggatgttgttaatgaagcggttgaaattgatgaaggatactatgatgaaaaagtatcatggaaaactcgaacaaaatgtaatgaatcatccaatccttggtatgaaacaatgggtcctgattatgtaattaaagcatttagatttgctagaaaatatgcagctcctggtgttaaattaatatataatgattataatacttttatgagtgaaaagacaacagcaattattaatctcttaaaaattttaaaagaagaaaatttaattgatggaattggaatgcaatcatatcttaccccaacttttccagaacgaagtacatatgctaatgctattaagaaattcggtgaattaggaatagaagtacaaattactgaattaactataagcattgatgataaattatcagaagaagagatgtatgaaaaacaagctgaacaatataaggaggtttttgaaatatatcttaaagcgtatcataatggtattaatattggaagtgttactgtatttggtttacaagatggctacctattttataccaatgattcaacgaaaactcgtttatgggataaagatttacaaaaaaagaagaattattattcaattttggaagttttaaa

SEQ ID NO: 24508 - DNA, 807 bp, Neocallimastix californiae
  Glyco_10
taaatttgttagtattcaaggtactaaaggtaaattcaactttaatgattgtgatgctcacttaaataaggctaaacaattaggtatggatttcagaggtcacgctttaatttggcacagtatggctccaaaatggcttgaaaatgaagattccaatagtatgaaaaattctattgttaaccatattacaaatgtcttaaaacactacgaaggaaaaattgatacatgggatgtagttaatgaagctattgatgatagttctaatggtaatggctggaaaatgcgtaattccttcctttaccaaaaggttccaaatttcattgatctttctttccaaaccgctcgtaaagtttctccaaaaactaaacttttctataacgattataatactgaaggtatttggggaaagagtgaatcggtttaccaatttattgctgatttaaagaagcgtaatattcctattgatggtgttggtcttcaataccacgttagtgtccaacatcaaccacaattcaataagattaatgatttaattggacgttactgtaaattaggtgttgaagttcatattactgaattagatgtcagttgtgttgaatcctgttatgctggtgatgttgaaaagaaacaatctgatgtctttactaatgccttaaaggcttgtcttggtaattcatgttgtactggatttcttgtttggggtattggtgatccagatagttggttaggtagtgataagaagggcttacttttcaatagtaattaccaaccaaaatcacaatacacggctgtattaaatgtcttaaa

SEQ ID NO: 24509 - DNA, 693 bp, Neocallimastix californiae
  Glyco_10
aacttacagtagtgatattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttat

SEQ ID NO: 24510 - DNA, 807 bp, Anaeromyces robustus; identical to SEQ ID NO: 24505
  Glyco_10

SEQ ID NO: 24511 - DNA, 831 bp, Anaeromyces robustus
  Glyco_10
taagttttacactttccaaggtactgaaactttcaacacaaaaccttgtgatgacagtattgcttttgctaagaaattaggtgccaaattccgtggtcacaatcttttctggccagcttactctccatcatggttcaaaacttacagtagtgatattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttat

SEQ ID NO: 24512 - DNA, 807 bp, Anaeromyces robustus
  Glyco_10
taaactttctggtattcaacaacaaaaaggtgtttacaatttcaatgattgtgataatcattataagaaggctaaagaattaggtatggacttccgtggtcactgtcttatttggcatgcctatcaaccatcatggttccaaaatgctgatgctaacacattaaagaacgctattgttgatcacattactaaggtacttcaacattatgatggtaaaattgatgcctgggatgttgttaatgaagctattgatgatagttctaatggtaatggatggaagatgcgtaattccttcctttaccaaaaggttccaaactttattgatttagctttccaaactgctcgtaaagttgctccaaatgttaaacttttctataatgattataatactgaaggtgtttacgctaaaactgaatctgtttatcaatttattcaagatatgattaaacgtaatattccaattgatggtgttggtattcaatatcacgttgctgttaatcaacaaccatcttaccaaaagattaatgatttaattggtcgttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttcttaa

SEQ ID NO: 24513 - DNA, 810 bp, Anaeromyces robustus
  Glyco_10
taaatttgttagtattcaaggtactaaaggtagatataattttgatgattgtgataatcatcttaaaaaagctcaagaattaaaaatggatttcagaggtcatgctttaatttggcattctatggctccacaatggcttgaacgtgaagattctaatactatgaaacaatctattattgatcatattactactgttttaaaacattatgaaggtaaaattgatacttgggatgttgttaatgaagctattgatgatggttctaatggtaatggttggaaattacgtaattctttcctttatcaaaaagttccaaatttcattgatattgctttccaaactgctcgtaaagtttctccaaatactaaacttttctataatgattataatacagaaggtatttgggcaaaaagtgaatctgtttatcaatttgttgctgatatgaaaaaacgtaatattccaattgatggtgttggtatacaatatcatgttggtgttaatgttcaacctcaatttgataaaattaataatttaattagtcgttattgtaaattaggtgttgaagttcatattacagaattagatgttagttgtgatgataattgtaatgatagagatggtggtgaaggtaaacaatctcaagtttatattaatgctttaaaagcttgtcttaataattcttgttgtactggtttccttgtttggggtattggtgatagtgatagttggagaggtgctgaaaataaaccattacttttcaattctaattatcaaccaaaaggacaatataatgctattttagaaactttaaa

SEQ ID NO: 24514 - DNA, 915 bp, Anaeromyces robustus
  Glyco_10
gaaagctgaacatatgttagataaaacagctagtcaaaataatgctaaaaatggtaatgatatgccagttttaaaatttgataccattattgatggtttagaattttgtcaaaaaaataatgtaaaaatgagaggtcatactttagtttggcatactcaaactccttcttggtttttccgtactaatttccaagataatggttcatttgttaatgcttctaaaatggaaaaacgtatggaaagttatattaaacaaatgttagaatttattcaatattattatccaggtgtagttgatgtttgggatgttgttaatgaagctgttgaaattactaatggttcctacgatagttctacaggatggaatactcgtacaaaatttgatggaggtgataatctttggtataaaactatgggtgctgattacgtttttaaggctttccgttttgctcgtaaatatgctgataaaaatgttaaacttatttataatgattataatacttttatgtctcaaaaaactaatgctattagtaaccttattaaaaagttaaaagctgaaaatttagtggatggagttggtcttcaatcttacttaaatgctgattggccaaatcgtaatgattataaatctgctattcaaaaattcagttctcttggagttgaaatccaaattactgaattaactattaaaacagatggttctggtaataaatttaataatcaagctactcattatcaacaagttttccaaatttataaagatttaaagaaaagtggtgttaatattactagtgttactgttttcggtttacaagatggttacttattctacagtaatgatagtactgatactcgtttatgggatcataaccttaaaaagaaaccagtatacaacgccattatgaaggttttaaa

SEQ ID NO: 24515 - DNA, 927 bp, Anaeromyces robustus
  Glyco_10
gaaatcactttttattatggatcaagaaaagtcacttaagaacttagcagaaggtaaagaagaagttggtataaatttctcaggagttatagatggtttagaattttcagctaaaaataatcttaatattagaggacatgttttagtttggcataagcaaactccagaatggttttggagaaaagattttgatgaaactaaagaatatgtcgatcgtgaaactattttcaagcgtttagatagtttcatgaaaaattattttgatttcttaaatttcaactacccaggtgttgtagatgttgttgatgttgttaatgaagctgttgaagttcttgaaggaaaatatgataattctactggttggtacactcgtacagaatcatatgaaggtgatgaaaacatttggtataacttagttggaccagattatgttaaggaagctttccgtattgctcgtaaatatgcacttccaaccactaaattagtttataatgattatgatacttggagaactactcctcatgataaaactgaagctattattaatcttatgaaaatattaaaagctgaagatttagttgatgttattggtatggaatcttatattactccaggtgaaccaactccagaagaatatggtaaagctattgaacgttatgctgctgaaggattagaaattcaaattactgaatttactatttatgttactgatggtgatgattggttagaacaacaaaccattcattatcgtgatatgttcaaagctattatggaagcttataaaaagggagctaatattactagtttcactgttttcggtttacaagatggttatagattctatgatagtgatagtactagaactcgtttatatgaccacgatcttcaaaagaaaccaaacttccaagctattatggatatcttaaa

SEQ ID NO: 24516 - DNA, 927 bp, Piromyces finnis
  Glyco_10
gaatccaagtgctattttagatcaacaagcttctattgataatattatgaatggtaatgaagatcctattctaaattttagtaatattgttgatggtttagattttgcctataaaaatggacttaatattcgtggtcatgctctagtatggcatactcaagttccagaatggttctttagagatggatattatagcaatacagaatttgttagtagagatgttatggagtatcgtttagatagttatattcgtaagttccttggatttgttcaatttaattatccaggaacagtagatgtttgggatgtagttaatgaagcaattgaaattacagatggtcaatatgatgaaacaactggatggtatacccgtactgctaataataaaacaccaaatccttggtatgaaatatttggacctgattatgttgcaatagcattccgtattgctcgtaaatatgcccttcctaatgtaaagttaatttataatgatcataatactttccaaatccaaccacatgataaaactcaagccattattgatcttgccaatattttacaacaagaaaacttaattgatggtattggtatgcaatcttatataggagttacttggccaaatttagatgattactttaacggtttagaaaggttaattacttctactggattagaaattcaaattactgaattaacaattactccaccaataggtgataattggttaggtgctcaagcagaacaatattatgagtacttcaatagacttttatcttacattaaaaatggttataacatttctagtgtcactgtttatggtttacaagatggctatagattctacactaaagattctaccaaaactcgtcttttagatcatgatcttaaaaagaaaccaaatttcaatgctattataaatgtattaaa

SEQ ID NO: 24517 - DNA, 447 bp, Piromyces finnis
  Glyco_10
gaaaccacttttcgttcttgaccaagctggttgtcaaaagaacttcaagaatggtagtaatgaaattgctcttaattttactccatttgttgatggtttagattatgctcaaaagaatggtcttcatattagaggtcacgttttagtctggcacaagcaattcccagactggttctttagagaagaatttgacgatgctaaggaatacgtttctgaagaagttatttacgaacgtttagaaaactatattaaacaatatctcggtttcgttaactacaactacccaggtgttgttgatgtttgggatgttgttaatgaagctgttgaagttttagaaggaaaattcgataacagtactggatggtacactcgtactattacttatgaaggtgatagaaacatctggtatgactttgttggtccagattatgttgttaaaactttccg

SEQ ID NO: 24518 - DNA, 831 bp, Piromyces finnis
  Glyco_10
taaattctacactattcaaggtactcaaactttcaatactaaacaatgtgatgattcaattgcttttgctaagaaattcggtgctaaattccgtggacataatcttttctggccagccaactctccagattggttcaaaaattacagtgatgatattgaagaagttaaagcttattatcttgactatgttgccaaggttttagaccattacaaagatgaagaagatatcatctactgggatgttgttaatgaatccgtcactgatgattctactatcgataagtataagttacgttatggttctgatagaagtaatgaattcaagggttgggatacttacactgaagatattttcactcttgctcgtgaacatactaatccaaatgttaaattaatttacaatgattataatgctgaaaacaacaacggtaacttcaatggtaaaactggtgctgtttacaagtatattaaggaaatgaaagaaaagggtattccaattgatggtgtaggtttacaaatgcacatttcttgtaactacactccaaactacgaacaactcactgaattaattgatatgtacaaagaaatcggtgttgaagttcatgttactgaaattgatgtcagtatgaagaattgtaaaactcatgaccaacaaagaaaattatatatggatgttttcagagcttgttttgataatgaaaactgtaaggtttttactgtttggggtgcttatgatactgaatcatggattggtgcttcaaacgttccattaccatttgatgatgatatgtatccaaaggatatctactttgatatgttagaatatgttat

SEQ ID NO: 24519 - DNA, 807 bp, Piromyces finnis
  Glyco_10
taagttatctggtattcaacaaagacaaggtaactacgattttagtgattgtgataatcactataagaaggctaaggaattaggtatggctttccgtggtcatgctcttatctggcacgcatacatgccatcttggtttgaaaatgctaatgcttcaaccttaaagaatgccattgttgaacatgttaccaaggttcttcaacactacgaaggtaaaattgatacttgggatgttgtcaatgaagctattgatgacagttcaaatggtaacggttggaagatgcgtaactccttcctttatcaaaaggttccaaactttgttgatcttgcttttgaaactgcccgtaaggtttctccaaatactaagctcttctacaacgattacaatactgaaggtatttacggaaaaactgaatccgttttccaattcgttaaggacatgaaatctcgtggtattccaattgatggtgttggtattcaatatcacgtttctgttgacagtcaaccacaatacaacaagattgatgatttaatttctcgttactgtggtcttggtcttgaagttcacattactgaacttgatgttaagtgtggtagccaatgttcttcatctaatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaa

SEQ ID NO: 24520 - DNA, 807 bp, Piromyces finnis; identical to SEQ ID NO: 24519
  Glyco_10

SEQ ID NO: 24521 - DNA, 1065 bp, Neocallimastix californiae
  Glyco_18
aataattgttggttatttcagtgaatggaaaaatgcgaactatcctattagtcgtgtagatttatcaaaaattacacatcttaattatgcatttggtgtaattgatccaaattcatatgctgtaactggatatgatagtaatattttaagtcaagttgtcactgctgcacacagtcaaggagtaaaagttcttatgtctgtaggtggatggtatggaagtcgttactttactcagatgacttcttcaaaaagtaacatagaaaagtttgttgacagttgtcaaagtcttatcagtaattatggtgttgatggtattgatattgattgggaatacccaggaagagaaggcgcatgtaatagcccagatatggcaaatgatgcagaaaattatttaactcttttaaagatcttacgtgaaaagatcggaaatgctctaatttctgctgctgtcagtgttataccgtttgaaaagaatggtcaaccaatttcagacctttctgaatatgaaaaatactttgattatattaatgttatggcatatgattttgctggtagttggacacctactgtttctcatcactctgctttatatgacccagaagctggtgaaaagttgtctctatcttcaggtgtaaagaattggttaagtcgtggttttccagctaataaaattgttgttggtgtaccagcttatggaaagagttggattgctgcatcttcaaatagaaatggtttatatcaatctgttgctaatggaaatccaaaaggtgatcatgaagatagtaattcaccatggactaactattgtggagttcttgaaagtgcttacagtggaaattggaaatataaaaatattcgtagtgaaatcttaaaatctgattacacaactgcttcaggtagttgggttcgttcatgggatgataaagttaagggtccatatttatttaataaggaaactaaacaaatcattacatacgatgatccagaaactattcaatataaagctaaatatattattgataacaactttggtggtatgatgatttgggaattagaaaatgatac

SEQ ID NO: 24522 - DNA, 1056 bp, Neocallimastix californiae
  Glyco_18
atcaattattatttattatccagaatggaagtactataactatccaccaaggaatcttccatttaacaaacttactcatataaattatgcctttggtgaaattgatccaactaattattcattaaaatatgactctactaagtttttagaattgattgaaactgctcgtagtagaaataaaaatgttaaaattataatgtctgttggtggttggactggaagtagatatttctcagttatgtcatcaaatcctgcaaacagatccaaatttataagtagtgttaaatcgatgttagaaagtactggtgctgatggtattgatattgattgggaacacccaggagtacctggtgctttttatgatagttttgatgcccaaaatgatacctataatttattaaaattgatgcaagaattacgtgaagctattggtaaatcaaaaattatttcaactgctgtaacgttcaatttatttgttgtgaactatcaaccattacaagacttatctaaatttgccgaaatattagattatattaatcttatgtgttatgattttaatggaagttggtcaaatattatatcacatcaatcttcactatacccaactggaggaaatgatagtggattttctgtagaaggtgctgttaaaaattggatgaatgctaaatttccatctaacaaaattgttattggtattccttcttatggtatatcatggatttcaagtacatctaataataatggtttacttcaaataccatccaattctttcccaaaaggtgatgaagaagatgtcatgaatgcagaatcaggaagatacagtggtatttggaaatataaaaatcttcgtaaacagattttacaatctagtttcaaagatgcaactggtgattggattcgtgtatgggattcaaaatctagtgttccttacttatataataaagtttcaagacaatttattacttatgatgatccagaatcagtgaaaattaaagctgattatgtaatcgaaagaaatttaggaggtatgatgatgtgggaaattgaagaagatac

SEQ ID NO: 24523 - DNA, 1056 bp, Neocallimastix californiae
  Glyco_18
atcaatcattgtttactatccagaatggaagtattacgatttcccaccaaagaatattccatttaataagcttactcatataaattatgcgtttgccgaaattgattcaaatgattattcattagattatgattcaagtagatttttagaattagttgaaactgctcatgaaaaaaataaaaatattaaagttttaatgtccattggtggctggacaggtagtaagtattactcaaaaatggcatcttcttcttctcgacgatcaaaatttgttaagagtgtgaaaagaatgttggaagcaagtgatgcagatggtattgatattgattgggaatatccaggtacaagtggtgcttatgatgataattttgatgctgaaaatgatacaaataatttattgaaattgttaaaggaattacgtgaagctattggttcttcaaaaattatttctgctgctgttccatttaatacatttgaagtggactctcgtccattaaaagatatgtctgaatttgctgaattgtttgactatgttaatattatggcttacgattttgctggaagttggtcaaccgttacatctcatcaatcttcactgtattcaatttcagaagatgataatggctattctttatctggtgcggtaagtaactggataaatgctaatttcccttcaagtaaaattgttgttggtattcctgcttatggaagatcatggatttctggtagttcctcaaacaacggttatcttcaaagaccatctaattctcatccaaagggagatgaagaggattacattgattctagttcaaaaagatatagctctacctggaaatataaaaatattcgtaaagcaattgtaaaatctacttataaaaattcgtcaggggattggattcgtatatgggattcaaagtcgagtgttccatttctttttaatacgaatactagacaatttattacctatgatgatccggaatcagtatctcttaaagccgattacgttataaataaaaatttaggtggaatgatgatgtgggaaattgaagaagatac

SEQ ID NO: 24524 - DNA, 1056 bp, Neocallimastix californiae
  Glyco_18
atcaataattgtgtattatccagaatggaagtattataattttccaccaaagaatattccatttaataaacttactcatataaattatgcatttgctgaaattaattcaagtgattattccttagaatatgattcaagtaaatttttagaattagttgaaactgcacatgaatataataaaaatattaaggtattaatgtcaattggtggttggacaggtagtagatattattcaaaaatggcatcctcttcttctaatagatcaaaatttgttaaaagtgtaaaaagaatgctagaagctagtggtgctgatggtatagatattgattgggaatatccaggaacaagtggtgcttatgatgataacttcgatgctaaaaatgatacaaataatttattaaaattattgcaagaattacgtgcctcaattggttattcaaaaattatttctgctgctgtaccatacaacacatttgaagttaattataaaccattagaagatatgtctgaatttgctgaattatttgactatattaatattatggcttatgatttcgctggtagttggtcatctgttacatcacatcattcttcactttattcaactgttgaagatgacagtggatattcattagcaggtgctgttaaaaattggatgaacgcaagattcccagctactaaaattgttgttggtattcctgcttatggtagatcgtggatttcaggtagttcttcaaataatggttatcttcaaagaccatctaactctcatccaaagggtgatgaagaagattacattgatccaaattcaaaaagatacagctctacctggaaatataaaaatattcgtaaagcaatcatgaaatcaacttataaagattcaactggaaattggattcgtgtatgggattcaaagtctagtgttccatttctgttcaacaagaacaccagacaatttattacgtatgatgatccagaatcagtatcaattaaagctgattatgttataaaatataacttaggtggaatgatgatgtgggaaatcgaagaggatac

SEQ ID NO: 24525 - DNA, 1068 bp, Anaeromyces robustus
  Glyco_18
aaaaattgttggttatttcagtgaatggagaaattccaattatccaattagtcgtgtagatttatcaaaaattactcaccttaattatgcatttggtcttattgatccaagtacatatgctgtaaccggttatgaaagttggattttaactcaagttgttgaagctgctcataaacaaggtgttaaagttcttatgtcaattggtggttggtatggaagtcgttacttcactaaaatgacctcttctaagagtaatatggaaagatttgctgatagttgtaaaaatcttattgatacatataaaatcgatggtattgatattgattgggaatatcctggaagagaaggtgcttgtaacacccctgaccttgccaatgatacagataattatttaacacttttagaaattttacgtaagaagattggtaatgattcattaattactgctgctgttagtgcaattccatttgaaaagaatggtcaaccagtttcaaatctttcagcttatgctaaatactttgattttattaaccttatggcatatgattttgctggtagttggtcatcagttacttcacatcattcaggtttatatgatccagaagctggtgataaattatctgtttccactggtgttaaaaattggttaaatgctcaattcccagctagtaagattgttgttggtgttccagcttacggaaagagttggattgctgcttcatctgataaaaatggtttatatcaatctattgctaacaaaagtccaaaaggtgatcaagatgatagtaatgatgcatggacaaattattgtggtgttgttgaaagtacttatagttcaaattggaaatataaaaaccttcgtaaagaaattttaacttctgattatacttctgcatctggtagttgggttcgcacttgggatgatactgttatggctccatatttatttaataaggatactaaacaaattatttcttatgatgatccaaaagctattgaaaacaaagctaaatatgttcttagtaataattttgctggtatgatggtttgggaattagaaaatgatac

SEQ ID NO: 24526 - DNA, 1056 bp, Anaeromyces robustus
  Glyco_18
atcaattattgtttattacccagaatggaaatattatgatttcccaccaaaagatatcccattttcaaagttaactcatattaattatgcttttgctgaaattaatcctgatgatttctcattagaatatgattcaaataaatttttagaattaatagatactgctcataaaaaaaataaaagtattaaagttttaatgtcaataggtggttggactggtagtagatatttctcaaaaatggcttcatcttcttcaaatcgtacaaaatttgttaaaagtgtaaaaagaatgattgatgctagtaatgctgatggtattgatattgattgggaatatccaggttcaagtggtgcttatgatgacaattatgattcagaaaatgataccaataatttattaaaattattaaaagaattacgtgaaactataggaacttcaaaacttattactgctgctgtaccatttaacacttttgaagttgatcataaacctttaagtgatatgacagaatttgctaaactttttgattttattaatattatggcttatgatttctctggaagttggtcttccgttactgcacatcaatccgctctttattcaactcatgaagatgatagtggttattccctttcaggtgcagttaaaaattggatgaatgctaatttccctgctaaaaaaattgttgtaggtattccagcttatggtagatcatggattgctggtagttctaccaatcatggttatcttcaaagaccttctaattcttatccaaaaggtgatgaagaagattatattgattcagattctaaaagatattcttcaacttggaaatataaaaatatacgtaaacaagttttaaaatcagattattctaaatctactggtagttgggaacgtatatgggattctaaatcaagtgcaccatttttatttaataaagatactaaacaatttattacttatgatgatccaaaatcagtaggtcttaaagctgattatgttattgaaaataatttaggtggtatgatgatgtgggaaattgaagaagattc

SEQ ID NO: 24527 - DNA, 1053 bp, Piromyces finnis
  Glyco_18
ttttagtgaatggagatattcaagttacccagttagccgtatagacttttcaaaatttacccatcttaactatgcttttgctgtcattgacccaaatacatatgcattaactggttatgaaggttggattttaaatgaagtagttacagctgctcataatcaagatgtaaaagttcttatgtcagttggtggttggtatggaagtcgttattttactaaaatgacatcttctgaaaataatatgaaaaaatttgctgaaagttgtaaaaatcttattgatacctatcacattgatggtatcgatattgattgggaatatccaggaagagaaggtgcttgcaataacccggattatgccaatgataccgataattatttaaaacttttaaaaatattacgtgaatatattggtaatgaaaatataatttctgcagctgtcagtattactccatttgaaaaaaatggtcagccaataacaaatcttgctccatatgctgaatattttgattttattaacattatgggctatgacttcgcaggtagttggtcgtctgttacttctcatcatgctgctttatatgacccagaagctggtgatatattgtctatttcctcaggagttaataattggttaaatggtcaatttcctgcagacaaaattgttattggtgttccaacttatggaaagagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatgatgatccagagagtattggatacaaagctaaatttgttcttgaaaatggctttgctggtatgatggtttgggaattagaaaatgatac

SEQ ID NO: 24528 - DNA, 699 bp, Neocallimastix californiae
  Glyco_hyd_65N_2
ttggtatgattctcctgcaagagcttggaccgatgctttaccagtaggtaattctcatcttggtggtatggtttatggtggagctcaacgtgatgaaattcaattgaacgaagatactttctgggccggaggtccacataataatattccaagaaatgctgcttctgctttaccacaagctagaagaatgattttcgaaggtagatttggtcaagctcaagattacattgataaaaacttctttaccggtcaaaatggtatgggttatcttacattaggtagtctctttatcaatttctctgatgtaagtggattctccaattattatcgtgatttagatcttaataatgctatcgctaccagtaaatttactgccaatggatctaatatagaacgttccttatttgcttcaatggctgatgatgttattgtttacaatattgctacggatggtaaacctcttaacttcagtgtcaatcataaatgtccacttcaaacgaatgcttcttcaagtggtaaccgtttaattcttaagattagaggtaaggatcaagaaggtgttggtgctaaacttaatgcctacgttatcgttgaaattgtttctgatggaagagttagtgctagtggttcaagccttaatgtatccaatgctaaggaagctaccatcttaatttccgctgccactaactttgttaacta

SEQ ID NO: 24529 - DNA, 76 bp, Neocallimastix californiae
  Glyco_hyd_65N_2
ttggtataattctccagctaccacttggacagaagctttaccagtaggtaattcgcaccttggtggtatggtttat

SEQ ID NO: 24530 - DNA, 696 bp, Anaeromyces robustus
  Glyco_hyd_65N_2
ttggtataataatccagctggagaatggactgaagctcttccagtaggtaattctcatcttggtgctatgatatatggtggtgctcaacgtgatgaattacaattaaatgaagatactttctgggctggtggtccacataacaatattccaggaaatgctgctaatgctttaccacaagctcgtcaaatgattttcgaaggtagatttggtcaagctgaaaattacattaatcaaaatttcttcactggtcaaaatggtatgggttatcttactttaggaagtcttttcattaatttctctgatattaaggattactcaaattactatcgtgaattagatatcagtaatgctattgctactactacctttaatgctaatggaggaagtatggaaagaacattatttgcttctatgactgatgatgttttagtttatcatatttcttctgaaaaagctactagtttctctcttagtcataaatgtgctctttcaacttctgtttcatcctctggtaatcgtttaattattcaagttagaggtaaagatcaagaaggtgttagaggacaactttctgcttacggtattgctgaagttgttactgatggtagagtaagtgctagtggttcatcactttcagtttctggtgctaaggaagctatgattattttctctgctgctactaactttgttaatta

SEQ ID NO: 24531 - DNA, 705 bp, Anaeromyces robustus
  Glyco_hyd_65N_2
ttggtatgatattccagctagagaatggactgaagcacttccagtaggtaactcgcaccttggagcaatgatatatggtggagtacaacgtgatgaattacaattaaatgaagaaactttctggggtggtggtccacataataatgttgtaaataatgcttttccaaaaattcaacaagctcgtcaaatgatttttgatggtaaatttatgcaagctgaaaattacattaatcaaaattgcttatctggtatagatggtatgccatatcttccattgggaagtcttttcattaattattctgatataaaagaatattcaaattattatcgtgaattagatattagtaatgcaatgacaaccactaaatttactgctaatggtgttaatatggaaagaactttatttgcatctatgactgatgatgtattagtttatcatattacatctgatccaaaaaagcctattagtttttctcttagttatcaattcccaagacttacaaactccatttcaacatctggtaaccgtttaattataaaggttaatggtaaggatcatgaaggtgttaaaggacgtgttactgcatatggtattgctgaagttgtcactgatggtaaagtaaatggtaatggttcaacactttctgtatcaggtgctaatgaagctattatctttttctctgctgctactaattttgtaaacta

SEQ ID NO: 24532 - DNA, 696 bp, Piromyces finnis
  Glyco_hyd_65N_2
ttggtacaactcacctgctaatgcatggactgaagctcttccagttggtaattcacaccttggtggaatggttttcggaggggcacaaactgatgaaattcaattaaatgaagaaactttctgggccggcggtcctcacaacaatatcccacaaagagctaattcagtcctttcacaagctcgtcaacttattttcagtagcaaatttggtgatgctcaaaatttaattgataaaaacttcttctcaggtcaaaatggtatgggatatcttactttaggtagtctttacattaaattctcagatgttaaagatgtttcaaactattatcgtgatcttgatctcaatactgctattgcaacttccaagtttacttccaatggaatgaatgtagaacgttcattgttcgcttctatggctgacaatgtattagcttacaagattactaatgaaaacaaaccaattagttttactgttagtcataaatgtcaacttagtacttctgtttcaacaagtaataatcgtatgattcttaaaattagaggtaaggatcaagaaggtgttggatcaaaactttctgcttatggtattgtagaaattgttaccgacggtagagtatctgcaagtggttcatcactttctgtttcaggtgcttatgatacagttatttatatcactgctgccaccaactttgtttc

SEQ ID NO: 24533 - DNA, 675 bp, Neocallimastix californiae
  Glyco_hydr_30_2
taaattcgaaggttttggtaccagtttttgttggtgggcgaacagacttggttactctgatattttatctgaaaaggctgctaccctcttctacgataaaaaggaaggtttaggtcttactattattcgttataatattggtggtggtgataatccatctcataatcatattactagaacggattctaacatgccaggttatgccattaatccacgttataacggtaatggttcctacacctgggattacaattggaatagtgatttcaatcaaagaaatgctctacttaaagctatcgctaagaacaaggaagaaatcatcgttgaaggtttctctaattctccaccatactttatgactaattctggttgttcaaccggtaatactgatcctaataaggataacctaaagagtgacgcctatcctgcttttgctaaatatcttgcggatgttgcggagcacttcagcaaaagttggggagttaccttccaaagtatgaccccagtcaatgaaccatttactaattactggggagcaaatagtaaaaaacaggaaggatgtcactttgatcaaggaaattctgaatcaaaaattattgtagaacttcgtaaagccattgatcaaaagggcttaaagagtattcaaattagtggtacggatgaaactagtatcga

SEQ ID NO: 24534 - DNA, 654 bp, Anaeromyces robustus
  Glyco_hydr_30_2
tcgtaaatttgaaggtttcggtacaagtttctgttggtgggctaatcgacttggttattctgattctttatctgaaaaagcagctactctattttatgataaagaaaaaggtttaggtcttactgttattcgttataatatcggtggtggtgatgatccaactcataatcatattactagaacagattctaacatgccaggttatgctattaatccaaaatacgatggtagatcttacacttgggattataattggaatagtgatagtaatcaaagaaatgttttattaaaatctgtagctaagaataaagatgaaattattgtggaagcattctctaattctcctccatattttatgacatattctggttgttctactggtaattttgatccaggtaaagataatcttagaagtgatgcttatccagctttcgctaaatatcttgctgatgttgctgaacatttcaaaactcattggggtgtttatttccaaagtattactcctactaatgaaccatacactaatttctggggagcaaatagttataaacaagaaggttgtcattttgatcaaggagaatctgaatcaaaaattattgttgaacttcgtaaagctattgatcaaaaaggattaaaagaaatgcaaattagtgg

SEQ ID NO: 24535 - DNA, 651 bp, Anaeromyces robustus
  Glyco_hydr_30_2
atttgaaggttttggtacaagtttctgttggtgggctaatcgtcttggttattcagattctttagctgaaaaagctgctactctcttttatgataaagtcaatggtttaggtcttaccgttattcgttataatattggtggtggtgatgatccaactcatcatcatattactagaacagattcaaatatgccaggttatgctattaatccaagatatgatggtagatcatatacttgggattataattggaatagtgatgctaatcaaagaaatgttttattaaaatctgttgctaaaaatagagatgaaattattgtagaagctttctctaattctccaccatactttatgacgaattctggttgttccacaggtaattttgatgctaataaggataatcttaaaagtgatgcttaccctgcttttgctaaatatcttgctgatgttgctgaacatttcaaaacaagttggggtgttggtttccaaagtattacccctgttaatgaacccttcactaattattggggagctaatagtaaaaaacaagaaggttgtcactttgatcaaggtaattctgaatccaaaattattgttgaacttaaaaaagctattgatcaaagaggtttaagagatatgcaaattagtggtac

SEQ ID NO: 24536 - DNA, 921 bp, Neocallimastix californiae
  Glyco_hydro_10
aaaaaattactctaagggtttcagaattggtgctgctactaacaccattcattacaacaacgctaactatgttaatgctatgaaagcattcaactatatggttgctgaaaatgcttgtaagttcgttagtattcaaggtactaagggtagattcaatttcaatgattgtgatgcccactacaacaaagcaaaggaattaggtatggactttagaggtcacgctttaatttggcacagtatggctccaaagtggcttgaatacgaagattctaatactatgagaaattccatagttaatcacattacaactgtcttaaagcactacgaaggtaaaattgatacttgggatgttgttaatgaagctattgatgatgattccaatggtaatggttggaagtatcgtaattcattcctttaccaaaagaacagagatttcattgatcttgctttcaagactgctcgtcaagtagctccaaaggttaaacttttctacaacgattataatactgaaggtatttggggtaagagtgaatctgtttaccaatttgttgctgatttaaagaaacgtaatattccaattgatggtgttggtcttcaataccatgtcagtgttcaaaatcaaccacaattcaacaaaattaacgatttaattggtcgttactgtaagttaggccttgaagttcacattactgaattagatgtcagttgtgttaattcttgtaatgctggagatgttgaaagcagacaatcccaagttttcactaatgctttaaaggcttgtcttaacaactcctgttgtactgctttccttgtctggggtattggtgatccagacagttggttaggtaatgataagaagggtttacttttcaatggtaattaccaaccaaaatctcaatacaatgctctcttaaacgtctt

SEQ ID NO: 24537 - DNA, 945 bp, Neocallimastix californiae
  Glyco_hydro_10
acaagttagacctgatttctactttggtgtttctacagcctctcatttctttgctaacccaaagtacaatgatattatttctacttacaacttacaagttgctggtaatgaatgtaaattctatacttttaacggttctcaaactttcaacacaaagccatgtgatgacactgttgctttcgctaagaagtatggagctaagttccgtggtcacaatcttttctggccagcttactctccacaatggttccaagatgctcatgatggtagtgacccagaagctgtaaaagaatacattcttgactatgttgctaaggttttagatcattacaaggatgaagaagatattatttactgggatgttattaatgaatctgttactgacgattctactgctaagaacatcaagttacgtactggttctgataacagtaatgaattcgaaggttgggatacttacacagaagatattttcaaggttgctcgtgaacacaccaacgaaaatgtaaagttattctataacgattacaatgccgaagcaaacaatggaaactttgatggaaaaactggtgctgttttcgaatacatcagatctatgagagaaaagggtgtcccaattgatggtgtcggcttacaaatgcacgtttcctgtaattggactccaaattatgaacaacttacaaagttaatttctcaatatgaagaaattggcgttgaagttcatattactgaaattgatgttaaaagaactcaatgtaaatctgctgaagctcaaaaagaagttttcatgaacgtcttcaaagcttgtttcgatcatgaaaactgtaaggtcttcactgtttggggttcctacgatgaagaatcctgggttggtgttgaaaatgaaccagttctttttgatgttgatatgtatccaaaggacatttactttgatatgttggacta

SEQ ID NO: 24538 - DNA, 921 bp, Neocallimastix californiae
  Glyco_hydro_10
aaaggattattctaatggttttagaattggtgctgccaccaacactagattctacaacaatggtaactacgttaatgccatgaaggctttcaactatatggttgctgaaaatgcttgtaagtttgttagtattcaaggtacaaagggtaaattcaacttcaatgactgtgataatcacctcaagaaagctaaggaattaggtatggacttcagaggtcacgcccttgtttggcactctatggctccagattggcttaaaaatgaagattcaaaaactatgagacaatccatcgttaaccacattactaaggtcttacaacactatgacggtaagattgatacctgggatgttgttaatgaagctattgatgatgattccaatggtaatggctggaaataccgtaactccttcctttaccaaaagaacagagatttcattgatcttgctttcaagaccgctcgtcaagttgctccaaaggttaaacttttctacaacgactacaacaccgaaggtatttggggcaagagtgaatctgtctaccaatttattgctgacttaaagaagcgtaacattccaattgatggggtcggtattcaataccacgtcagtgtcaagaaccaaccccaattaaacaaaattactgacttaattggccgttactgtaagttaggccttgaggttcacattaccgaaattgatgtcagttgtgaaggtgcctgtaacaacggtgatgttcaaaaccgtcaagctcaagtcttcacaaatgccttaaaggcttgtcttgccaactcctgctgtaccgcttatcttgtttggggtattggggataatgacagttggttaggtgctgataagaagggtttacttttcgatggtagttacaagccaaaagctcaatacactgccctcttaaacacctt

SEQ ID NO: 24539 - DNA, 984 bp, Neocallimastix californiae
  Glyco_hydro_10
tactgttttatctaagaaaatgcgtgaaatcattgcttatcaattcaattcagtcacttattcaaatcttatgaaggctgaaaatattttagataaagccgcttcccaagctaatgcaaaaaaaggtgatgatatgccagttttaaaatttgatacaattgttgatggtttagaattctgtaaagaaaataacattaaaatgagaggtcacactttagtatggcatgttcaaactccagaatggttcttccgtactgactttagtgatagtggttcatatgtcaatgcagccaagatggaaaagcgtatggaaagttatattaaacaaatgttagaattcgttcaatattattatccaggtattgttgatgtttgggatgttgttaatgaagctgttgaaattgaaggtggtagttatgatgcctcaactggttggaatactcgtactagatataatggtagtccaaatccatggtatactactatgggcgctgactatgttattaaggctttccgtattgctcgtaaatatgctgacaaaaatgttaaacttatttacaatgattacaacacttttatgtcacaaaagactactgctatttgtaatcttattaaaaaattaaaggctgaaaacttagttgatggcgttggtcttcaatcttacttaaatgccgactggccaaatcgtaatgactataagactgctattcaaaagtttgctgctcttggtgttgaagttcaagctacagaattaactattagaactgatggtactgcaaataaatataatactcaagctaaacattatgaagaagttttcaagatttacaaagatttgaagaagagtggtgtcaatattactagtgttacagtctttggcttacaagatggttatttattttataataatgattcaactgatacacgtttatgggaccataatcttaagaaaaaaccagtttacaattctattatgaaagtatt

SEQ ID NO: 24540 - DNA, 1005 bp, Neocallimastix californiae
  Glyco_hydro_10
taccaataagagttcttctccagtcttctctaagaaaatgcgtgaaattattaaatatcaatttaattctgtaactttcactaatcttatgaaagctgaatttatgttagataaaagtgcttctcaagccaacgctagaaatggtaatgatatgccagttttaaagtttgatacaattgttgatggtttagaattctgtaaggaaaataatattaagatgagaggtcacactttagtttggcacactcaagctccagaatggttcttccgtactggatttaatgataacggtagttatgttgataagaacaaaatggaaaaacgtatggaaagttacattaaacaaatgttagaatttattcaatattactatccaggtgtcattgatgtatgggatgttgttaatgaagctgttgaaattgctaacggtagttatgatgcttcatccggatggaatactcgtactaagtttgataacaacaagactaatccatggtatgcaactatgggtcctgactatgtatttaaggctttccgttttgctcgtaaatatgctgataagaatgtcaagcttatttacaacgattttaatacattccaatatccaaaaactgataatatctgtaaccttgttaagaaattaaaggctgaaaacttaattgatggtgttggtctccaatcttacttaggtccaagttggccaaatcgtaacgattacaagaacgctattcaaaagttcggtgctcttggtgttgaagttcaaattactgaattaactattagtgttgaaaatggtaataacaaattcactacccaagctaatcaatatagagatgttttcaagatctataaggacttaaagaaaagtggtgttaacatcactagtgttactgtcttcggtttacaagatcattacttattctatgataatgataatactgaaactcgtttatgggatggtaatcttaagaagaagccagtatacaatgctattatgaatgtatt

SEQ ID NO: 24541 - DNA, 918 bp, Neocallimastix californiae
  Glyco_hydro_10
tgccgccaagggtttcagaattggtgctgctacaaacactattcactataataatccaaattatattaatgctatgaaggctttcaattatatggttgctgaaaatgcttgtaaatttgtaagtattcaatacactaaaggtaaatttaactttgacgattgtgataatcacttaaagaaagctaaggaattaggtatggctttcagaggtcatgctttaatatggcatgctatggctccaggttggcttgaacgtgaagatggaaatactatgaaacaatctattattaatcatattaccactgtattaaagcattatgaaggtaaaattgatacttgggatgtcgttaatgaagctcttgatgatagttctaatggtaatggttggaaacttcgtaattctttcctttatcaaaaggttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaaattcgaaaaaattaacaatttaattagtcgttactgtaaattaggtgttgaagttcacatcactgaattagatgtcagttgcgatgacaactgtcgtgacgcagacggtggtgagagcaagcaaggacaagtttacactaatgccctaaaggcttgtcttaataattcttgttgtactggtttccttgtttggggtattggtgataaggatagttggagaggtgttgaaagtaaaccattacttttcgatgctaactaccaaccaaagggtcaatacactgctatattaaacacttt

SEQ ID NO: 24542 - DNA, 690 bp, Neocallimastix californiae
  Glyco_hydro_10
tgctatggctccaggttggcttgaacgtgaagatggaaatactatgaaacaatctattattaatcatattaccactgtattaaagcattatgaaggtaaaattgatacttgggatgtcgttaatgaagctattgatgatggttctaatggtaatggttggaaacttcgtaattctttcctttatcaaaaagttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaagttcgaaaaaattaatgatttaattagtcgttactgtaaactaggtgttgaagttcatatcactgaattagatgtcagttgtgatgacaactgtcgtgatgcagacggtggtgacagtaagcaaggacaagtttacactaatgccctaaaggcttgtcttaataattcttgttgtactggtttccttgtttggggtattggtgataatgatagttggagaggtgccgaaaacaagccattacttttcaatactaattatcaaccaaagggtcaatataccgctgtcttaaacacatt

SEQ ID NO: 24543 - DNA, 918 bp, Neocallimastix californiae
  Glyco_hydro_10
tgccgctaatggtttcagaattggtgccgctaccaatactattcattacaacaatccaaattatattaatgctatgaaggcttttaactatatggttgctgaaaatgcttgtaaattcgttagtattcaatataataaaggtagatacaactttgatgattgtgataatcatttaaagaaagctcaagaattaggtatggctttcagaggtcacgctttaatttggcatgctatggctccaggatggcttgaacgtgaagatggtaacactatgaagcaatctattattgatcacattactactgtattaaaacattatgaaggtaaaattgatacttgggatgttgttaatgaagctatcgatgatggttctaatggtaatggttggaaattacgtaattctttcctttaccaaaaggttccaaactttattgatattgctttccaaactgctcgtaaggtctcaccaaaaactaaacttttctacaatgattacaacactgaaggtatttgggccaagagtgaatctgtttatcaatttgttgctgatatgaaaagacgtaatattccaattgatggtgttggtattcaatatcacgttggtatcaatgttcaaccacaattccaaaagattaatgatttaattggtcgttactgtaagttaggagttgaagttcatatcactgaattagatgtcagttgtgatgataattgtcgtgattgggatggtggtgaaagtaaacaaggacaagtttacactaatgctttaaaggcttgtcttggtaattcttgttgtaccggtttccttgtttggggtattggtgataaggatagttggagaggtgaagaaaacaagccattacttttcaattctaactatcaaccaaagggtcaatacacagctatcttaaatacttt

SEQ ID NO: 24544 - DNA, 909 bp, Neocallimastix californiae
  Glyco_hydro_10
aaacggcttcagaattggtgctgctgctaacacaatgtactttaacaaccaaagttatatcaatgccttaaagtctttcaactatatggttgctgaaaatggttgtaagctttcaggtattcaacaacaaaaaggtgtttacaatttcaatgattgcgataatcacttaaagaaggctcaagaattaggtatggatttccgtggtcactgtcttatctggcacgcttaccaaccatcttggttcgaaaatgctgatgctaatactttaaagaacgctattgttgatcatattactaagactttacaacattatgaaggaaagattgatacttgggatgttgttaatgaagctattgatgatagttctaatggtaatggttggaaaatgcgtaactccttcctttatcaaaaggttccaaactttattgatttagctttccaaactgcacgtaaggtttctccaaacactaaacttttctacaatgattacaatactgaaggtatttatggaaaatctgaatctgtttaccaattcgttaaagatttagtttcacgtaatattccaattgatggtgttggtattcaatatcacgtttctgtccaaagtcaaccacaatataacaagattaacgatttaatttctcgttactgtaaacttggacttgaagttcacattactgaacttgatgttaaatgtgataatcaatgttatagtggtaatgttgaacaacaacaagctacagtctttactaatgccttaaaggcttgtcttagtaactcttgttgtactggttaccttgtttggggtgttggtgacaacaattcatggttaggtagtgataagaagggtttacttttcgacggtaactacagaccaaaatctcaatacactgctgtccttaacatgtt

SEQ ID NO: 24545 - DNA, 918 bp, Neocallimastix californiae
  Glyco_hydro_10
taaagactatgctaatggtttcagaattggtgttgctgctaacactatgaaatttaataatcaagcctataatgaagccttaaaagcctttaattatatggttgctgaaaatggttgtaaattgtctggtattcaacagcaaaaaggtgtttacaacttcagtgattgtgataaccacttaaagaaagctaaagaattaggcatggacttccgtggtcactgtcttatctggcactcataccaaccatcttggttcgaaaatgctgatgcaaacaccttaaagaatgctatcgttgatcacattactaagactttacaacactatgaaggaaagattgatacttgggatgttgttaacgaagctattgatgacagttctaatggaaatggttggaaaatgcgtaactccttcctttaccaaaaagttccaaactttgttgatttagctttccaaactgctcgtaaagtttctccaaatactaaacttttctataacgattataatactgaaggtatttatggtaaatctgaatcggtataccaatttgtaaaagatatgatttctcgtaacattcctattgatggtgtaggtattcaatatcatgtttctgtttcaagtcagccaaaatacgaaaaaattaatgatttaatttcccgttactgtaaacttggtattgaagttcatattactgaactcgatgttaaatgtgataatcaatgcaacagcaataatgttgaacaacaacaagctacagtcttcactaatgctttaaaggcttgtttcagtaattcatgctgtaccggttatcttgtttggggtgtaggtgataatgatagttggttaggttctgacaagaaaggtttacttttcaatagtaactacaagccaaagtctcaatacaccgctattcttaattt

SEQ ID NO: 24546 - DNA, 1014 bp, Neocallimastix californiae
  Glyco_hydro_10
cggtgctagtattgaaaattctactgtttcatctaaaactatgagagaagttatcaaacatcaattcaattctgttacttactcaaaccttatgaaatcattatttattcttaatcaagaaggtagtattaagaatcttaaagaaggtaaacaagatccagctttagatttcagtggtattgttgatggtttagatttctgtcaaaagaatggtattcacatgagaggtcatgttttagtttggcacaaccaagtcccaagatggttcttcaccaaagattattctgaagatggtgaatttgttgatccagaaactatggaataccgtttagatagtttcattagacaatatcttggttttgttcaatactactacccaggtgttgttgatgtttgggatgttgttaatgaagctgttgaagttgttggtgaacaatatgataattctactggttggtacactcgtactttatatgatgaagttaaaccaaacatgtggtatgatatgtttggtccagattacgttgttaaaactttccgtattgctcgtaagtatgcccttccaaatgttaaattagtttacaacgattactgtacttatgtcactaaaccaattagtaagagagatgctattgttaaacttcttggtattttacaaaaggaagatttagttgatgctattggtatgcaatcctacatcaacccagaagaagatgttaatgaccatttagcagctattgaagtataccaacaaaccggattagaaattcaaattactgaattaactattcgtgttaagaatactgatgactgggaagaatacaatattcaacaatacagtcaactctttgaaggtattatgaaatatgttagaaagggttacaatattggtagtgttactgttttcggtttacaagatggatacagattctatgaaaacgattccaccaagactcgtctcttcgatcacgatcttcaaaagaagaaggtttaccgtgctattatggatatcat

SEQ ID NO: 24547 - DNA, 1014 bp, Neocallimastix californiae
  Glyco_hydro_10
tggtggagccatttctacttctactactacttcaaaaaaaatgagagaagtcattaaatatcaatttaactctatgacttatactaatcttatgaaaccagaatttgttcttgataaggaaggttgtctcaaaaacgctgaaaatggatctgaagaagtcgtattaaaatttgatgatattgttgacggtttagattttgctttaaagaataatattcacgttagaggtcatgtattagtatggcacacccaaactccagattggttcttcagaaaaggattcaattctgaaaatgaatttgctgatgttgaaactatctatcaacgtttagaaagttatattcgtcaatatcttggatttgttcaacacaattatccaggtgtcattgatgtttgggatgttgttaatgaagctattgaaattaatgatggatatttcgataactctactggatggtataccagagtctctactcaaactgaagaaagtttatggtataagattgttggaccagattatgttaagaaaacatttgaaattgctcgtaaatacgctcttccaaatgttaaattagtttacaatgattacaatactttccaaacctatccacatgataaaactcaagccatcattgatcttatgaatattttaagaaaagataatttagttgatgctcttggtatgcaatcttatattggtgaaacttggccaaagattgaagaatatgttagagccattgaacgtttcactgaagctggtttagaacttcaaattaccgaattaaccattaccccaccaagtggagaaggttggttagaaaaacaagctcaacaatatcgtgaattctttgaaaaagttatggaacaaattaataagggagctaatattaccagtgttactgtatttggtattcaagatggatatagattctacacctctgacagtactaagactcgtcttttagatcatgatcttcaaaagaaaccaaattacgaagccattatggaagtttt

SEQ ID NO: 24548 - DNA, 1008 bp, Neocallimastix californiae
  Glyco_hydro_10
cggtaccagtaaaactaattctccaattttctcaaagaaaatgcgtgacgtaatcgcctatcaatttaattctgttaccttcactaatcttatgaaagctgatcaaatgttggataaggccgcctctcaagctaacgccagaagtggtaatgatatgccagttttaaaatttgattccatcgtggatggtttagaatactgtaaagcgaataacatcaagatgagaggacataccttggtttggcatgttcaagctccagaatggttcttccgtactggatttaacgataatggtaactatgtggataaaaataaaatggaaaaacgtatggaaagttacattaaacaaatgtttgaatttgttcagcactactatcctggtgtagttgatgtctgggatgtcgttaatgaagcggtcgaaattactaatggtagttttgatgcttcctccggttggaatactcgtactaaatatgataataataaaacaaatccatggtatgctaccatgggtcctgattatgtcttcaaagctttccgttttgctcgtaaatacgccaataaagatgttaaactcgtctataacgacttcaatacttttatgtctcaaaagacaaatgccatctgtaatcttgtaaagaaattaaaggctgaaaacttaattgatggtgttggtcttcaatcctacttaggtccaagctggccaaatcgtaatgactataagaatgccattcaaaagtttagtgctctcggtgttgaaattcaaattaccgaattaaccattagtgtcgaagaatccaataataaattcaatgctcaagctaatcactacagagatgtcttcaagatttataaggatttaaagaaaagtggtgttaacattaccagtgtcactgttttcggtttacaagatcactacttattctatgataatgataagacagaaactcgtttatgggaccgcaatcttaagaagaaacaagcttacaattctgtcatgagtgtctt

SEQ ID NO: 24549 - DNA, 945 bp, Neocallimastix californiae
  Glyco_hydro_10
acaagtcagaccagatttctattttggtgttgcaactcaaaaaactttctttgctaacccaaaatacaaagatatcatgtcaacttttaatttagaagttggtggtaacgaatgtaaattctatactataaatggatctgaaactttcaacactaaggcttgtgatgaatctattgcttttgctaagaaacaaggtgctaagtaccgtggtcacaatcttttctggccagctaattctccaagttggtttaagagtgcttacgatggtaaagacccagaagaagttaaggaatacattcttgactacattacaaaggttttagatcattacaaggatgaagaagatatcatttactgggatgttattaatgaatcagttaccgatgattctaccccagaaaatattaaattacgtaccggatccgatactagtaatgaatttaagggttgggatacctatactgaagatatcttcaaacttgctcgtgaacacactaatgaaaatgttaaattaatttacaatgattataatgctgaagctaatggtggaaacttcggtggtaagactggtgctgtattccaatacattaaatccatgaaagaaaacggtgttccaatcgatggtgttggtttacaaatgcacatttcttgtaattggactccaaattacgaagaacttactaaattaatttctcagtatgaagaaattggtgttgaagttcatgttactgaaattgatgttaaaatggagaactgtaaaactcatgatgatcaaaggaaggtatacatgaacatcttcaaagcttgtttcgatcatgaaaactgtaaagtcttcactgtttggggtgcttacgattctgaatcatgggttggtgctgaaaacgaaccacttattttcgatgaagatatgtatccaaaggacatttactttgacatgttagatta

SEQ ID NO: 24550 - DNA, 1014 bp, Neocallimastix californiae
  Glyco_hydro_10
tggtggtgctattgaaaactccacaacttcttccaaaacgatgagagaggttattaagcatcaattcaactccgttacctattctaacctcatgaaagcagtatttgtacttaatcaagaaggtagtattaagaatcttaagaaaggtaaacaagatccagttttagatttcagtacttttgtggatggtttagatttctgtcaaaagaatggtattcacatgagaggtcatgtcttagtttggcacaaccaagctccaagatggttcttcacgaagaactatgaagaagatggtgaatatgtagatgctaaaacgatggaataccgtttagagagttacattaagcaatatcttagctttgttcaattcaattacccaggggttgttgatgtttgggatgttgttaacgaagccattgaagttgttgataatcaatatgataaatctactggttggtacactcgtaccttatacggtaataactcaccaaacatgtggtatgatatatttggtccagattacgttgtgaagaccttccgtattgctcgtaagtacgctcttccaaatgtcaaattagtttacaacgattattccaccttcgtcaccaagccagtgagtaagagagatgctatcattaaacttcttggtattttaaagaaggaagatttagttgatgccattggtatgcaatcctatattaatcccgatgaagatattaatgaatatttagctgctgtggatgaataccaaaaaactgggttagaaattcaaattactgaattaaccattcgtgtgaagagtacggatgattgggaagaatacaatattcaacaatactctcagctctttgaaggtcttatgaaacgtgttaagaaaggttacaatattggaagtgttactgttttcggtttacaagatggttacagattctatgaaaacgatactcaaaaattccgtcttttcgatcacgatcttaaaaagaagaaggtctaccatgccatcatgaaaatact

SEQ ID NO: 24551 - DNA, 1026 bp, Neocallimastix californiae
  Glyco_hydro_10
tgttgatataaataattacactccaagttcaaagaaaatgatggaacttatcaagtatcaatttaactctatgacttattctaatggtatgaaaagtattaaaattatggatgaagaaggatctcgtaagaatatagccgaaggtagagaagaagttgctgttgacttttctggaattattgatggtcttgaatttgccaagaaaaatggtattcacattagaggtcacgtcttagtttggcacaaacaaactccagactggttcttcagaaaagattttgatactgaaaaggaatatgctgatgttgaaactatctttgttcgtttagaaagctacatgaaagctttctttgacttccttaacttcaattacccaggtgttgttgatgtctttgatgttgttaatgaagccattgaagtcagagaaggaaaattcgataactcaactggttggtacactcgtactgaatctcttgaaggtgatgacaatatttggaatactcttgttggtccaagttacgttgttagagctttccgtattgctcgtaaatacgctcttccaactaccaaattagtttacaatgatgttgataccttcatgactaagccacatgacaagacccaagctgttattgatctcatgaacatattaagagctgaagatttagttgatgcccttggtatggaatcttacattgatcaagacttagttaatgtagatgccccagaagactacgctcgtgccattgaacgtttcaccgaagctggtttagaaattcaaattacagaatttactatctacaatgatgatagagaagattggttagaaactcaaactaagagatacagagacttcttccaagttgttatagatcatgttaagaagggatatgataatatttctagtttcactgttttcggtttacaagatggatacagattctacgataatgatactcaaaaaactcgtctcttcgatcatgatcttcaaaagaagccaaactactatgccatcatggaaatttt

SEQ ID NO: 24552 - DNA, 939 bp, Neocallimastix californiae
  Glyco_hydro_10
acaagttcgtccagatttttattttggtgtagcaacatcgattgcttattcctctaatccaaaatataaggatattgtttcttcttttaatttacatgttggaggaaatgaatgtaaattctataccattcaagcttctaaaacccgaaatttctatcaatgtgatcagtcattgtcctacgcaaaaaaatttggagccaagtatcgtggtcataatctcttctggccagcaaattcaccaaattggtttaagacctacagtgatgatattgaagttactaaaagctatattattgactacattaaaagtgttttaaatcattatcgtgatgatgatagtattatctattgggatgttattaatgaatcagttatggatgaatccacctccaatgatattcaattacgtacaggttcaaaaactagtgatgaatttttgggatgggatacgtataccgaggatatctttaaattagcaagagataatatcaatgaaaatgtcaaattgatttacaatgattattattgtgaagccaataatggtaattttgatggaaaaacaggtgcagttttcaattacattaaaaatatgaaggaaaaggaggttcctattgatggtgttggtcttcaaatgcatgtttcttgtaatgacgcaccatcatatgatgatctttacctgttgatttcacgatatgaagaaattggagttgaagttcacgttactgaaattgacgtaaccatggctcgttgtaacagtctcaaagatcaaaaggatgtctatatgaatattttcaaggcttgttttaatcataacaactgtaaagttttcactgtctggggagcctatgatacagaatcatggattggagctgagaatactccattaatatttgattcagatatgtatcccaaagatatctattttgaaatgttagatta

SEQ ID NO: 24553 - DNA, 984 bp, Neocallimastix californiae
  Glyco_hydro_10
tacagttctttcaaagaaaatgcgtcaactcattgcttatcaattcaattcagttacctattctaatcttatgaaggctgaacatattttagataaatctgcttcccaagctaatgctaataaaggtaatgatatgccagtcttaaaatttgacactattattgatggtttagaattctgtaaggaaaacaatattaaaatgagaggtcacaccttagtttggcacgttcaaacaccagaatggttcttccgtacaaactttagcgatagtggttcatatgttaatgcccaaaaaatggaaaagcgtatggaaagttatattaaacaaatgctagagtttgttcaatactactacccaggtgttgttgatgtttgggatgtcgttaatgaagctgttgaaattgaaggtggtagttacgatagttctactggttggaacacacgtactaagtacaatggaagtgcaaatccatggtatgctactatgggtcctgattatgtcttcaaggcattccgatttgctcgtaaatacgctgacaaaaatgttaaacttatttacaatgattacaatactttcatgtcacaaaagactaatgctatttataatcttgtaaaaaaattaaagtctgaaaatttaattgatggtgttggtcttcaatcttacttaaacgctgactggccaaatcgtaacgattacaagaatgctatgcaaaggtttgcatctcttggtgtagaaattcaagctactgaattaactattaaaactgatggatctagtaataagttcaataatcaagctaaacactaccaagaagtcttcaagatttacaaagatttgaagaagagcggtgttaacattactagtgttacagtcttcggcttacaagatggctacttattctatagtaatgattcaaccgatactcgtttatgggaccataatcttaagaaaaagccagtttactattctattatgaatgcttt

SEQ ID NO: 24554 - DNA, 1014 bp, Neocallimastix californiae
  Glyco_hydro_10
tggaaccaatttacaagtttccacaaccgtttcggaaaagatgagagatatcattaagcatcaatttaattcgatgacctacaccaatttaatgaagcctctctacattttagataaggaaggaagtatccaaaatattaagaatggcattcaagatccaaagttaaactttactagtatcgtcgatggattagaatttgcttataaaaatggtatccacattagaggacatgtcttgatttggcacactcaaactccagattggttctttaatgaaggctatactgacgatggaaaaaaagtcagtccagaggttatggaatctcgtttagatagttatataaaacaatatcttagttttgtacaatttaattatccaggagtagtagatgtatgggatgttgtcaatgaagccatagaaattactgatggacaatatgatgccaatacaggatggtatacccgtaccatgttaaacaatacccctaatccatattacgatatgtttggaccagattacgtcattaaagccttccgtatagctcgtaaatatgctcttccaaatgtgaaattagtgtataacgatttcaatacattccaagtatggccccacaataagacacaagccattatggatttagccggaattttacagaaagaagatttaattgatggtattggattacaatcgtatttaggagtcacctggccatcccttgatgaatactttagaggtgtcgaaagattagccaccacaggacttgagcttcaaattaccgaattaactattaccgccccagatggagataattggttagaagcacaagcagaacaatacagagatttctttgaaagattaatgaagcatgttgaagaaggatacaatattggcagtgtcaccgtatttggacttcaagatggctatctcttctacgctagtgattcgacaaaaacaagacttcttgatcatgatcttcaaaagaagccaaactttgaggcgattatgagcatttt

SEQ ID NO: 24555 - DNA, 918 bp, Neocallimastix californiae
  Glyco_hydro_10
agattattctaagggtttcagaattggtgctgctactaacactattcactacagtaattctaactataacaatgctatgaaagctttcaattatatggttgctgaaaatgcttgtaaatttgttagtattcaaggtaccaagggaaaattcaactttaatgattgtgataatcatttaaagaaagctcaagaattaggtatggatttcagaggtcatgctttagtttggcatagtatggccccaaaatggcttgaaaacgaagatgcaaatactatgaaaaactctataattaatcatattactactgtattaaagcattatgaaggaaaaattgatacttgggatgtagttaatgaagctattgatgatagttctaatggtaatggatggaatatgcgtaaatccttcctttacaataaagttccaaactttattgatattgctttccaaactgctcgtcaagtatctccaaaaactaaacttttctataatgattataatactgaaggtatttggggaaagagtgaatctgtttaccaatttgttgctgatttaaagaaacgtaatattccaattgatggtgttggtattcaatatcacgttagtcttgaaaataatccacgtttcgacaaaattaatgatttaattagtcgttattgtaaattaggtgttgaagttcacattactgaaatggatgtcagttgtgacaaaaactgttgggccagtgatgttgaacaacaacaaggtaaagtttttactaatgctttacaagcttgtcttaacaattcttgttgtaccggtttccttgtttggggtattggtgataacgatagttggattggtggtgataagaaaggtttacttttcaattccaattaccaaccaaagtctcaatacactgctgtcttaaatctctt

SEQ ID NO: 24556 - DNA, 1014 bp, Neocallimastix californiae
  Glyco_hydro_10
tggtggtgctctttctacttctactactacttctaaaacaatgagagaagtcattaaatatcaatttaattcaatgacttatactaatatcatgaaacctgaatatatttttgataaagaaggatgtctcaaaaatgcagaaaatggttcagaagaaatggctttaaaatttgatgatattgtggatggtttagattttgctttaaagaataatattcatattagaggtcatgtattagtatggcataaacaaactccagattggttcttcagaaaaggatttaattctgaaaatgaatttgccgatgtcgatacgatctattatcgtttagaaagtttcattaaacaatatcttggatttattcaatttaattatccaggagtcattgatgtttgggatgttgttaatgaagcagttgaaattaatgatggcagctttgataattctacaggatggtacactagaactatgacaggagatgaagaaagtttatggtataaagtagtaggaccagattatgttaagaaaacatttgaaattgctcgtaaatatgcacttccaaatgtcaagttagtatataatgattataatactttccaaacttatccacatgataaaactcaagccatcattgatctcatagatattttaagaaaagataatttaatcgatgccattggtatgcaatcatacattggagtgaattggccaagtgttgatgaatatataagagccattgaacgtttcactgaagccggattagaaattcaaattaccgaattaaccattacagcaccaagtggcgatgattggttagaaaaacaagctcaacaatatggagaattatttgaaagaatcatggaacaaattaaaaagggagctaatatttctagtgtaacagtttttggattacaagatggatatagattctattcctctgatagtactaaaactcgtcttttagatcatgatcttcaaaagaaaccaaattacgaagctattatgaaagtttt

SEQ ID NO: 24557 - DNA, 270 bp, Neocallimastix californiae
  Glyco_hydro_10
tggtcgttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttct

SEQ ID NO: 24558 - DNA, 999 bp, Neocallimastix californiae
  Glyco_hydro_10
aacatcaactattctttctaagaaaatggttgatataataaatcatcaatttaatagtgtaacattaacaaacttaatgaaaccttcgtatttactagatcaaaatggaagtcaaaaaaatattatgaaaggaatacaagatccatcagtaaatttccaatcggcaatagatactttagaatattgtaaaaagaataatataaaaatgagaggacatactttagtatggcacactcaaacaccatcatggttctttaaaaaagattatgatgataaaaatgattatgttgattctgaagtaatggaattgcgtatagaaagttatataaaacaggttatgcaattcgttcaatattattatccaggcgttgtagatgtatgggatgttgttaatgaagcggttgaaattgatgaaggatactatgatgaaaaagtatcatggaaaactcgaacaaaatgtaatgaatcatccaatccttggtatgaaacaatgggtcctgattatgtaattaaagcatttagatttgctagaaaatatgcagctcctggtgttaaattaatatataatgattataatacttttatgagtgaaaagacaacagcaattattaatctcttaaaaattttaaaagaagaaaatttaattgatggaattggaatgcaatcatatcttaccccaacttttccagaacgaagtacatatgctaatgctattaagaaattcggtgaattaggaatagaagtacaaattactgaattaactataagcattgatgataaattatcagaagaagagatgtatgaaaaacaagctgaacaatataaggaggtttttgaaatatatcttaaagcgtatcataatggtattaatattggaagtgttactgtatttggtttacaagatggctacctattttataccaatgattcaacgaaaactcgtttatgggataaagatttacaaaaaaagaagaattattattcaattttggaagtttt

SEQ ID NO: 24559 - DNA, 921 bp, Neocallimastix californiae
  Glyco_hydro_10
aaaagactactcaaagggtttcagaattggtgcagctactaacacaattcactacaacaatgctaactacgttaatgctatgaaggcattcaactatatggttgctgaaaatgcttgtaaatttgttagtattcaaggtactaaaggtaaattcaactttaatgattgtgatgctcacttaaataaggctaaacaattaggtatggatttcagaggtcacgctttaatttggcacagtatggctccaaaatggcttgaaaatgaagattccaatagtatgaaaaattctattgttaaccatattacaaatgtcttaaaacactacgaaggaaaaattgatacatgggatgtagttaatgaagctattgatgatagttctaatggtaatggctggaaaatgcgtaattccttcctttaccaaaaggttccaaatttcattgatctttctttccaaaccgctcgtaaagtttctccaaaaactaaacttttctataacgattataatactgaaggtatttggggaaagagtgaatcggtttaccaatttattgctgatttaaagaagcgtaatattcctattgatggtgttggtcttcaataccacgttagtgtccaacatcaaccacaattcaataagattaatgatttaattggacgttactgtaaattaggtgttgaagttcatattactgaattagatgtcagttgtgttgaatcctgttatgctggtgatgttgaaaagaaacaatctgatgtctttactaatgccttaaaggcttgtcttggtaattcatgttgtactggatttcttgtttggggtattggtgatccagatagttggttaggtagtgataagaagggcttacttttcaatagtaattaccaaccaaaatcacaatacacggctgtattaaatgtctt

SEQ ID NO: 24560 - DNA, 660 bp, Neocallimastix californiae
  Glyco_hydro_10
taaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagatta

SEQ ID NO: 24561 - DNA, 918 bp, Anaeromyces robustus; identical to SEQ ID NO: 24555
  Glyco_hydro_10

SEQ ID NO: 24562 - DNA, 939 bp, Anaeromyces robustus
  Glyco_hydro_10
acaagtcagaccagatttttactttggtgttgccactactaaatctttcttcgctaatccaaaatacaaagatattatgagtacttataatttacaagttggtggtaatgaatgtaagttttacactttccaaggtactgaaactttcaacacaaaaccttgtgatgacagtattgcttttgctaagaaattaggtgccaaattccgtggtcacaatcttttctggccagcttactctccatcatggttcaaaacttacagtagtgatattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagatta

SEQ ID NO: 24563 - DNA, 918 bp, Anaeromyces robustus
  Glyco_hydro_10
agactatgctaacggtttcagaattggtgctgctactaatactatgcattataataatcaaaactatgttaatgctatgaaatctttcaattatatggtagctgaaaatgcttgtaaactttctggtattcaacaacaaaaaggtgtttacaatttcaatgattgtgataatcattataagaaggctaaagaattaggtatggacttccgtggtcactgtcttatttggcatgcctatcaaccatcatggttccaaaatgctgatgctaacacattaaagaacgctattgttgatcacattactaaggtacttcaacattatgatggtaaaattgatgcctgggatgttgttaatgaagctattgatgatagttctaatggtaatggatggaagatgcgtaattccttcctttaccaaaaggttccaaactttattgatttagctttccaaactgctcgtaaagttgctccaaatgttaaacttttctataatgattataatactgaaggtgtttacgctaaaactgaatctgtttatcaatttattcaagatatgattaaacgtaatattccaattgatggtgttggtattcaatatcacgttgctgttaatcaacaaccatcttaccaaaagattaatgatttaattggtcgttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttct

SEQ ID NO: 24564 - DNA, 918 bp, Anaeromyces robustus
  Glyco_hydro_10
tgctgctaatggttttagaattggtgccgctacaaatacaattcattacagtaatcgtaattatattgaagctatgaagtctttcaattatatggttgctgaaaatgcttgtaaatttgttagtattcaaggtactaaaggtagatataattttgatgattgtgataatcatcttaaaaaagctcaagaattaaaaatggatttcagaggtcatgctttaatttggcattctatggctccacaatggcttgaacgtgaagattctaatactatgaaacaatctattattgatcatattactactgttttaaaacattatgaaggtaaaattgatacttgggatgttgttaatgaagctattgatgatggttctaatggtaatggttggaaattacgtaattctttcctttatcaaaaagttccaaatttcattgatattgctttccaaactgctcgtaaagtttctccaaatactaaacttttctataatgattataatacagaaggtatttgggcaaaaagtgaatctgtttatcaatttgttgctgatatgaaaaaacgtaatattccaattgatggtgttggtatacaatatcatgttggtgttaatgttcaacctcaatttgataaaattaataatttaattagtcgttattgtaaattaggtgttgaagttcatattacagaattagatgttagttgtgatgataattgtaatgatagagatggtggtgaaggtaaacaatctcaagtttatattaatgctttaaaagcttgtcttaataattcttgttgtactggtttccttgtttggggtattggtgatagtgatagttggagaggtgctgaaaataaaccattacttttcaattctaattatcaaccaaaaggacaatataatgctattttagaaacttt

SEQ ID NO: 24565 - DNA, 978 bp, Anaeromyces robustus
  Glyco_hydro_10
tctttctaaaaaaatgtgtcaattaattgcttatcaatttaattctgtgacttattctaatcttatgaaagctgaacatatgttagataaaacagctagtcaaaataatgctaaaaatggtaatgatatgccagttttaaaatttgataccattattgatggtttagaattttgtcaaaaaaataatgtaaaaatgagaggtcatactttagtttggcatactcaaactccttcttggtttttccgtactaatttccaagataatggttcatttgttaatgcttctaaaatggaaaaacgtatggaaagttatattaaacaaatgttagaatttattcaatattattatccaggtgtagttgatgtttgggatgttgttaatgaagctgttgaaattactaatggttcctacgatagttctacaggatggaatactcgtacaaaatttgatggaggtgataatctttggtataaaactatgggtgctgattacgtttttaaggctttccgttttgctcgtaaatatgctgataaaaatgttaaacttatttataatgattataatacttttatgtctcaaaaaactaatgctattagtaaccttattaaaaagttaaaagctgaaaatttagtggatggagttggtcttcaatcttacttaaatgctgattggccaaatcgtaatgattataaatctgctattcaaaaattcagttctcttggagttgaaatccaaattactgaattaactattaaaacagatggttctggtaataaatttaataatcaagctactcattatcaacaagttttccaaatttataaagatttaaagaaaagtggtgttaatattactagtgttactgttttcggtttacaagatggttacttattctacagtaatgatagtactgatactcgtttatgggatcataaccttaaaaagaaaccagtatacaacgccattatgaaggtttt

SEQ ID NO: 24566 - DNA, 1017 bp, Anaeromyces robustus
  Glyco_hydro_10
cggtggtaatattagcaattatactccaagttctaagaaaatgatggaacttattaattatcaatttaattctatgacttactctaatggtatgaaatcactttttattatggatcaagaaaagtcacttaagaacttagcagaaggtaaagaagaagttggtataaatttctcaggagttatagatggtttagaattttcagctaaaaataatcttaatattagaggacatgttttagtttggcataagcaaactccagaatggttttggagaaaagattttgatgaaactaaagaatatgtcgatcgtgaaactattttcaagcgtttagatagtttcatgaaaaattattttgatttcttaaatttcaactacccaggtgttgtagatgttgttgatgttgttaatgaagctgttgaagttcttgaaggaaaatatgataattctactggttggtacactcgtacagaatcatatgaaggtgatgaaaacatttggtataacttagttggaccagattatgttaaggaagctttccgtattgctcgtaaatatgcacttccaaccactaaattagtttataatgattatgatacttggagaactactcctcatgataaaactgaagctattattaatcttatgaaaatattaaaagctgaagatttagttgatgttattggtatggaatcttatattactccaggtgaaccaactccagaagaatatggtaaagctattgaacgttatgctgctgaaggattagaaattcaaattactgaatttactatttatgttactgatggtgatgattggttagaacaacaaaccattcattatcgtgatatgttcaaagctattatggaagcttataaaaagggagctaatattactagtttcactgttttcggtttacaagatggttatagattctatgatagtgatagtactagaactcgtttatatgaccacgatcttcaaaagaaaccaaacttccaagctattatggatatctt

SEQ ID NO: 24567 - DNA, 1005 bp, Piromyces finnis
  Glyco_hydro_10
tgccatgtccaccatcacatctgaaaaaatgagaaaagttattaaatatcaatttaattcaatgacctatactaatcttatgaatccaagtgctattttagatcaacaagcttctattgataatattatgaatggtaatgaagatcctattctaaattttagtaatattgttgatggtttagattttgcctataaaaatggacttaatattcgtggtcatgctctagtatggcatactcaagttccagaatggttctttagagatggatattatagcaatacagaatttgttagtagagatgttatggagtatcgtttagatagttatattcgtaagttccttggatttgttcaatttaattatccaggaacagtagatgtttgggatgtagttaatgaagcaattgaaattacagatggtcaatatgatgaaacaactggatggtatacccgtactgctaataataaaacaccaaatccttggtatgaaatatttggacctgattatgttgcaatagcattccgtattgctcgtaaatatgcccttcctaatgtaaagttaatttataatgatcataatactttccaaatccaaccacatgataaaactcaagccattattgatcttgccaatattttacaacaagaaaacttaattgatggtattggtatgcaatcttatataggagttacttggccaaatttagatgattactttaacggtttagaaaggttaattacttctactggattagaaattcaaattactgaattaacaattactccaccaataggtgataattggttaggtgctcaagcagaacaatattatgagtacttcaatagacttttatcttacattaaaaatggttataacatttctagtgtcactgtttatggtttacaagatggctatagattctacactaaagattctaccaaaactcgtcttttagatcatgatcttaaaaagaaaccaaatttcaatgctattataaatgtatt

SEQ ID NO: 24568 - DNA, 556 bp, Piromyces finnis; identical to SEQ ID NO: 13788
  Glyco_hydro_10

SEQ ID NO: 24569 - DNA, 111 bp, Piromyces finnis
  Glyco_hydro_10
tgtttggggtgttggtgatccagatagttggttaggtcaagacaaaagaggtttacttttcgatggtagttacaagccaaaggctcaatataacgctcttttaaatgtttt

SEQ ID NO: 24570 - DNA, 939 bp, Piromyces finnis
  Glyco_hydro_10
acaagttagaccagatttttactatggtgttgccactacaaagtcattcttttctaacccaaaatacaaagatatcatttctacttacaacttacatactggtggtaatgaatgtaaattctacactattcaaggtactcaaactttcaatactaaacaatgtgatgattcaattgcttttgctaagaaattcggtgctaaattccgtggacataatcttttctggccagccaactctccagattggttcaaaaattacagtgatgatattgaagaagttaaagcttattatcttgactatgttgccaaggttttagaccattacaaagatgaagaagatatcatctactgggatgttgttaatgaatccgtcactgatgattctactatcgataagtataagttacgttatggttctgatagaagtaatgaattcaagggttgggatacttacactgaagatattttcactcttgctcgtgaacatactaatccaaatgttaaattaatttacaatgattataatgctgaaaacaacaacggtaacttcaatggtaaaactggtgctgtttacaagtatattaaggaaatgaaagaaaagggtattccaattgatggtgtaggtttacaaatgcacatttcttgtaactacactccaaactacgaacaactcactgaattaattgatatgtacaaagaaatcggtgttgaagttcatgttactgaaattgatgtcagtatgaagaattgtaaaactcatgaccaacaaagaaaattatatatggatgttttcagagcttgttttgataatgaaaactgtaaggtttttactgtttggggtgcttatgatactgaatcatggattggtgcttcaaacgttccattaccatttgatgatgatatgtatccaaaggatatctactttgatatgttagaata

SEQ ID NO: 24571 - DNA, 921 bp, Piromyces finnis
  Glyco_hydro_10
taaggactatgctaaagactttagaattggtgttgctgctaacacaatgagattcaataatcaagcttacaatgaagccttaaaggctttcaactacatggttgctgaaaatggttgtaagttatctggtattcaacaaagacaaggtaactacgattttagtgattgtgataatcactataagaaggctaaggaattaggtatggctttccgtggtcatgctcttatctggcacgcatacatgccatcttggtttgaaaatgctaatgcttcaaccttaaagaatgccattgttgaacatgttaccaaggttcttcaacactacgaaggtaaaattgatacttgggatgttgtcaatgaagctattgatgacagttcaaatggtaacggttggaagatgcgtaactccttcctttatcaaaaggttccaaactttgttgatcttgcttttgaaactgcccgtaaggtttctccaaatactaagctcttctacaacgattacaatactgaaggtatttacggaaaaactgaatccgttttccaattcgttaaggacatgaaatctcgtggtattccaattgatggtgttggtattcaatatcacgtttctgttgacagtcaaccacaatacaacaagattgatgatttaatttctcgttactgtggtcttggtcttgaagttcacattactgaacttgatgttaagtgtggtagccaatgttcttcatctaatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtctt

SEQ ID NO: 24572 - DNA, 921 bp, Piromyces finnis; identical to SEQ ID NO: 24571
  Glyco_hydro_10

SEQ ID NO: 24573 - DNA, 192 bp, Piromyces finnis
  Glyco_hydro_10
taatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtctt

SEQ ID NO: 24574 - DNA, 195 bp, Piromyces finnis
  Glyco_hydro_10
atctaatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtctt

SEQ ID NO: 24575 - DNA, 192 bp, Piromyces finnis; identical to SEQ ID NO: 24573
  Glyco_hydro_10

SEQ ID NO: 24576 - DNA, 501 bp, Neocallimastix californiae
  Glyco_hydro_11
ttgttttaaggcttcctggaacaacgctggtgatttcttaggtcgtgttggtcttgtttgggataacaagccaaattataagaaccttggaggtgatcttattgctaactactcttacaagaagagtggtaacgatggaggtacatattcctacgttggtatctacggttggatggataatccacaaattgaatactatgttgttgatgactggcttcataacagaggtgctccaggtggttcttacatgggttcacaaaagggtaccattaatgttgatggtggtacatacaaggtttggactggtactcgtactggtgcttctaagtggggtcaatctaccttcactcaaattttctctgttcgtactcaacaacgtacttgtggtcaaattaacatttctgaacatttcagacaatgggaaaaattaggtattagagttggtcaacttatggaagctcaaattttagctgaatctggtggtggttctggttacgttga

SEQ ID NO: 24577 - DNA, 567 bp, Neocallimastix californiae
  Glyco_hydro_11
tggaaattacagatacgaaatctggcgtgatggtaacggtggtgaattaaccctttacccaaaggatgcttgctttaaggcttcttggaacaacgctggtgattatttaggtcgtgttggtcttgtttgggatcaatatattaattacaagaatcttgatggtgatcttgttgctaagtataactacaagaagagtggtaacgatggaggtacatattcctacgttggtgtctacggttggatggataatccacaaattgaatactatgttgttgatgactggcttcataacagaggtgctccaggtggttcttacatgggttcacaaaagggaactattactgttgatggtggtacatacaaggtttggtctggtactcgtactggtgcttctaagtggggtcaatctaccttcactcaaattttctccgttcgtactgaacaacgtacctgtggtcaaattaacatttctgaacatttcagacaatgggaaaaattaggtcttagaattggttctgttatggaagctcaaattttagctgaatctggtggtggttctggttacgt

SEQ ID NO: 24578 - DNA, 252 bp, Neocallimastix californiae
  Glyco_hydro_11
gcgtccaggtgattgggttggtaataagaagcatggtgatttcactattgatggtgctaagtacactgtttatgaaaatacacgttatggtccatctattgatggtgatactactttcaaacaattctttagtattcgtcaacaagctcgtgattgtggtactattgatattactgctcactttgaacaatgggaaaagcttggtatgaaacttggtaagatgcatgaagctaaagttttaggtgaagctgg

SEQ ID NO: 24579 - DNA, 525 bp, Neocallimastix californiae
  Glyco_hydro_11
tagtgtagattatgaaatatgggctgatggtggtaacaacagtgccgatttctataaagatggttctttctcctgtgctttcaataatagtaaagattatttatgtcgttctggtgttaatattagacctgctaaatacccatctgaaattggaaaaattaaggctgaatataaggttgttaaacaaaatgctcaaaatgtaggttattcttatgttggtgtttacggttggactttagaatctggtatttctggagtctttgaattttacattgtcgataattggctttctcaatatagaccaggtgattgggttggtaatcaaaagaagggtgacttcactattgatggtgctgtatacactgtatacaaaaatgttaatggtaatcttactcaatacttcagtcttcgtagagaaccacgtacctgtggtactattgatgttactgctcactttgaccaatgggaaaaattaggtttgaaaatgggaaagattagtgaaattaaggttttaggtgaagccgg

SEQ ID NO: 24580 - DNA, 558 bp, Neocallimastix californiae
  Glyco_hydro_11
cggtggtgttggttatgaattatgggctgatagtggtaacaacagtgctactttctattccgatggttcattctcttgtaccttccaaaatgccaaggattacttatgccgttcaggtctttcctttgatagtactaagactcaccaacaaattggccacatgtatgctgatttcaagttagttaaacaaaacattcgtaatgttgattattcttacattggtatctacggttggaccagaaatccacttgttgaattctacgttgttgataactggcttagtcaatatcgtccaggtgattgggttggtaacaaaaagcatggtgatttcactattgatggtgctagatacactgtttatgaaaatactcgttacggtccatctattgatggtaacactaattttaagcaatacttcagtatccgtcaaactgctcgtgactgtggtactattgatattactgctcacttccaacaatgggaaaaacttggtatgactatgggtaagatgcatgaagctaaagttttaggtgaagctggtagtaacggtgctggtac

SEQ ID NO: 24581 - DNA, 376 bp, Neocallimastix californiae
  Glyco_hydro_11
taacggtattggttatgaattatgggctgatagtggtaataacagtgctactttctattctgatggttcattctcttgtactttccaaaaggctaaggattacttatgtcgttccggtctttccttcgatagtaccaagactcatgaccaacttggtcatatgtatgctgactttaaattagttaaacaaaacattcaaaatgttgattattcttatgttggtatctacggttggagcaaggatccacttgtcgaattctatgttgttgataactggctcagtcaatggcgtccaggagattgggtaggaaacaagaagcatggtgattacgttattgatggtgctacctacactgtttatgaaaatgaacgttat

SEQ ID NO: 24582 - DNA, 318 bp, Neocallimastix californiae
  Glyco_hydro_11
tccacttgtcgaattctatgttgttgataactggctcagtcaatggcgtccaggagattgggtaggaaacaagaagcatggtgattacgttattgatggtgctacctacactgtttatgaaaatgaacgttatggtccatccattgttggtgatactaacttcaagcaattcttcagtattcgtaaggaagctcgtgactgtggtactattgatattaccgctcacttcttacaatgggaaaaacttggaatgaaattaggtaagatgtatgaagctaaggttttaggagaagctggtagtaacagttccggtactac

SEQ ID NO: 24583 - DNA, 561 bp, Neocallimastix californiae
  Glyco_hydro_11
taacggtattggttatgaattatgggccgatagtggaaacaatagtgctaccttctatgaagatggttctttctcttgttctttcaataatgctaaggattatttatgtcgttccggtctttccttcgacagtactaagactcataaggaaattggtcacatctatgccgactttaaattagttaaacaaaacattcgtaatgttgattattcctatgtcggtatttacggttggaccagaaatccacttgttgaattctacgttgttgataactggctcagtcaatggcgtccaggagattgggttggtaacaagaagcatggtgatttcactattgatggtgctaaatacacagtttatgaaaacacacgttacggtccatccattgatggtgataccaacttcaagcaattcttcagtatccgtcaaactgctcgtgactgtggtaccattgatattacagctcactttgaacaatgggaaaaacttggtatgaaattaggtaagatgcatgaagctaaagttttaggtgaagctggtagtactggttctggtaccac

SEQ ID NO: 24584 - DNA, 522 bp, Neocallimastix californiae
  Glyco_hydro_11
ttatgaattatggtcagacagtggtgacaacagtgctactttctatgccgatggttcattctcttgttcattcaagaatgctaaggattacttatgtcgttccggtctttccttcgatagtactaagactcacaaagaaattggacacatttatgctgatttcaagttagttaagcaagatattaaggatgttgattattcatacattggtatttatggttggactcgtgaaccacttgttgaatactatgttgttgataactggcttagtcaataccgtccaggtgactgggttggaaacaagaaatatggtgatttcgaaattgatggtgctgaatacactgtttatgaaaacactcgtactggtccatctattgatggtgataatgttactttcaagcaatacttcagtattcgtaaagaagctcgtgattgtggtactattgatattacagctcatttcgaaaaatgggaagaacttgatttagttcttggtaagatgcatgaagctaaggttttagg

SEQ ID NO: 24585 - DNA, 522 bp, Neocallimastix californiae
  Glyco_hydro_11
ttatgaattatggtcagacagtggtgacaacagtgctactttctatgccgatggttcattctcttgttcattcaagaatgctaaggattacttatgtcgttccggtctttccttcgatagtactaaaactcacaaagaaattggacacatttatgctgacttcaaattagttaagcaagatattcaagatgttgattattcatacattggtatttatggttggactcgtgaaccacttgttgaatactatgttgttgataactggcttagtcaataccgtccaggtgactgggttggaaacaagaaatatggtgatttcgaaattgatggtgctgaatacactgtttatgaaaacactcgtactggtccatctattgatggtgataatgttactttcaaacaatacttcagtattcgtaaagaagctcgtgactgtggtactattgatattacagcccattttgaaaaatgggaagaacttgatttagttcttggtaagatgcatgaagctaaggttttagg

SEQ ID NO: 24586 - DNA, 555 bp, Neocallimastix californiae
  Glyco_hydro_11
aggtattggctatgaattatgggccgatagtggtaataacagtgctactttttatgaagatggttctttctcttgttcttttagtagagcaaaggattatttatgtcgtagtggtctctcctttgatagtacaaagactcatgaccaaattggtcatatatatgctgactttaaacttgtcaagcaaaatattcaaaatgtagattattcatacgttggtatttacggttggactagaaacccacttgttgaattctatgttgttgataactggcttagtcaatggcgtccaggtgattgggttggtaacaagaaacatggtgatttcgttattgatggtgctacttatactgtctatgaaaacactcgttatggtccatctattgatggtgatactaatttcaagcaattcttcagtatccgtcaacaagctcgtgactgtggtactattgatattactgctcacttccaacaatgggaaaagcttggtatgaaattaggtaaaatgcatgaagctaaggttttaggtgaagctggtagtaatggtcaaggtac

SEQ ID NO: 24587 - DNA, 570 bp, Neocallimastix californiae
  Glyco_hydro_11
tggaaattacagatatgaaatctggcgtgatggtaacggtggtgaattaactttatacccaaaggatgcttgtttcaaggcatcatggaataatgccggtgattacttaggtcgtgttggtcttgtatgggataacaagattaattataagaatgctggtggtgatattattgctaactatgcttataagaagagtggtagtgatggaggtacatactcctacattggtatttacggttggatggataacccacaaattgaatactatgttgttgatgactggttacataacagaggagctccaggaggttcatggatgggtcaacaaaagggtactattaatgttgatggtggtacatacaaggtttggtctggacaacgtactggagcttctaaatggggtcaatctactttcacacaaattttctccgttcgtacttcacaacgtcaatgtggtcaaattaacatttctgaacacttcagacaatgggaaaaattaggtcttagaattggtcaagtcatggaagcccaaattttagctgaagctggtggtggttctggttatgttga

SEQ ID NO: 24588 - DNA, 570 bp, Neocallimastix californiae
  Glyco_hydro_11
tggaaattacagatatgaaatctggcgtgatggtaatggtggtgaattaactttatacccaaaggatgcttgtttcaaggcttcatggaataatgctggtgattacttaggtcgtgttggtcttgtatgggataacaagattaactacaagaatgctggtggtgatattgttgctaaatatgcttataagaagagtggtagtgatggaggtacatactcctacattggtatttacggttggatggataacccacaaattgaatactatgttgttgatgactggttacataacagaggtgcaccaggaggttcatggatgggtcaacaaaagggtactattaatgttgatggtggtacatacaaggtttggtctggacaacgtactggagcttccaaatggggtcaatctactttcacacaaattttctccgttcgtacttcacaacgtcaatgtggtcaaattaacatttctgaacacttcagacaatgggaaaaattgggtcttagaattggtcaagtcatggaagcccaaattttagctgaagctggtggtggttctggttatgttga

SEQ ID NO: 24589 - DNA, 564 bp, Neocallimastix californiae
  Glyco_hydro_11
caatggtattggatatgaattatgggcagacagtggcaataacagtgctactttctattctgatggttcattctcatgttctttccaaaacgcaaaggattatttatgtcgtagtggtctttcctttgatagcaccaaaactcatcaacaacttggacatatgtatgctgacttcaaacttgttaaacaaggtatttctaatgtagattattcttatgttggtatttatggatggacaagaagtccacttgttgaattctatgttgtagataactggcttagtcaatggcgtccaggagattgggtaggaaacaaaaagtatggcgattacaccattgatggtgctaaatatactgtttatgaaaatagtcgttacggtccatccattgatggtgatactaatttcaagcagttcttcagtattcgtcaacaagctcgtgattgtggtacaattgatattactgctcacttcgaacaatgggaaaaactcggtatgaaaatgggcaaaatgcatgaagcaaaggttttaggagaagctggtagtactggttcaggtactagtgg

SEQ ID NO: 24590 - DNA, 525 bp, Neocallimastix californiae
  Glyco_hydro_11
aggttatgaattatggtcagatagtggtgataacagtgctactttctattctgatggttcattctcttgttcattcaagaatgctaaagattatttatgtcgttcaggtctttccttcgacagtactaagactcacaaagaaattggtcacatttatgctgactttaagttagttaaacaagatattaaagatgttgattattcatacattggtatttatggttggactcgtaaaccacttgttgaatactatgttgttgataactggcttagtcaataccgtccaggtgattgggttggaaataagaaatttggagatttcgaaattgatggtgctgaatatactgtttatgaaaacactcgtactggaccatctattgatggagataatgttactttcaaacaatacttcagtattcgtaaagaagctcgtgactgtggtactattgatattaccgctcactttgaaaagtgggaagaacttggtttaacccttggtaaaatgcatgaagctaaagtattagg

SEQ ID NO: 24591 - DNA, 525 bp, Neocallimastix californiae
  Glyco_hydro_11
aggttatgaattatggtcagatagtggtgataacagtgctactttctattctgatggttcattctcttgttcattcaagaatgctaaagattatttatgtcgttcaggtctttccttcgacagtactaagactcacaaagaaattggtcacatttatgctgactttaagttagttaaacaagatattaaggatgttgattattcatacattggtatttatggttggactcgtgaaccacttgttgaatattatgttgttgataactggcttagtcaataccgtccaggtgattgggttggaaataagaaatatggagatttcgaaattgatggtgctgaatatactgtttatgaaaatactcgtactggaccatctattgatggagataatgttactttcaaacaatacttcagtattcgtaaagaagctcgtgactgtggtactattgatattaccgcccactttgaaaagtgggaagaacttggtttaacccttggtaaaatgcatgaagctaaagtattagg

SEQ ID NO: 24592 - DNA, 522 bp, Neocallimastix californiae
  Glyco_hydro_11
ttatgaattatggtcagatagtggtgataacagtgctactttctattctgatggttcattctcttgttcattcaagaatgctaaagattatttatgtcgttccggtctttccttcgacagtactaagactcacaaagaaattggtcacatatatgctgatttcaagttagttaaacaagatattcaagatgttgattattcatacattggtatttatggttggactcgtgaaccacttgttgaatattatgttgttgataactggcttagtcaataccgtccaggtgattgggttggaaataagaaatatggagatttcgaaattgatggtgctgaatatactgtttatgaaaatactcgtactggaccatctattgatggagataatgttactttcaaacaatacttcagtattcgtaaagaagctcgtgactgtggtactattgatattaccgctcactttaaaaaatgggaagaacttggtttaacccttggtaaaatgcatgaagctaaagtattagg

SEQ ID NO: 24593 - DNA, 558 bp, Neocallimastix californiae
  Glyco_hydro_11
tggttaccattatgaaatctggtaccaaggtggtaacaattcaatgacctattacgataatggtactttcaaggccagctggggtggaacaaatgatttccttgctcgtgttggtcttaagtataatgaagataagactcaccaacaacttggtcaaatcgatgcttactttaagtggactaaatctggtagtgctggtggttataactatattggtatctatggttggactgtcgatccattagtagaatactatattgtagatgactggtacaataaaccaggttcttaccttggacaaaagaagggtgaattcactgttgatggtgatacttacgaaattttccaaaatactcgtgttaaccaaccatctattaagggtacttcaaccttcccacaattcttcagtgttcgtcgtagtgctcgttcttgtggtcatattgatattagtgctcacttcaagaagtgggaatccctcggtatgaaattaggtaagatgtacgaagccaaggttctcgttgaagctggtggtggttctggttcatttgatgttaccta

SEQ ID NO: 24594 - DNA, 555 bp, Neocallimastix californiae
  Glyco_hydro_11
aggttatgaattatggtctgatagtggttataatagtgctactttctattctgatggttcattctcatgttcattcagtaatgctaaagattacttatgtcgttcaggtctttcattcgatagtactcaaactcatgatcaaattggtcatatgtatgctgacttcaaacttgttaaacaaaatattagaaatgttgattattcttatattggtgtttacggttggagtagagatccacttgttgaatattacgttgtagataattggcttagtcaatatcgtccaggagattgggttggtaataagaaacatggtgatttcactattgatggtgctaaatacactgtttatgaaaatactcgttatggtccatctattgatggtgatactcaatttaaacaatatttcagtattcgtcaacaagcacgtgattgtggtaccattgatattacagctcatttccaacaatgggaaaaacttggtatgaaacttggtaaaatgcatgaagctaaagttttaggagaagcaggtagtaatggatcaggtactagtgg

SEQ ID NO: 24595 - DNA, 519 bp, Neocallimastix californiae
  Glyco_hydro_11
aggttatgaattatggtctgatagtggttacaatagtgctactttctattctgatggttcattctcatgttcattcaataatgccaaggattacttatgtcgttcaggtctttcatttgatagtactaagactcatgatcaaattggtcatatgtatgctgatttcaaacttgttaaacaaaacattagaaatgttgattattcctatgttggtgtttacggttggactagaaatccacttgttgaatattatattgtagataactggcttagtcaatatcgtccaggagattgggttggtaataagaaacatggtgatttcactattgatggtgctcaatatactgtttatgaaaatactcgttatggtccatctattgatggtgatactcaatttaaacaatatttcagtattcgtcaacaagcacgtgattgtggtaccattgatattacagctcatttccaacaatgggaaaaacttggtatgaaacttggtaaaatgcatgaagctaaagtatt

SEQ ID NO: 24596 - DNA, 525 bp, Neocallimastix californiae
  Glyco_hydro_11
ttccgttgattatgaagtatgggctgatggtggtaacaacagtgctgttttctatagtgatggttctttctcatgttccttctcaaatactaaagattatttatgtcgtactggtgtttctttctcacaagctaaatatccatctgaaattggtcatattaaggcagaatataaagttgtaaaacaaaatgctcaaaatgtaggttattcttacgttggtgtttacggatggactttaaattctggtatttcaggtgtatttgaattttatattgttgataactggctttctccaggaagaccaggtgattgggttggtaatgaaaagaagggtgatttcactattgatggtggtaaatacactgtctacaaaaatgttaatggtaatcttacacaatacttcagtcttcgtacaagtccacgtacttgtggtactattgatgttactgctcactttgaacaatgggaaaaaattggtttaaagatgggtaagattactgaagttaaagttttaggtgaagccgg

SEQ ID NO: 24597 - DNA, 558 bp, Anaeromyces robustus; identical to SEQ ID NO: 24593
  Glyco_hydro_11

SEQ ID NO: 24598 - DNA, 540 bp, Anaeromyces robustus
  Glyco_hydro_11
aggtataggttatgaattatgggctgatagtggtagtaacagtgctactttctattctgatggttccttctcttgttctttcagtcgtgccaaggattacttatgtcgttctggtctttcctttgatagtactaaaactcatcaacaaattggtcacatttacgctgacttcaaacttgtaaaacaaaatattcaatctgtagattattcttatgttggtatttatggttggactagaaatccacttgttgaattctatgttgtcgataattggcttagtcaataccgtccaggtgattgggtaggtaataagaaacatggtgatttcactattgatggtgctaaatatactgtatatgaaaatactcgttatggtccatctattgatggtgatactcaatttaaacaattctttagtattcgtcaacaagctcgtgattgtggtactattgatattactgctcactttgaacaatgggaaaaacttggtatgaaattaggtaaaatgcatgaagctaaagttttaggtgaagctggtag

SEQ ID NO: 24599 - DNA, 525 bp, Anaeromyces robustus; identical to SEQ ID NO: 24596
  Glyco_hydro_11

SEQ ID NO: 24600 - DNA, 540 bp, Anaeromyces robustus
  Glyco_hydro_11
tggttatgaattatgggctgatagtggtaataatagtgctactttctatgctgatggttcattctcttgttccttcagacaagctaaggattacttatgtcgttctggtctctccttcgacagtactcaaactcaccaacaaattggtcacatgtacgctgacttcaaacttgttaaacaaaacattcaatctgtagattactcatacgttggtatttacggttggactagaaacccacttgttgaattctacgttgttgataactggctcagtcaatggcgtccaggagattgggttggtaacaaaaagcatggtgatttcactattgatggtgctaaatatactgtttatgaaaacactcgttacggtccatctattgatggtgacactaacttcaagcaatacttcagtattcgtcaacaaccacgtgactgtggtacaattgatattactgctcacttccaacaatgggaaaaacttggtatgaccatgggtaaaatgcatgaagctaaagttttaggtgaagccggtagtactgg

SEQ ID NO: 24601 - DNA, 546 bp, Anaeromyces robustus
  Glyco_hydro_11
tggtggtgttggttatgaattatggtctgacagtggtagcaacagtgctactttctattctgatggttctttttcttgttctttcagaagtgctaaagattatttatgtcgttctggtctttctttcgacagtactaaaactcaccaacaaatcggtcatatatacgctgatttcaaacttgttaaacaaaatattcaaaatgttgattactcttatgtaggtatttacggttggactagaaacccacttgttgaattctacgttgttgataattggcttagtcaatatcgtccaggtgattgggttggtaataaaaaacatggtgatttcactattgatggtgctaaatatactgtttatgaaaatactcgttatggtccatctattgatggtaatacaaacttcaaacaatactttagtattcgtcaacaagctcgtgattgtggtactattgatattactgcccactttgaacaatgggaaaaacttggtatgactatgggtaaaatgcatgaagctaaagttttaggtgaagctggtagtaa

SEQ ID NO: 24602 - DNA, 543 bp, Anaeromyces robustus
  Glyco_hydro_11
tagtgttggttatgaattatggtctgacagtggtaataacagtgctactttctattctgatggttctttctcttgttctttcagaagtgctaaggattatttatgtcgttctggtctttctttcgacagtactaaaactcaccaacaaatcggtcatatatacgctgatttcaaacttgttaaacaaaatattcaaaatgttgattactcttatgtaggtatttacggttggactagaaacccacttgttgaattctacgttgttgataattggcttagtcaatatcgtccaggtgattgggttggtaataaaaaacatggtgaatttactattgatggtgctaaatatactgtttatgaaaatactcgttatggtccatctattgatggtgatacaagtttcaaacaatactttagtattcgtcaacaagctcgtgattgtggtactattgatattactgcccactttgaacaatgggaaaaacttggtatgactatgggtaaaatgcatgaagctaaagttttaggtgaagctggtagtaa

SEQ ID NO: 24603 - DNA, 540 bp, Anaeromyces robustus
  Glyco_hydro_11
tggaggagtaggttatgaattatggtttgaaggtggtaataatagtgctactttctattctgatggttcattttcttgttctttccaaggttctaaggattatttatgtcgtacaggtctttcatttaatagtgataaaacttaccaacaaatcggtcatatgtttgccgattttaaacttgttaaacaaggtatttcaaatgtagattattcttatgttggtatttatggttggacaagaaatccacttgttgaattttatattgtagataattggctcagtccaagtcgtccaggggattgggttggtaatagaaaacatggtgatttcactattgatggtgctaaatatactgtttatgaaaatactcgtaatggtccttctattgatggtaatactaatttcaaacaatatttcagtattcgtcaacaagctcgtgattgtggtactattgatattaatgctcactttgaacaatgggaaaaattaggtatgcaaatgggtaaaatgcatgaagctaaaattttaggtgaagctgg

SEQ ID NO: 24604 - DNA, 567 bp, Anaeromyces robustus
  Glyco_hydro_11
tattggtggtgtaggttatgaattatgggcagatagtggtaataatagtgctactttctattctgatggttcattctcttgtactttccaaaatgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggatctggtactagtgg

SEQ ID NO: 24605 - DNA, 564 bp, Anaeromyces robustus
  Glyco_hydro_11
tattggtggtgtaggttatgaattatgggcagatagtggtaataatagtgctactttctattctgatggttcattctcttgtactttccaaaatgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggagctggtactag

SEQ ID NO: 24606 - DNA, 555 bp, Anaeromyces robustus
  Glyco_hydro_11
tgtaggttatgaattatgggcagatagtggtaataatagtgctactttctattctgatggttcattctcttgtactttccagagtgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggagctggtactag

SEQ ID NO: 24607 - DNA, 141 bp, Piromyces finnis
  Glyco_hydro_11
tattcgtaaggaagctcgtgactgtggtactattgatattacagctcacttccaacaatgggaaaagcttggtatgaagcttggtaagatgcatgaagctaaggttttaggagaagctggtagtaatggatcaggtactac

SEQ ID NO: 24608 - DNA, 561 bp, Piromyces finnis
  Glyco_hydro_11
tggtattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgattgtggtactattgatattacagctcacttccaacaatgggctaaacttggtatgaatcttggtaagatgcatgaagctaaggttttaggtgaagctggtagtactggttctggtactagtgg

SEQ ID NO: 24609 - DNA, 564 bp, Piromyces finnis
  Glyco_hydro_11
tggtggtattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgactgtggtactattgatattactgctcacttccaacaatgggaaaagcttggtatgaagcttggtaagatgcatgaagctaaggttttaggtgaagctggtagtactggttctggtactagtgg

SEQ ID NO: 24610 - DNA, 564 bp, Piromyces finnis
  Glyco_hydro_11
tggaggaattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgactgtggtactattgatattactgctcacttccaacaatgggaaaagcttggtatgaagcttggtaagatgcatgaagctaaggttttaggtgaagctggtagtactggttctggtactagtgg

SEQ ID NO: 24611 - DNA, 477 bp, Piromyces finnis
  Glyco_hydro_11
aaatgctaaggattatttatgtcgtactggtctttcattcgatagtactaagacccacgatcaacttggtcacatgtacgctgatttcaagcttgttaagcaaaacattagaaatgttgattactcttacgttggtatttacggttggaccagaaacccacttgttgaattctacgttgttgataactggctcagtcaatggcgtccaggtgattgggttggtaacaagaagcatggtgatttcactattgatggtgctcaatacactgtttacgaaaacactcgttacggtccatctattgatggtgatactcaattcaaacaatacttcagtattcgtcaacaagctcgtgattgtggtactattgatattacagctcacttccaacaatgggaaaagcttggtatgaagcttggtaagatgcatgaagctaaggttttaggtgaagctggtagtactggttctggtactagtgg

SEQ ID NO: 24612 - DNA, 528 bp, Neocallimastix californiae
  Glyco_hydro_11/12
tgcttgttttaaggcttcctggaacaacgctggtgatttcttaggtcgtgttggtcttgtttgggataacaagccaaattataagaaccttggaggtgatcttattgctaactactcttacaagaagagtggtaacgatggaggtacatattcctacgttggtatctacggttggatggataatccacaaattgaatactatgttgttgatgactggcttcataacagaggtgctccaggtggttcttacatgggttcacaaaagggtaccattaatgttgatggtggtacatacaaggtttggactggtactcgtactggtgcttctaagtggggtcaatctaccttcactcaaattttctctgttcgtactcaacaacgtacttgtggtcaaattaacatttctgaacatttcagacaatgggaaaaattaggtattagagttggtcaacttatggaagctcaaattttagctgaatctggtggtggttctggttacgttgatttcacttacgctactgttgaaat

SEQ ID NO: 24613 - DNA, 615 bp, Neocallimastix californiae
  Glyco_hydro_11/12
caagaatgaaaccggtagaggtaatggaaattacagatacgaaatctggcgtgatggtaacggtggtgaattaaccctttacccaaaggatgcttgctttaaggcttcttggaacaacgctggtgattatttaggtcgtgttggtcttgtttgggatcaatatattaattacaagaatcttgatggtgatcttgttgctaagtataactacaagaagagtggtaacgatggaggtacatattcctacgttggtgtctacggttggatggataatccacaaattgaatactatgttgttgatgactggcttcataacagaggtgctccaggtggttcttacatgggttcacaaaagggaactattactgttgatggtggtacatacaaggtttggtctggtactcgtactggtgcttctaagtggggtcaatctaccttcactcaaattttctccgttcgtactgaacaacgtacctgtggtcaaattaacatttctgaacatttcagacaatgggaaaaattaggtcttagaattggttctgttatggaagctcaaattttagctgaatctggtggtggttctggttacgttgattacacttacgctaccgttga

SEQ ID NO: 24614 - DNA, 315 bp, Neocallimastix californiae
  Glyco_hydro_11/12
atggcgtccaggtgattgggttggtaataagaagcatggtgatttcactattgatggtgctaagtacactgtttatgaaaatacacgttatggtccatctattgatggtgatactactttcaaacaattctttagtattcgtcaacaagctcgtgattgtggtactattgatattactgctcactttgaacaatgggaaaagcttggtatgaaacttggtaagatgcatgaagctaaagttttaggtgaagctggtagtaatggaggtggtacaactggtactgctgatttcccatacgccaaggtttacattgc

SEQ ID NO: 24615 - DNA, 612 bp, Neocallimastix californiae
  Glyco_hydro_11/12
agtatcaacaactggcaataaaacaggaagaattggtagtgtagattatgaaatatgggctgatggtggtaacaacagtgccgatttctataaagatggttctttctcctgtgctttcaataatagtaaagattatttatgtcgttctggtgttaatattagacctgctaaatacccatctgaaattggaaaaattaaggctgaatataaggttgttaaacaaaatgctcaaaatgtaggttattcttatgttggtgtttacggttggactttagaatctggtatttctggagtctttgaattttacattgtcgataattggctttctcaatatagaccaggtgattgggttggtaatcaaaagaagggtgacttcactattgatggtgctgtatacactgtatacaaaaatgttaatggtaatcttactcaatacttcagtcttcgtagagaaccacgtacctgtggtactattgatgttactgctcactttgaccaatgggaaaaattaggtttgaaaatgggaaagattagtgaaattaaggttttaggtgaagccggtaatactggtggtggttgtactggtagagtagatttcccatatgctaagat

SEQ ID NO: 24616 - DNA, 630 bp, Neocallimastix californiae
  Glyco_hydro_11/12
taaggttactagtaacaaggttggctccatcggtggtgttggttatgaattatgggctgatagtggtaacaacagtgctactttctattccgatggttcattctcttgtaccttccaaaatgccaaggattacttatgccgttcaggtctttcctttgatagtactaagactcaccaacaaattggccacatgtatgctgatttcaagttagttaaacaaaacattcgtaatgttgattattcttacattggtatctacggttggaccagaaatccacttgttgaattctacgttgttgataactggcttagtcaatatcgtccaggtgattgggttggtaacaaaaagcatggtgatttcactattgatggtgctagatacactgtttatgaaaatactcgttacggtccatctattgatggtaacactaattttaagcaatacttcagtatccgtcaaactgctcgtgactgtggtactattgatattactgctcacttccaacaatgggaaaaacttggtatgactatgggtaagatgcatgaagctaaagttttaggtgaagctggtagtaacggtgctggtactactggtactgcagatttcccatatgctaaggtttacattgg

SEQ ID NO: 24617 - DNA, 357 bp, Neocallimastix californiae
  Glyco_hydro_11/12
tccacttgtcgaattctatgttgttgataactggctcagtcaatggcgtccaggagattgggtaggaaacaagaagcatggtgattacgttattgatggtgctacctacactgtttatgaaaatgaacgttatggtccatccattgttggtgatactaacttcaagcaattcttcagtattcgtaaggaagctcgtgactgtggtactattgatattaccgctcacttcttacaatgggaaaaacttggaatgaaattaggtaagatgtatgaagctaaggttttaggagaagctggtagtaacagttccggtactactggtactgctgatttcccatacgctaaggtatacatcag

SEQ ID NO: 24618 - DNA, 406 bp, Neocallimastix californiae
  Glyco_hydro_11/12
taaggttactagtaacaaagttggttctattaacggtattggttatgaattatgggctgatagtggtaataacagtgctactttctattctgatggttcattctcttgtactttccaaaaggctaaggattacttatgtcgttccggtctttccttcgatagtaccaagactcatgaccaacttggtcatatgtatgctgactttaaattagttaaacaaaacattcaaaatgttgattattcttatgttggtatctacggttggagcaaggatccacttgtcgaattctatgttgttgataactggctcagtcaatggcgtccaggagattgggtaggaaacaagaagcatggtgattacgttattgatggtgctacctacactgtttatgaaaatgaacgttat

SEQ ID NO: 24619 - DNA, 603 bp, Neocallimastix californiae
  Glyco_hydro_11/12
aattaacggtattggttatgaattatgggccgatagtggaaacaatagtgctaccttctatgaagatggttctttctcttgttctttcaataatgctaaggattatttatgtcgttccggtctttccttcgacagtactaagactcataaggaaattggtcacatctatgccgactttaaattagttaaacaaaacattcgtaatgttgattattcctatgtcggtatttacggttggaccagaaatccacttgttgaattctacgttgttgataactggctcagtcaatggcgtccaggagattgggttggtaacaagaagcatggtgatttcactattgatggtgctaaatacacagtttatgaaaacacacgttacggtccatccattgatggtgataccaacttcaagcaattcttcagtatccgtcaaactgctcgtgactgtggtaccattgatattacagctcactttgaacaatgggaaaaacttggtatgaaattaggtaagatgcatgaagctaaagttttaggtgaagctggtagtactggttctggtaccactggtaccgctgatttcccatatgccaaggtttacattgg

SEQ ID NO: 24620 - DNA, 630 bp, Neocallimastix californiae
  Glyco_hydro_11/12
agaaactagtaacaaggttggtgctattggtgatattggttatgaattatggtcagacagtggtgacaacagtgctactttctatgccgatggttcattctcttgttcattcaagaatgctaaggattacttatgtcgttccggtctttccttcgatagtactaaaactcacaaagaaattggacacatttatgctgacttcaaattagttaagcaagatattcaagatgttgattattcatacattggtatttatggttggactcgtgaaccacttgttgaatactatgttgttgataactggcttagtcaataccgtccaggtgactgggttggaaacaagaaatatggtgatttcgaaattgatggtgctgaatacactgtttatgaaaacactcgtactggtccatctattgatggtgataatgttactttcaaacaatacttcagtattcgtaaagaagctcgtgactgtggtactattgatattacagcccattttgaaaaatgggaagaacttgatttagttcttggtaagatgcatgaagctaaggttttaggtgaagctggtagtattcatgatggtactagtggtactgctgatttcccatatgctaaggtttatattaa

SEQ ID NO: 24621 - DNA, 630 bp, Neocallimastix californiae
  Glyco_hydro_11/12
agaaactagtaacaaggttggtgctattggtgatattggttatgaattatggtcagacagtggtgacaacagtgctactttctatgccgatggttcattctcttgttcattcaagaatgctaaggattacttatgtcgttccggtctttccttcgatagtactaagactcacaaagaaattggacacatttatgctgatttcaagttagttaagcaagatattaaggatgttgattattcatacattggtatttatggttggactcgtgaaccacttgttgaatactatgttgttgataactggcttagtcaataccgtccaggtgactgggttggaaacaagaaatatggtgatttcgaaattgatggtgctgaatacactgtttatgaaaacactcgtactggtccatctattgatggtgataatgttactttcaagcaatacttcagtattcgtaaagaagctcgtgattgtggtactattgatattacagctcatttcgaaaaatgggaagaacttgatttagttcttggtaagatgcatgaagctaaggttttaggtgaagctggtagtattcatgatggtactagtggtactgctgatttcccatatgctaatgtttacattaa

SEQ ID NO: 24622 - DNA, 630 bp, Neocallimastix californiae
  Glyco_hydro_11/12
taaggttactagtaacaaagttggtaacataaaaggtattggctatgaattatgggccgatagtggtaataacagtgctactttttatgaagatggttctttctcttgttcttttagtagagcaaaggattatttatgtcgtagtggtctctcctttgatagtacaaagactcatgaccaaattggtcatatatatgctgactttaaacttgtcaagcaaaatattcaaaatgtagattattcatacgttggtatttacggttggactagaaacccacttgttgaattctatgttgttgataactggcttagtcaatggcgtccaggtgattgggttggtaacaagaaacatggtgatttcgttattgatggtgctacttatactgtctatgaaaacactcgttatggtccatctattgatggtgatactaatttcaagcaattcttcagtatccgtcaacaagctcgtgactgtggtactattgatattactgctcacttccaacaatgggaaaagcttggtatgaaattaggtaaaatgcatgaagctaaggttttaggtgaagctggtagtaatggtcaaggtactagtggtactgctgatttcccatatgctaaagtttatattgg

SEQ ID NO: 24623 - DNA, 618 bp, Neocallimastix californiae
  Glyco_hydro_11/12
taagaatgaaaccggtagaggtaatggaaattacagatatgaaatctggcgtgatggtaacggtggtgaattaactttatacccaaaggatgcttgtttcaaggcatcatggaataatgccggtgattacttaggtcgtgttggtcttgtatgggataacaagattaattataagaatgctggtggtgatattattgctaactatgcttataagaagagtggtagtgatggaggtacatactcctacattggtatttacggttggatggataacccacaaattgaatactatgttgttgatgactggttacataacagaggagctccaggaggttcatggatgggtcaacaaaagggtactattaatgttgatggtggtacatacaaggtttggtctggacaacgtactggagcttctaaatggggtcaatctactttcacacaaattttctccgttcgtacttcacaacgtcaatgtggtcaaattaacatttctgaacacttcagacaatgggaaaaattaggtcttagaattggtcaagtcatggaagcccaaattttagctgaagctggtggtggttctggttatgttgatttcacttacgctaccgtagaaat

SEQ ID NO: 24624 - DNA, 615 bp, Neocallimastix californiae
  Glyco_hydro_11/12
taagaatgaaaccggtagaggtaatggaaattacagatatgaaatctggcgtgatggtaatggtggtgaattaactttatacccaaaggatgcttgtttcaaggcttcatggaataatgctggtgattacttaggtcgtgttggtcttgtatgggataacaagattaactacaagaatgctggtggtgatattgttgctaaatatgcttataagaagagtggtagtgatggaggtacatactcctacattggtatttacggttggatggataacccacaaattgaatactatgttgttgatgactggttacataacagaggtgcaccaggaggttcatggatgggtcaacaaaagggtactattaatgttgatggtggtacatacaaggtttggtctggacaacgtactggagcttccaaatggggtcaatctactttcacacaaattttctccgttcgtacttcacaacgtcaatgtggtcaaattaacatttctgaacacttcagacaatgggaaaaattgggtcttagaattggtcaagtcatggaagcccaaattttagctgaagctggtggtggttctggttatgttgatttcacctacgctaccgttga

SEQ ID NO: 24625 - DNA, 630 bp, Neocallimastix californiae
  Glyco_hydro_11/12
tagagttaccagtaacaaggtaggccaaatcaatggtattggatatgaattatgggcagacagtggcaataacagtgctactttctattctgatggttcattctcatgttctttccaaaacgcaaaggattatttatgtcgtagtggtctttcctttgatagcaccaaaactcatcaacaacttggacatatgtatgctgacttcaaacttgttaaacaaggtatttctaatgtagattattcttatgttggtatttatggatggacaagaagtccacttgttgaattctatgttgtagataactggcttagtcaatggcgtccaggagattgggtaggaaacaaaaagtatggcgattacaccattgatggtgctaaatatactgtttatgaaaatagtcgttacggtccatccattgatggtgatactaatttcaagcagttcttcagtattcgtcaacaagctcgtgattgtggtacaattgatattactgctcacttcgaacaatgggaaaaactcggtatgaaaatgggcaaaatgcatgaagcaaaggttttaggagaagctggtagtactggttcaggtactagtggtactgcagatttcccatatgcaaaggtatacattgg

SEQ ID NO: 24626 - DNA, 630 bp, Neocallimastix californiae
  Glyco_hydro_11/12
agaaacttcaaataaagtcggtactattggtgatataggttatgaattatggtcagatagtggtgataacagtgctactttctattctgatggttcattctcttgttcattcaagaatgctaaagattatttatgtcgttcaggtctttccttcgacagtactaagactcacaaagaaattggtcacatttatgctgactttaagttagttaaacaagatattaaggatgttgattattcatacattggtatttatggttggactcgtgaaccacttgttgaatattatgttgttgataactggcttagtcaataccgtccaggtgattgggttggaaataagaaatatggagatttcgaaattgatggtgctgaatatactgtttatgaaaatactcgtactggaccatctattgatggagataatgttactttcaaacaatacttcagtattcgtaaagaagctcgtgactgtggtactattgatattaccgcccactttgaaaagtgggaagaacttggtttaacccttggtaaaatgcatgaagctaaagtattaggagaagctggtagtattcatgatggtactagtggtacagctgatttcccatatgctaaagtttacattaa

SEQ ID NO: 24627 - DNA, 630 bp, Neocallimastix californiae
  Glyco_hydro_11/12
agaaacttcaaataaagtcggtactattggtgatataggttatgaattatggtcagatagtggtgataacagtgctactttctattctgatggttcattctcttgttcattcaagaatgctaaagattatttatgtcgttcaggtctttccttcgacagtactaagactcacaaagaaattggtcacatttatgctgactttaagttagttaaacaagatattaaagatgttgattattcatacattggtatttatggttggactcgtaaaccacttgttgaatactatgttgttgataactggcttagtcaataccgtccaggtgattgggttggaaataagaaatttggagatttcgaaattgatggtgctgaatatactgtttatgaaaacactcgtactggaccatctattgatggagataatgttactttcaaacaatacttcagtattcgtaaagaagctcgtgactgtggtactattgatattaccgctcactttgaaaagtgggaagaacttggtttaacccttggtaaaatgcatgaagctaaagtattaggagaagctggtagtatccatgatggtactagtggtacagctgatttcccatatgctaaagtttacattaa

SEQ ID NO: 24628 - DNA, 630 bp, Neocallimastix californiae
  Glyco_hydro_11/12
agaaactagtaacaaggttggtgctattggtgatataggttatgaattatggtcagatagtggtgataacagtgctactttctattctgatggttcattctcttgttcattcaagaatgctaaagattatttatgtcgttccggtctttccttcgacagtactaagactcacaaagaaattggtcacatatatgctgatttcaagttagttaaacaagatattcaagatgttgattattcatacattggtatttatggttggactcgtgaaccacttgttgaatattatgttgttgataactggcttagtcaataccgtccaggtgattgggttggaaataagaaatatggagatttcgaaattgatggtgctgaatatactgtttatgaaaatactcgtactggaccatctattgatggagataatgttactttcaaacaatacttcagtattcgtaaagaagctcgtgactgtggtactattgatattaccgctcactttaaaaaatgggaagaacttggtttaacccttggtaaaatgcatgaagctaaagtattaggagaagctggtagtattcatgatggtactagtggtacagctgatttcccatatgctaaagtttatattaa

SEQ ID NO: 24629 - DNA, 585 bp, Neocallimastix californiae
  Glyco_hydro_11/12
aattggaagctctggttaccattatgaaatctggtaccaaggtggtaacaattcaatgacctattacgataatggtactttcaaggccagctggggtggaacaaatgatttccttgctcgtgttggtcttaagtataatgaagataagactcaccaacaacttggtcaaatcgatgcttactttaagtggactaaatctggtagtgctggtggttataactatattggtatctatggttggactgtcgatccattagtagaatactatattgtagatgactggtacaataaaccaggttcttaccttggacaaaagaagggtgaattcactgttgatggtgatacttacgaaattttccaaaatactcgtgttaaccaaccatctattaagggtacttcaaccttcccacaattcttcagtgttcgtcgtagtgctcgttcttgtggtcatattgatattagtgctcacttcaagaagtgggaatccctcggtatgaaattaggtaagatgtacgaagccaaggttctcgttgaagctggtggtggttctggttcatttgatgttacctacttcaagatgactga

SEQ ID NO: 24630 - DNA, 573 bp, Neocallimastix californiae
  Glyco_hydro_11/12
tcaagaaacaagtaataaagttggtcaaattggagatgtaggttatgaattatggtctgatagtggttacaatagtgctactttctattctgatggttcattctcatgttcattcaataatgccaaggattacttatgtcgttcaggtctttcatttgatagtactaagactcatgatcaaattggtcatatgtatgctgatttcaaacttgttaaacaaaacattagaaatgttgattattcctatgttggtgtttacggttggactagaaatccacttgttgaatattatattgtagataactggcttagtcaatatcgtccaggagattgggttggtaataagaaacatggtgatttcactattgatggtgctcaatatactgtttatgaaaatactcgttatggtccatctattgatggtgatactcaatttaaacaatatttcagtattcgtcaacaagcacgtgattgtggtaccattgatattacagctcatttccaacaatgggaaaaacttggtatgaaacttggtaaaatgcatgaagctaaagtattaggagaagcaggtag

SEQ ID NO: 24631 - DNA, 630 bp, Neocallimastix californiae
  Glyco_hydro_11/12
aaagattactaataataatgttggtcaaattggagatgtaggttatgaattatggtctgatagtggttataatagtgctactttctattctgatggttcattctcatgttcattcagtaatgctaaagattacttatgtcgttcaggtctttcattcgatagtactcaaactcatgatcaaattggtcatatgtatgctgacttcaaacttgttaaacaaaatattagaaatgttgattattcttatattggtgtttacggttggagtagagatccacttgttgaatattacgttgtagataattggcttagtcaatatcgtccaggagattgggttggtaataagaaacatggtgatttcactattgatggtgctaaatacactgtttatgaaaatactcgttatggtccatctattgatggtgatactcaatttaaacaatatttcagtattcgtcaacaagcacgtgattgtggtaccattgatattacagctcatttccaacaatgggaaaaacttggtatgaaacttggtaaaatgcatgaagctaaagttttaggagaagcaggtagtaatggatcaggtactagtggtacagccgatttcccatatgctaaagtctatattgg

SEQ ID NO: 24632 - DNA, 597 bp, Neocallimastix californiae
  Glyco_hydro_11/12
attaggaaaaattggttccgttgattatgaagtatgggctgatggtggtaacaacagtgctgttttctatagtgatggttctttctcatgttccttctcaaatactaaagattatttatgtcgtactggtgtttctttctcacaagctaaatatccatctgaaattggtcatattaaggcagaatataaagttgtaaaacaaaatgctcaaaatgtaggttattcttacgttggtgtttacggatggactttaaattctggtatttcaggtgtatttgaattttatattgttgataactggctttctccaggaagaccaggtgattgggttggtaatgaaaagaagggtgatttcactattgatggtggtaaatacactgtctacaaaaatgttaatggtaatcttacacaatacttcagtcttcgtacaagtccacgtacttgtggtactattgatgttactgctcactttgaacaatgggaaaaaattggtttaaagatgggtaagattactgaagttaaagttttaggtgaagccggtaatgttggtggtggttgtagtggtactgttgatttcccatatgctaagatttatat

SEQ ID NO: 24633 - DNA, 147 bp, Neocallimastix californiae; identical to SEQ ID NO: 20070
  Glyco_hydro_11/12

SEQ ID NO: 24634 - DNA, 585 bp, Anaeromyces robustus; identical to SEQ ID NO: 24629
  Glyco_hydro_11/12

SEQ ID NO: 24635 - DNA, 630 bp, Anaeromyces robustus
  Glyco_hydro_11/12
aaaagttactagtaataaagttggtagtattggaggtataggttatgaattatgggctgatagtggtagtaacagtgctactttctattctgatggttccttctcttgttctttcagtcgtgccaaggattacttatgtcgttctggtctttcctttgatagtactaaaactcatcaacaaattggtcacatttacgctgacttcaaacttgtaaaacaaaatattcaatctgtagattattcttatgttggtatttatggttggactagaaatccacttgttgaattctatgttgtcgataattggcttagtcaataccgtccaggtgattgggtaggtaataagaaacatggtgatttcactattgatggtgctaaatatactgtatatgaaaatactcgttatggtccatctattgatggtgatactcaatttaaacaattctttagtattcgtcaacaagctcgtgattgtggtactattgatattactgctcactttgaacaatgggaaaaacttggtatgaaattaggtaaaatgcatgaagctaaagttttaggtgaagctggtagtaatggtggtggtacaagtggtactgctgatttcccatatgctaaggtttacattgg

SEQ ID NO: 24636 - DNA, 597 bp, Anaeromyces robustus; identical to SEQ ID NO: 24632
  Glyco_hydro_11/12

SEQ ID NO: 24637 - DNA, 630 bp, Anaeromyces robustus
  Glyco_hydro_11/12
tactgttaccagtaacaaggttggtaagattggtgacattggttatgaattatgggctgatagtggtaataatagtgctactttctatgctgatggttcattctcttgttccttcagacaagctaaggattacttatgtcgttctggtctctccttcgacagtactcaaactcaccaacaaattggtcacatgtacgctgacttcaaacttgttaaacaaaacattcaatctgtagattactcatacgttggtatttacggttggactagaaacccacttgttgaattctacgttgttgataactggctcagtcaatggcgtccaggagattgggttggtaacaaaaagcatggtgatttcactattgatggtgctaaatatactgtttatgaaaacactcgttacggtccatctattgatggtgacactaacttcaagcaatacttcagtattcgtcaacaaccacgtgactgtggtacaattgatattactgctcacttccaacaatgggaaaaacttggtatgaccatgggtaaaatgcatgaagctaaagttttaggtgaagccggtagtactggtggtggtacaagtggtactgctgatttcccatacgctaaggtttacattaa

SEQ ID NO: 24638 - DNA, 630 bp, Anaeromyces robustus
  Glyco_hydro_11/12
aacttgtaacagtaacagggttggtagtattggtggtgttggttatgaattatggtctgacagtggtagcaacagtgctactttctattctgatggttctttttcttgttctttcagaagtgctaaagattatttatgtcgttctggtctttctttcgacagtactaaaactcaccaacaaatcggtcatatatacgctgatttcaaacttgttaaacaaaatattcaaaatgttgattactcttatgtaggtatttacggttggactagaaacccacttgttgaattctacgttgttgataattggcttagtcaatatcgtccaggtgattgggttggtaataaaaaacatggtgatttcactattgatggtgctaaatatactgtttatgaaaatactcgttatggtccatctattgatggtaatacaaacttcaaacaatactttagtattcgtcaacaagctcgtgattgtggtactattgatattactgcccactttgaacaatgggaaaaacttggtatgactatgggtaaaatgcatgaagctaaagttttaggtgaagctggtagtaatggtggtggtacaagtggtactgctgatttcccatatgctaaggtttacattgg

SEQ ID NO: 24639 - DNA, 630 bp, Anaeromyces robustus
  Glyco_hydro_11/12
aacttgtaacagtaataaagttggtagtattggtagtgttggttatgaattatggtctgacagtggtaataacagtgctactttctattctgatggttctttctcttgttctttcagaagtgctaaggattatttatgtcgttctggtctttctttcgacagtactaaaactcaccaacaaatcggtcatatatacgctgatttcaaacttgttaaacaaaatattcaaaatgttgattactcttatgtaggtatttacggttggactagaaacccacttgttgaattctacgttgttgataattggcttagtcaatatcgtccaggtgattgggttggtaataaaaaacatggtgaatttactattgatggtgctaaatatactgtttatgaaaatactcgttatggtccatctattgatggtgatacaagtttcaaacaatactttagtattcgtcaacaagctcgtgattgtggtactattgatattactgcccactttgaacaatgggaaaaacttggtatgactatgggtaaaatgcatgaagctaaagttttaggtgaagctggtagtaatggtggtggtacaagtggtactgctgatttcccatatgctaaggtttatattgg

SEQ ID NO: 24640 - DNA, 627 bp, Anaeromyces robustus
  Glyco_hydro_11/12
agaaacaggtaataaagtaggtagtattggaggagtaggttatgaattatggtttgaaggtggtaataatagtgctactttctattctgatggttcattttcttgttctttccaaggttctaaggattatttatgtcgtacaggtctttcatttaatagtgataaaacttaccaacaaatcggtcatatgtttgccgattttaaacttgttaaacaaggtatttcaaatgtagattattcttatgttggtatttatggttggacaagaaatccacttgttgaattttatattgtagataattggctcagtccaagtcgtccaggggattgggttggtaatagaaaacatggtgatttcactattgatggtgctaaatatactgtttatgaaaatactcgtaatggtccttctattgatggtaatactaatttcaaacaatatttcagtattcgtcaacaagctcgtgattgtggtactattgatattaatgctcactttgaacaatgggaaaaattaggtatgcaaatgggtaaaatgcatgaagctaaaattttaggtgaagctggtagtaatggtggtggtacatctggtactgctgatttcccatatgctaaggtatatattgg

SEQ ID NO: 24641 - DNA, 594 bp, Anaeromyces robustus
  Glyco_hydro_11/12
tgtaggttatgaattatgggcagatagtggtaataatagtgctactttctattctgatggttcattctcttgtactttccagagtgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggagctggtactagtggtactgccgatttcccatatgctaaggtttacattgg

SEQ ID NO: 24642 - DNA, 627 bp, Anaeromyces robustus
  Glyco_hydro_11/12
agaaacaagtaataaagtaggtaatattggtggtgtaggttatgaattatgggcagatagtggtaataatagtgctactttctattctgatggttcattctcttgtactttccaaaatgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggagctggtactagtggtactgccgatttcccatatgctaaggtttacattgg

SEQ ID NO: 24643 - DNA, 627 bp, Anaeromyces robustus
  Glyco_hydro_11/12
agaaacaagtaataaagtaggtaatattggtggtgtaggttatgaattatgggcagatagtggtaataatagtgctactttctattctgatggttcattctcttgtactttccaaaatgcaaaagattatttatgtcgttctggtctttccttcgatagtacacaaactcatgaccaaattggtcatatttatgccgatttcaaacttgttaagcaaaatattaataatgtagattattcttatgttggtatttatggttggactagaaatccacttgttgaattttatgttgtagataactggctcagtcaataccgtccaggtgactgggtaggtaataaaaaacatggtgatttcactattgatggagctcaatataccgtttatgaaaatactcgttatggaccatctattgatggtgatactcaattcaagcaatatttcagtattcgtcaacaagcacgtgattgtggtacaattgatattacagctcacttccaacaatgggaaaaacttggtatgacacttggtaagatgcatgaagctaaagtattaggagaagctggtagtaatggatctggtactagtggtactgccgatttcccatatgctaaagtttacattgg

SEQ ID NO: 24644 - DNA, 177 bp, Piromyces finnis
  Glyco_hydro_11/12
tattcgtaaggaagctcgtgactgtggtactattgatattacagctcacttccaacaatgggaaaagcttggtatgaagcttggtaagatgcatgaagctaaggttttaggagaagctggtagtaatggatcaggtactactggtacagctgatttcccatacgccaaggtattcat

SEQ ID NO: 24645 - DNA, 627 bp, Piromyces finnis
  Glyco_hydro_11/12
tgaatatagtaataaggtcggttccattagtggtattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgattgtggtactattgatattacagctcacttccaacaatgggctaaacttggtatgaatcttggtaagatgcatgaagctaaggttttaggtgaagctggtagtactggttctggtactagtggtactgctgatttcccatatgctaaggtttacattgg

SEQ ID NO: 24646 - DNA, 627 bp, Piromyces finnis
  Glyco_hydro_11/12
tgaacgtagtaacaaggttggttccattggtggtattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgactgtggtactattgatattactgctcacttccaacaatgggaaaagcttggtatgaagcttggtaagatgcatgaagctaaggttttaggtgaagctggtagtactggttctggtactagtggtactgctgatttcccatatgctaaggtttacattgg

SEQ ID NO: 24647 - DNA, 630 bp, Piromyces finnis
  Glyco_hydro_11/12
taaagttacctcaaataaggtaggttcaattggaggaattggttatgaattatgggctgatagtggtaacaacagtgctactttctattctgatggttctttctcttgttccttccaaaatgctaaggattacctttgtcgttccggtctttccttcgatagtaccaagactcacgaccaaattggtcacatgtacgctgacttcaagcttgtcaaacaaaacattcaaaatgttgattactcctatgtaggtatttacggttggactagaagtccacttgttgaattctacgttgttgataactggctcagtcaatggcgtccaggagattgggttggtaacaagaaacatggtgattttgttattgatggagctacttacactgtttatgaaaacactcgttacggtccatctattgatggtgatactcaattcaaacaatacttcagtattcgtcaacaagctcgtgactgtggtactattgatattactgctcacttccaacaatgggaaaagcttggtatgaagcttggtaagatgcatgaagctaaggttttaggtgaagctggtagtactggttctggtactagtggtactgctgatttcccatatgctaaggtttacattgg

SEQ ID NO: 24648 - DNA, 513 bp, Piromyces finnis
  Glyco_hydro_11/12
aaatgctaaggattatttatgtcgtactggtctttcattcgatagtactaagacccacgatcaacttggtcacatgtacgctgatttcaagcttgttaagcaaaacattagaaatgttgattactcttacgttggtatttacggttggaccagaaacccacttgttgaattctacgttgttgataactggctcagtcaatggcgtccaggtgattgggttggtaacaagaagcatggtgatttcactattgatggtgctcaatacactgtttacgaaaacactcgttacggtccatctattgatggtgatactcaattcaaacaatacttcagtattcgtcaacaagctcgtgattgtggtactattgatattacagctcacttccaacaatgggaaaagcttggtatgaagcttggtaagatgcatgaagctaaggttttaggtgaagctggtagtactggttctggtactagtggtactgctgatttcccatatgctaaggtttacattgg

SEQ ID NO: 24649 - DNA, 207 bp, Neocallimastix californiae
  Glyco_hydro_114
aatatggttaccttctcaaggtatgacttggaattatgtattaggaaatgatatagatgtaaattcagaaacagcaaatgttgttgatattgatatcagaaagactgaagcaatcaataaacttcataaaaaaggaataaaagtaatttgctatttttcggttggtactcttgaaagttttcgtgatgattatccacaatttcttgc

SEQ ID NO: 24650 - DNA, 204 bp, Neocallimastix californiae
  Glyco_hydro_114
atggttaccttctcaagatatgacatggaattatgtattaggaaatgatattgatgtaaattcagaaaaggccaatgttgttgatattgatattagaaagagtgaaacaaaaataaaaaatcttcaaaaaaaaggaataaaggtaatttgttatttctcggttggtacacttgaaagttttcgtgatgattatccacaatttat

SEQ ID NO: 24651 - DNA, 213 bp, Piromyces finnis
  Glyco_hydro_114
tgccatttggattccaccccaaggaattaaatggaattatgtattgggtagcgacattaatgaaaataccgaaacagccaatgttgttgatatagatattagaaaagatcaatcaaaaattgataatcttcacaaaaggggtataaaggttatatgttatttttcaggtggtacattggaatattttcgtgaggattataaagattttttaaa

SEQ ID NO: 24652 - DNA, 294 bp, Neocallimastix californiae
  Glyco_hydro_13_b
tagatacattcgtccaggttacactatcattggttgttacaacaactctgttgcagcttatgatagtgtcggtaagaagcttgtgattgttgccactaatacagctaatactactaagacggttgatttcaacctctctgaattcactagtgttggttacaacattagagtcattagaaccagtggttctgttagtaatggtgaaaagtgggctgaacttaagccactcataccctacggtaaaggtttcaatgctgatttaaagggtaattctattactacttttattgttga

SEQ ID NO: 24653 - DNA, 294 bp, Anaeromyces robustus
  Glyco_hydro_13_b
tagatatattcgtccaggttatactattattggtagttataataattcagttgctgcttacgataatgaaggtaaaaaattagttattgtagcaaccaatacagctggttctaataaaattgttgattttgatctttctacctttactagtgttggttataatgttagagttattagaactagtggttcaatgagtaatggtgaacattgggctgaacttacacctcttattccatatggtaaaggtttcaatgctgaattaaaagctaattctattactacttttattgttga

SEQ ID NO: 24654 - DNA, 468 bp, Neocallimastix californiae
  Glyco_hydro_16
ttgtccaggttctggtaatggtggtcgtatgagaactaatgttcgttacaagtctggtaagttcgaagttcgtgctaagatgccaattgctagtggtttagttccagctatttactttgcctctactccagataacactaacggtaaccaagatgaatttgatttcgaattaattggaagcaaccgtatgcaaactaatttattcatttatggtaatggtggtcgtgaacaagtttggaacccaccaaccgatttatctaaagatttccacctttacacctttgaatggaattcaaattccattgttttaaaggttgataaccaagttattcgtaccttcaataatccaatgccacaacaaccatgttactttattttaactaattggatgtgcgttggttgcgatggttggactggtccagctgattggtctagacaaccttatgacttcattgttgattacgttaa

SEQ ID NO: 24655 - DNA, 540 bp, Neocallimastix californiae
  Glyco_hydro_16
gtatggtactagtactgatcatacacacgtttatttaaaggaaaatacagttgttctttttgctaaaagaattaactgggatgaaggaaaaagtacttctaacccacatccagcaattcattatcattctggtgcaatccactcaaagcaaactttcacggtaaatgatcaatatccaaactatgaaattaaaggtgaattcatggttccaactaattcaggtacatggccagcgttctggttaaatggtgcaaaaacatggccaccagaaattgatattgttgaatttaagggtagtaacgttaattggtttaatactttccgtacttcaagtgatgtttcaacttacaagaccactattaataataaaggtgcctggcatgaataccgtatttggataactaaagtttcaaatactaacatagatattcacttttacattgatggtgtttggaaagcaaagcatactgctaatcacgttggaaagccattccatttaattatgaatttacaaatggaaggtagttctggtggtaatgg

SEQ ID NO: 24656 - DNA, 519 bp, Neocallimastix californiae
  Glyco_hydro_16
cggtgctccagatgaccacaaccatgtttatttagaaaataattcagttgttcttcaggcctgtagaattaattgggatgaaggtaaaagtactgctaatccacacccagtaattcattatcactctggtgcaattcactcaattcaaacttttactattaatgaccaatatccaaattacgaaattagaggtgaattcatagctccaactactggaggtacatggccagccttttggttgaatggtgcatggacttggccaccagaaattgatattcttgaattcaagggtaccactaccaattggtttaatactttccgtacttcaagtgatgtctctacatacaaagaagctattagcaatccaaatacttggcacgaatatcgtctttggattagcaaagtttcagatgttaatatggatattcatttctatattgatggaaaatggagagctaaacacactgcaaatcatgttggaaaaccattccatttaattatgaatttacaaatggaagg

SEQ ID NO: 24657 - DNA, 447 bp, Neocallimastix californiae
  Glyco_hydro_16
tgaatataaattaactgatgaggaaaagaaatcatgcactaataataatgagaattcatgtggatggactcaaagtgttactagtggtcgtattagaacttataagagtggtcatgcttggaagtatggtaaagttagagttaaggctaaattaccagcaggtccatatctttggccagctatatggatgttaccacaagacgatgtttatggtacatgggcagcttcaggagaaattgatatcatggaagctagaggacaagttccggatgctgtaggtcatgccattcattatggaggtcaatggccaaataatgttttttcatctgaaactgcttctgttaaagatgttatcaatgatttccatgtttatggattagattgggaagagaatttcctcatttttagtgttgatgaagtcgaatactttactgttgatcttcgtaa

SEQ ID NO: 24658 - DNA, 540 bp, Neocallimastix californiae
  Glyco_hydro_16
gtatggtgcttctgatgatcacaatcatgtatatttagaaaacaacactgttgttcttaaagcttctagaattaattgggatgaaggaaaaagtacagctaatccacacccagtaattcattatcactctggtgctattcactcaaaacaaacttttacaattaatgatcaatatccaaattatgaaattagaggggaatttcaagccccaactaatggaggtacatggcctgctttctggttaaatggtgcttggacttggccaccagaaattgatattcttgaattcaaaggtactactaccaactggtttaatactttccgtacttcaagtgatgtttctacatataaagaagctataagtaatccaagtggttggcatgaatatcgtctttggattaccaaggtttcaaatactgatatggatattcatttctatattgataataaatggaaggctaaacacactgcaaaccatgttggaaaaccattccatttaattatgaatttacaaatggaaggtagtgctagtggtagtgc

SEQ ID NO: 24659 - DNA, 411 bp, Neocallimastix californiae
  Glyco_hydro_16
cgattctgtaagtcaatcttgtcctggttctggtaatggtggtcgtatgagaaccaatgttcgttacaaatctggtaaatttgaagttcgtgctaagatgcctattgctagtggtttagtaccagctatttattttgcttccacccctgataacaccaacggtgatcaagatgaatttgatttcgaattaattggtagtaaccgtatgcaaacaaacttattcattcatggtaatggtggtcgtgaacaaatttggaacccaccaaccgatttatcgaaggacttccacctctacacctttgaatggagctctaatgccattgtcttgaaggtggataatgaagttattcgtaccttcaataatccaatgccagaccaaccaagttacttcattttaacgaattggatgtg

SEQ ID NO: 24660 - DNA, 465 bp, Anaeromyces robustus
  Glyco_hydro_16
aggatcaggtaatggtggtcgtatgagaactaatgttcgttacaagtctggtaagtttgaagttcgtgctaagatgccaattgctagtggtttagtaccagctatttactttgcttcaactccagataatactaatggtagtcaagatgaatgggatttcgaattaattggtagtaaccgtatgcaaactaatttattcattaatggtcaaggtggtcgtgaagaagtttggaatccaccttatgatttatctagagatttccatacttatacttttgaatggacttctaattctatcgttttaaaggttgataatcaagtcgttcgtaccttcaataatccaatgccaactcaaccaagttacttcattttaactaattggatgtgtgttggttgtgatggatggactggtccagctgattggtctagacaaccatacgatttcattgttgactatgttaaaat

SEQ ID NO: 24661 - DNA, 471 bp, Anaeromyces robustus
  Glyco_hydro_16
aaagaatggtcaacttcatattaaagctgttccaaaaggtcaatataaattaactgatcaagaaatgaaaacatgtactaataataatgaagattcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtatcaaatgctattggaaatgctattcattttggtggtcaatggccaaataatgattttgtagataaaacatacaacctttctaatattattaatgatttccatgtctatggattagattgggaagaagattatttattattctcagtagatgaagaagtcactttctt

SEQ ID NO: 24662 - DNA, 492 bp, Anaeromyces robustus
  Glyco_hydro_16
aaagaatggtcaacttcatattaaagctgttccaaaaggtcaatataaattaactgatcaagaaatgaaaacatgtactaataataatgaaaactcatgtggttggactcaaagtactactagtggtcgtattagaacatataaaagtggtaatgcttggaaatatggtaaaattagagtaaaagctaaattaccagcaggtccatatctttggccagcaatttggatgttaccacaagatgatgtatatggtacatgggcagcttctggtgaaattgatattatggaagctagaggtcaagtacctgatgctgtaggtcatgcaatacattttggtggtcaatggccagataatgactttatgtctgaaacagcttctattaaaaatgttattaatgatttccatgtttatggtttagattgggaagaaaacttccttatctttactgttgacgagaaaccatattataccgttgatcttcgtaagagttt

SEQ ID NO: 24663 - DNA, 228 bp, Piromyces finnis
  Glyco_hydro_16
aggttctggtaacggtggtcgtatgagaaccaacgttcgttacaagtctggtaaattcgaagttcgtgctaagatgccaattgctagtggtttagttccagctatttacttcgcttctactccagataacaccaacggtagtcaagatgaattcgatttcgaattaattggtagcaaccgtatgcaaactaacttattcatttacggtaatggtggtcgtgaacaagt

SEQ ID NO: 24664 - DNA, 1062 bp, Neocallimastix californiae
  Glyco_hydro_18
aattgttggttatttcagtgaatggaaaaatgcgaactatcctattagtcgtgtagatttatcaaaaattacacatcttaattatgcatttggtgtaattgatccaaattcatatgctgtaactggatatgatagtaatattttaagtcaagttgtcactgctgcacacagtcaaggagtaaaagttcttatgtctgtaggtggatggtatggaagtcgttactttactcagatgacttcttcaaaaagtaacatagaaaagtttgttgacagttgtcaaagtcttatcagtaattatggtgttgatggtattgatattgattgggaatacccaggaagagaaggcgcatgtaatagcccagatatggcaaatgatgcagaaaattatttaactcttttaaagatcttacgtgaaaagatcggaaatgctctaatttctgctgctgtcagtgttataccgtttgaaaagaatggtcaaccaatttcagacctttctgaatatgaaaaatactttgattatattaatgttatggcatatgattttgctggtagttggacacctactgtttctcatcactctgctttatatgacccagaagctggtgaaaagttgtctctatcttcaggtgtaaagaattggttaagtcgtggttttccagctaataaaattgttgttggtgtaccagcttatggaaagagttggattgctgcatcttcaaatagaaatggtttatatcaatctgttgctaatggaaatccaaaaggtgatcatgaagatagtaattcaccatggactaactattgtggagttcttgaaagtgcttacagtggaaattggaaatataaaaatattcgtagtgaaatcttaaaatctgattacacaactgcttcaggtagttgggttcgttcatgggatgataaagttaagggtccatatttatttaataaggaaactaaacaaatcattacatacgatgatccagaaactattcaatataaagctaaatatattattgataacaactttggtggtatgatgatttgggaattagaaaatgatac

SEQ ID NO: 24665 - DNA, 1053 bp, Neocallimastix californiae
  Glyco_hydro_18
aattattatttattatccagaatggaagtactataactatccaccaaggaatcttccatttaacaaacttactcatataaattatgcctttggtgaaattgatccaactaattattcattaaaatatgactctactaagtttttagaattgattgaaactgctcgtagtagaaataaaaatgttaaaattataatgtctgttggtggttggactggaagtagatatttctcagttatgtcatcaaatcctgcaaacagatccaaatttataagtagtgttaaatcgatgttagaaagtactggtgctgatggtattgatattgattgggaacacccaggagtacctggtgctttttatgatagttttgatgcccaaaatgatacctataatttattaaaattgatgcaagaattacgtgaagctattggtaaatcaaaaattatttcaactgctgtaacgttcaatttatttgttgtgaactatcaaccattacaagacttatctaaatttgccgaaatattagattatattaatcttatgtgttatgattttaatggaagttggtcaaatattatatcacatcaatcttcactatacccaactggaggaaatgatagtggattttctgtagaaggtgctgttaaaaattggatgaatgctaaatttccatctaacaaaattgttattggtattccttcttatggtatatcatggatttcaagtacatctaataataatggtttacttcaaataccatccaattctttcccaaaaggtgatgaagaagatgtcatgaatgcagaatcaggaagatacagtggtatttggaaatataaaaatcttcgtaaacagattttacaatctagtttcaaagatgcaactggtgattggattcgtgtatgggattcaaaatctagtgttccttacttatataataaagtttcaagacaatttattacttatgatgatccagaatcagtgaaaattaaagctgattatgtaatcgaaagaaatttaggaggtatgatgatgtgggaaattgaagaagatac

SEQ ID NO: 24666 - DNA, 1053 bp, Neocallimastix californiae
  Glyco_hydro_18
aatcattgtttactatccagaatggaagtattacgatttcccaccaaagaatattccatttaataagcttactcatataaattatgcgtttgccgaaattgattcaaatgattattcattagattatgattcaagtagatttttagaattagttgaaactgctcatgaaaaaaataaaaatattaaagttttaatgtccattggtggctggacaggtagtaagtattactcaaaaatggcatcttcttcttctcgacgatcaaaatttgttaagagtgtgaaaagaatgttggaagcaagtgatgcagatggtattgatattgattgggaatatccaggtacaagtggtgcttatgatgataattttgatgctgaaaatgatacaaataatttattgaaattgttaaaggaattacgtgaagctattggttcttcaaaaattatttctgctgctgttccatttaatacatttgaagtggactctcgtccattaaaagatatgtctgaatttgctgaattgtttgactatgttaatattatggcttacgattttgctggaagttggtcaaccgttacatctcatcaatcttcactgtattcaatttcagaagatgataatggctattctttatctggtgcggtaagtaactggataaatgctaatttcccttcaagtaaaattgttgttggtattcctgcttatggaagatcatggatttctggtagttcctcaaacaacggttatcttcaaagaccatctaattctcatccaaagggagatgaagaggattacattgattctagttcaaaaagatatagctctacctggaaatataaaaatattcgtaaagcaattgtaaaatctacttataaaaattcgtcaggggattggattcgtatatgggattcaaagtcgagtgttccatttctttttaatacgaatactagacaatttattacctatgatgatccggaatcagtatctcttaaagccgattacgttataaataaaaatttaggtggaatgatgatgtgggaaattgaagaagatac

SEQ ID NO: 24667 - DNA, 1053 bp, Neocallimastix californiae
  Glyco_hydro_18
aataattgtgtattatccagaatggaagtattataattttccaccaaagaatattccatttaataaacttactcatataaattatgcatttgctgaaattaattcaagtgattattccttagaatatgattcaagtaaatttttagaattagttgaaactgcacatgaatataataaaaatattaaggtattaatgtcaattggtggttggacaggtagtagatattattcaaaaatggcatcctcttcttctaatagatcaaaatttgttaaaagtgtaaaaagaatgctagaagctagtggtgctgatggtatagatattgattgggaatatccaggaacaagtggtgcttatgatgataacttcgatgctaaaaatgatacaaataatttattaaaattattgcaagaattacgtgcctcaattggttattcaaaaattatttctgctgctgtaccatacaacacatttgaagttaattataaaccattagaagatatgtctgaatttgctgaattatttgactatattaatattatggcttatgatttcgctggtagttggtcatctgttacatcacatcattcttcactttattcaactgttgaagatgacagtggatattcattagcaggtgctgttaaaaattggatgaacgcaagattcccagctactaaaattgttgttggtattcctgcttatggtagatcgtggatttcaggtagttcttcaaataatggttatcttcaaagaccatctaactctcatccaaagggtgatgaagaagattacattgatccaaattcaaaaagatacagctctacctggaaatataaaaatattcgtaaagcaatcatgaaatcaacttataaagattcaactggaaattggattcgtgtatgggattcaaagtctagtgttccatttctgttcaacaagaacaccagacaatttattacgtatgatgatccagaatcagtatcaattaaagctgattatgttataaaatataacttaggtggaatgatgatgtgggaaatcgaagaggatac

SEQ ID NO: 24668 - DNA, 1068 bp, Anaeromyces robustus; identical to SEQ ID NO: 24525
  Glyco_hydro_18

SEQ ID NO: 24669 - DNA, 1053 bp, Anaeromyces robustus
  Glyco_hydro_18
aattattgtttattacccagaatggaaatattatgatttcccaccaaaagatatcccattttcaaagttaactcatattaattatgcttttgctgaaattaatcctgatgatttctcattagaatatgattcaaataaatttttagaattaatagatactgctcataaaaaaaataaaagtattaaagttttaatgtcaataggtggttggactggtagtagatatttctcaaaaatggcttcatcttcttcaaatcgtacaaaatttgttaaaagtgtaaaaagaatgattgatgctagtaatgctgatggtattgatattgattgggaatatccaggttcaagtggtgcttatgatgacaattatgattcagaaaatgataccaataatttattaaaattattaaaagaattacgtgaaactataggaacttcaaaacttattactgctgctgtaccatttaacacttttgaagttgatcataaacctttaagtgatatgacagaatttgctaaactttttgattttattaatattatggcttatgatttctctggaagttggtcttccgttactgcacatcaatccgctctttattcaactcatgaagatgatagtggttattccctttcaggtgcagttaaaaattggatgaatgctaatttccctgctaaaaaaattgttgtaggtattccagcttatggtagatcatggattgctggtagttctaccaatcatggttatcttcaaagaccttctaattcttatccaaaaggtgatgaagaagattatattgattcagattctaaaagatattcttcaacttggaaatataaaaatatacgtaaacaagttttaaaatcagattattctaaatctactggtagttgggaacgtatatgggattctaaatcaagtgcaccatttttatttaataaagatactaaacaatttattacttatgatgatccaaaatcagtaggtcttaaagctgattatgttattgaaaataatttaggtggtatgatgatgtgggaaattgaagaagattc

SEQ ID NO: 24670 - DNA, 378 bp, Piromyces finnis
  Glyco_hydro_18
gttttattataggagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatgatgatccagagagtattggatacaaagctaaatttgttcttgaaaatggctttgctggtatgatggtttgggaattagaaaatgatac

SEQ ID NO: 24671 - DNA, 381 bp, Piromyces finnis
  Glyco_hydro_18
tttgttttattataggagctggattgtttcttcaacttcaagaaacggtttatatcaatctattgttaatggtaatccaaggggtgatcatgaagatagtagtgattcatggactaattattgtggtattgttgaaagcggattcagtggtagttggaaatacaaaaatattcgcaatgaaatattattatcaagttacaacacttcatcaggaagttggattcgtacatgggatgataatgttaaatgcccatatttatttaataaggatactaaacaaatcatttcatatgatgatccagagagtattggatacaaagctaaatttgttcttgaaaatggctttgctggtatgatggtttgggaattagaaaatgatac

SEQ ID NO: 24672 - DNA, 1053 bp, Piromyces finnis; identical to SEQ ID NO: 24527
  Glyco_hydro_18

SEQ ID NO: 24673 - DNA, 345 bp, Neocallimastix californiae; identical to SEQ ID NO: 14966
  Glyco_hydro_2

SEQ ID NO: 24674 - DNA, 345 bp, Neocallimastix californiae; identical to SEQ ID NO: 14969
  Glyco_hydro_2

SEQ ID NO: 24675 - DNA, 345 bp, Piromyces finnis; identical to SEQ ID NO: 14971
  Glyco_hydro_2

SEQ ID NO: 24676 - DNA, 888 bp, Neocallimastix californiae
  Glyco_hydro_2_C
taccatcaatggtaagagacttcttatcaagggtgtcaatcgtcatgattcagatccattcaatggaagggctgttccacaacaaacattacgtgaagatattgctctcatgaaaaagcataatattaatgccataagaacttctcattacagtaatgactcctacctctactggctctgcaataaatatggtatgtatgtcatgggtgaaaccaatttggaatctcatgctttacagaataaccatgacgcaaaagccaaattctatgaacttggaatggacagaacagaaactgcctataagcgtttgaaaaataatccatcaatctttgcatggtctattggaaatgaaatggcctacaccaataatccaaatgatgcaggaggtcttttccgtgatatgatctggtatttcaaaaagaacgattccagtcgtccagtacatagtgaaggacaaggtagtagtatgggtgttgatatgtctagtaatatgtatcctggttctgatggactcggtgttcatgctggtcgaggaaagatgccttacatcatgtgtgaatatgatattgcttcaggtaatgctataggtgctttaaaagaatattgggatgtgataagaagtgctgataatatgttagggggttttatttgggattgggttgatcaatccagagcaaaaactctcaacggcggatgggattactactctcaatcttatgccataactaatctttattctgaagaaattaaaggtaaattctatgcttatggtggtgattggggtgattggccaaatgataatagtttctgtgtcaatggtcttatcaatccagatagaactcctcaaccagaacttgccgaagtcaaattccaatatcaaagtttctg

SEQ ID NO: 24677 - DNA, 888 bp, Neocallimastix californiae
  Glyco_hydro_2_C
tactattaatggtaaacgtcttcttcttaaaggtgttaaccgtcacgatactgatccattcaatggtaaagctattccacaagccactatggaaatggatattactcttatgaaaactaacaacattaatgctattagaacttctcactacagtaatgattcttacttatactggctttgtaacaaatatggtatgtatgtcatgggtgaaactaatatggaatctcatgctttaatggataataatgatgctaaagctttattctatgaagttggtcttgacagaactgaaactgcttataaacgtttaaagaatcatccatctattgttgcttggtctattggtaatgaaatggcttatactagtaatccaagtgatgctggaggtcttttccgtgatatgatttggtatttcaagaagaatgataacagtcgtccagttcatagtgaaggtcaaggtggtagtatgggtgttgatatgtctagtaatatgtacccaagttcagatggtattcgtggtaacgctggtaaaggtaaaatgccatacgttatgtgtgaatatgaccacgctatgggtaattctgttggtgctttaaaagaatactgggatggtattagaagtgctgataatatgcttggtggtttcatttgggattgggttgatcaatctagagctactccattaaaaggtggttgggattattattctgaatcctatgctaaaacaaatctttacgctgaagaaattaaaggtaaattctatggttatggtggtgattggggagattggccaaatgataacagtttctgtgttaatggtcttattagtcctgatagaactccacaaccagaacttgctgaagttaaataccaataccaaagtttctg

SEQ ID NO: 24678 - DNA, 894 bp, Piromyces finnis
  Glyco_hydro_2_C
tatcactataaatggtaaacgtcttcttcttaagggtgtaaatcgccacgacactgatccattcaatggaaaagctatacctcaagaaactatgcgtgaagatattactttaatgaaaaagaataatattaatgccattagaacttcccactatagtaatgattcctatttatattggctttgtaataaatatggtatgtatgttatgggtgaaacaaatatggaatcacatgctttaatggataataatgatggaaaagctttattctatgaacttggtcttgacagaacagaaacagcatacaaacgtttaaagaataatccttccattgtagcatggtccattggaaatgaaatggcatacacaggtaatccaagtgatgctggaggtcttttccgtgatatgatatggtactacaagaaaaacgataatactcgtccagttcacagtgaaggacaaggtggtggaatgggtgtcgatatgagtagtaatatgtaccctagctcagacggtattcgcggtaatgcaggaaaaggtaaaatgccatatgttatgtgtgaatatgatcacgctatgggtaactcagttggtgctttaaaagaatattgggatgctattagaagtgcggataatatgttaggtggtttcatttgggattgggttgatcaatcaagagcagttccaatcaaaagcggtggatgggattattactctgaatcctatgccaagacaaatctctattctagtgaaattaaaggaaaattctacggttacggtggtgactggggagatagaccaaatgataacagtttctgtgtaaatggacttatcaatcctgatagaactcctcaacctgaacttgctgaagtcaaattccaataccaaagtttctg

SEQ ID NO: 24679 - DNA, 543 bp, Neocallimastix californiae; identical to SEQ ID NO: 23339
  Glyco_hydro_2_N

SEQ ID NO: 24680 - DNA, 543 bp, Neocallimastix californiae; identical to SEQ ID NO: 23352
  Glyco_hydro_2_N

SEQ ID NO: 24681 - DNA, 537 bp, Piromyces finnis; identical to SEQ ID NO: 23367
  Glyco_hydro_2_N

SEQ ID NO: 24682 - DNA, 297 bp, Neocallimastix californiae
  Glyco_hydro_2/20_Ig-like
tgcttcacagttagataataaacaagtctcagtgtacaacgaaaacaatttccttaatttaaatgattttgatgtttcttggactcttctcaaaaatggtattgctattaaaactggaaatgtaaagaatgctaatgttgctcctttaacaaagggtactttgaaagtaccatttgaaatacctcaagattctctagctggtgatgaattttatcttgatatgtcagtaaaagtaaaaaatggttcagatttacttccagaaggtacagaaatttcttatggacaattccatctcta

SEQ ID NO: 24683 - DNA, 381 bp, Neocallimastix californiae
  Glyco_hydro_2/20_Ig-like
cttccgtgatgttttcttagttagtgctccagatgttcaaattagggattataccgtccgtacagatcttgatagttctttcacaaacgccaaccttgaaatatcaatggatattcgtaatctttcaggtggtgaaaagagtggttggggtgttattgccgaagcttatgatgaagctggtaataatattctcaaaggagcatcaataaaactcgataggcttaatactaataaagacaacacttttgttttgaaaactagtgttaattcaccaaaactctggtcagccgaaataccaaatctttatgctctcgttcttaaacttaccgataatagtggcaacgtacaagaaatactttccactcagttaggtttccgtaa

SEQ ID NO: 24684 - DNA, 381 bp, Neocallimastix californiae
  Glyco_hydro_2/20_Ig-like
tttccgtgatgttttccttgttagtgccccaagtgttcaaattagagattatactgttcgtactgatcttgatagttctttctcaaatgctagtcttgaaatttctatggatattcgtaatctttcaggaggtgctaagagtggatggagtgttacagctgaagcttatgatgaagctggtaaaaacattcttagtggtgctactgttaaacttgataatcttgctaatggtagagatactacttcagttttaaaaactagtgttaaatctccaaaactttggtctgcagaaactccaaacctttacgctcttgttcttaaacttactgatgataagggtactgttcaagaaattctttctgctcaattaggtttccgtaa

SEQ ID NO: 24685 - DNA, 297 bp, Neocallimastix californiae
  Glyco_hydro_2/20_Ig-like
tgcttctcaacttgaaaaacaagaagtttctgtttacaatgaaaacaacttccttaatattaatgaatttgatattacatggaccgtacttaaaaacggtattgctattagcaatggtgttgttcaaaatgctaatgtcggacctcttactaagggaacattaaaggttccatttgaagttccagaaaaaccacttgctggagatgaattcttccttgatatgtctgttaaggtaaagaagggtacaaaaatgcttccagaaggtactgaaattgcctatggacaaattccaattac

SEQ ID NO: 24686 - DNA, 300 bp, Piromyces finnis
  Glyco_hydro_2/20_Ig-like
tgcttcacaactcgataatcaagaagtttctgtatacaatgaaaataacttccttaacattaatcaatttgatgttacatggacacttcttaaaaatggtattgctatagattctggtatcgttagaaatgctaacgtagctcctctttccaagggtactcttaaagtaccatttgtgataccaatggattctcttgctggtgatgaatattatcttgatatgtctgtaaaggtaaagaatggcacagatatgcttccagagggcacagaaattgcttatggacaaattgctcttgcttc

SEQ ID NO: 24687 - DNA, 381 bp, Piromyces finnis
  Glyco_hydro_2/20_Ig-like
attccgtgatgttttccttgtaagtgctcctgctgttcaaataagagattatactgttcgtactgaccttgataattctttctcaactgccaaccttgaaatatccatggaaattcgtaatctttcaggtagttcaaaaaatggctggagtgttattgcagaagcttatgatgaagcaggttacaatatccttagtggagcttctgttaaactcggaggactttctaacggtaaagatagtaatgctgttttaaaaacttctgtaaagtcaccaaaactttggtccgctgaaacaccaaatatttacgctcttgttcttaaacttattgatgaaaatggtagaactcaagaaattctctccactcaattaggtttccgtaa

SEQ ID NO: 24688 - DNA, 906 bp, Neocallimastix californiae
  Glyco_hydro_26
taatccaaaggctattcctgctgctaaaaaactttatgatttcttaaaatcaaattatggtaaaagaattctttctggtcaagtcggtgctgccggtcaagctggtgatgaaggtgaagaatttaaacgtattatgaatgctactggtaaaaagccagcagtttggaatatggatttcatttttgaatctaatgattgtacttggagaccaactaatcctgatattactgaaatggcaattaattggtggaagaaatatcaaggtaaaggaattatgtctgctcaatggcattggaatattgctggtagaactggtaactttgctttctacaaaaaagataccactttcgatcttgaaaaagcagtcaccgaaggtacttgggaatatgaaaaaattattaaagatattgatcgtgtttctggtttaattaagaaattacaagctattaatatgccattaatctggcgtcctcttcatgaaaataatggtgactggttctggtggggtaataatccaaaagcttgtgctaaattatggaaaatcttatatgaacgtatggttaactatcatggattaaataatttaatttggctttggaatggtaataatgatgaatatactccaattgaatacattgatattattggtgttgatatctatgctaatgatcatggaccacaaactacagcatacaatactcactttgatttttatggaggtaaaaagatggttgttttatcagaaaatggacgtattccagatattcaacaatgtgttgaccaaggtgcttggtggggttatttccaaacctggaacaatgaatttattttacaaaatcattatcatactgatgctcaacttaaagaatatttcaatcataaaattgttatgaatatggatgaatt

SEQ ID NO: 24689 - DNA, 690 bp, Neocallimastix californiae
  Glyco_hydro_26
tcctgatattactgaaatggcaattaattggtggaagaaatatcaaggtaaaggaattatgtctgctcaatggcattggaatattgctggtaaaactggtaattttgctttttacaaaaaagataccactttcgatcttgaaaaagcagtcaccgaaggtacttgggaatataaaaaaattattaaagatattgatcgtgtttctggttttattaagaaattacaagctattaatatgccattaatctggcgtcctcttcatgaaaataatggagattggttctggtggggtaataatccaaaagcttgtgctaaattatggaaaatcttatatgaacgtatggttaactatcatggattaaataatttaatttggctttggaatggtaataatgatgaatatactccaattgaatacattgatattattggtgttgatatctatgctaatgatcatggaccacaaactacagcatacaatactcactttgatttttatggaggtaaaaagatggttgttttatcagaaaatggacgtattccagatattcaacaatgtgttgaccaaggtgcttggtggggttatttccaaacttggaatagtgaattcattttacaaaattcatatcatactgatgctcaacttaaagaatactttaatcataaaattgttatgaatatggatgaatt

SEQ ID NO: 24690 - DNA, 345 bp, Neocallimastix californiae
  Glyco_hydro_26
cattgatactttcgttaaaggtgtcaaagattttggtgaggaaatttggcttcgtcctcttcatgaagccaatggtgattggtacacttggggtactggtgctgatagaattaataattcggaagataagcttgcagccgcttatcgtcatattgttgatagattccgtgatgcaaacgttaccaatgttaaatggatatggactactaactgtagtaattctggagtagctactttaactggttcttacccaggtgatgattacattgattacacttctattgatggttacaactggggtaccgctcaaagttggtctcgttggaatactttcgaagaagtttt

SEQ ID NO: 24691 - DNA, 900 bp, Neocallimastix californiae
  Glyco_hydro_26
tccaaattcaacttcttcaaccaaattattatataattatcttgtgaataattttgggaaaaaaataatatcaggacaagttggttctgcaggatatttagaaactgaagaattcgattatataaaaaaaattactggaaaaactccagcaatgttcaatgttgactttatttttgaatctctagatcatgactggaaaccagatgatagtattgctgatatggttttagcttggtggaagaaatatgaaggaaaaggaatattacatgctcagtggcattggaataaaaaaggaagtgatggtcaagttagtttctatactaaaaatgttgatttcgatataactaaagctctaattgaaggtaccaatgaatataaaagtattatggcagatatggattatattgcttcacaaataaaaatactacaagacaaagatattccaattatttggagaccattacatgaagcttctggaggttggttttggtggggtgctaaaggtcccgaaccatgtgtagcgctgtataaaatgatgtatgaaagatttaccaaagttcataaattgaataatttaatatggtgttggaatggaggaattggtaattggtacccaggagatgaatatgtcgacataatctcagaagatgtttatgataaacatagttcatttgcctcaaaatataattctttacttaatcaagtaggaaataaaaaaattattgcattatctgaaaatggtagtttacctgatattgaatcttgtatgaaagagagaattacctggagtttcttttgtacctggaataatgaatatattttaaataatagtgataatatctataatactcctgaatatattaaaagtgtttataacagtaactatgttattactcaatc

SEQ ID NO: 24692 - DNA, 906 bp, Anaeromyces robustus
  Glyco_hydro_26
taatccaaaagctattcctgctgctaaaaaactttatgatttcttaaaaacaaattatggtaaaagaattttatctggtcaagttggtgctgctggtcaagccggtgatgaaggtgaagaatttaaacgtattattaatgctactggtaaaaaaccagctgtttggaatatggatttcatttttgaatctaatgattgtacttggagaccaactaaccctgatattactgaaatggcacttgattggtggaaaaaatatcaaggtaagggtattatgtctgctcaatggcattggaatattgctggtcaaactggtaattttgctttttataaaaaagatactacttttgatttagaaaaagctgttaccgaaggtacttgggaatataataaaattataaaagatattgatcgtgtttctggtcttattaaaaaattacaagctgttaatatgccattactttggcgtccacttcatgaaaataatggtgattggttctggtggggaaataatccaaaagcttgtgctaaattatggaaaattttatatgaacgtatggttaattatcacggattaaataatttaatttggctttggaatggtaataatgatgaatacactccaattgaatatatcgatttaattggtgttgatatttatgctgatgaccatggaccacaaactactgcttttaatactcattttgatttctatgatggaaagaaaatggttgttttatctgaaaatggtcgtattccagatattcaaaaatgtgttgcacaaggagcatggtggggttacttccaaacttggaatagtgaatttatattacaagattcctaccatactacagctcaacttaaagaatactttagcaataaagtcgttatgaatatggatgaact

SEQ ID NO: 24693 - DNA, 906 bp, Piromyces finnis
  Glyco_hydro_26
aaatccaaaagctattccagctgctagaaagctttatgactttttaaaatctaattatggtaagagaatactttctggtcaagttggtgctgctggtaaagctggtgatgaaggtcaagaattccaacgtattaagaatgcttctggaaaattacctgctgtttggaatatggatttcatttttgaatcaaatgattgtacttggagaccagaaaatccagatattactgaaatggcaattaattggtggaaaaagtatgaaggaaaaggtattatggcagctcaatggcactggaatattgctggtaaaactggtaattttgctttttacagtaaggatacaacatttagtcttgagaatgcagtaactaaaggtacttgggaatatgaaaagattattaaagatattgatcgtgtttcaggtcatataaaaaagttacaagctgttaatatgcctttaatatggagacctctccatgaaaacaatggtgattggttctggtggggtaataatccaaaggcttgtgctaaattatggaaaatcttatatgaacgtatggttaactatcacggtttaaacaatttaatttggctttggaatggtaataatgatgaatatactccagttgactatattgatattattggtgttgatatttatgctaatgaccacggaccacaaactacagcattcaatacccactttgatttctatggaggaaagaaaatggttgttttatcagaaaatggacgtattccagatattcaacaatgcgttgatcaagatgcttggtggggttacttccaaacttggaatagtgaatttattttacaagaatcataccatactaatgcacaacttaaagaatactttaatcatgaaattgttatgaatatggatgaatt

SEQ ID NO: 24694 - DNA, 906 bp, Piromyces finnis; identical to SEQ ID NO: 24693
  Glyco_hydro_26

SEQ ID NO: 24695 - DNA, 825 bp, Neocallimastix californiae
  Glyco_hydro_3
agaaatgactttagatgaaaagattggaatggttactggttctcaaaatagttttggtccatgtgttggatatattgaaccaattgaaagattaggtttcaagggtatgtgtttccaagatggtccagctggtgttcgtagtgctaaacatactacaactttaccatctggtttaaatattgcttctacttttgatccagaaattatgaagaaaattggtgttgtattaggtgaagaatcaagagctaagggtgttaatgccattttaggtccagctatgaatatgtaccgttctccagctgctggtagaaattgggaaggttatggtgaagatacctatcttgcttcagttgcttcaaagaatgttgtagctggtattgctagtcaaggtgtccttgctactattaagcactttgctggtaatgagcaagaaactaaccgtgaaacatctaattctgagattgatgaacgtgttttacaagaagtttacttcccaccattcaaggctggaattgtttctggtgctggtggtgttatggctgcttacaacgaccttaatggtattccatctgctaataatacctggcttttaaacaaagttttaaagaaacaaatgttattccatggtttcgttaccagtgactggtggggtactaaggataagtacgaaattatgaatggtttagatattaatatgccaggtggtaaacaatggggtccaaccgtaactgaaagttactggggtgaagaacttaaggaagctgttgaatctggtgaaattgatgtctcttatgttgatgaagcttgtactcgtatcttaactat

SEQ ID NO: 24696 - DNA, 798 bp, Neocallimastix californiae
  Glyco_hydro_3
ttatatgaataatcaaggttcatgtgttggtaatgttaaaccactcagcagaaagaatttcaaaggtatatgtttacaggatggtccagcaggtgttcgttttaatgatggaacttcaactacatggcaagttggtattaataatgctgccacttttaataaggaattattatacaaaattggtaaggaccaaggtgctgaattcaaggctaagggtattaatattgctcttgctccatctatgaatattcttcgtgctccagcttctggaagagtttgggaaaactttggtgaagatccatatttatctggtgtttgtggtactgaaatgactaagggttaccaagattctggttgtattgtttccgcaaagcattatgttgctaatgatgttgaacacaatcgtgaagcttcaacttctaatatggatgaacaaactttaatggaaattcatgttgaaccattctatagaactgttactgaaggtcaagctggttctgtcatggcctcctacaacgctgttaatgatgtatatgttgttcaaaataagaaggtgcttactgaaattttaaaggaaaaaatgaatttccaaggttttgttatgtctgattggtgggctattcatgatttagaaggtagtttcaatgctggtgttgatttgaatatgccaggtggtaaagcttggggtccagattatattaatgattctttctggggtaacaatatttctactgctatcagaaatggaaaggtatcttcagctcgtttggatgatgctgttagacgtattattcgtac

SEQ ID NO: 24697 - DNA, 822 bp, Neocallimastix californiae
  Glyco_hydro_3
aatgactttagatgaaaagattggaatgataactggttctaaaaacagttttggtccatgtgttggttatattgaaccaattgaaagattagacttcaaaggtatgtgcttacaagatggtccagctggtgttcgtaatgctaatcatagtactactttcccctcaggtttaaatattgcttcaacatttgatccagaaattatgaagaaacttggtgttgctttaggtgaagaatgtagagccaagggtgttaatgcacttttaggtccagctatgaacatgtaccgttctccagctgctggtagaaattgggaaggttatggtgaagatacttaccttgcttcagttacttctaaaaatgttgttgctggtgttgttagtcaaggtgtacttgctacagttaaacactttgccggtaatgaacaagaaacaagacgtgaacattctaactcagttgttgatgaacgtgtcttacaagaagtatatttcccaccattcaaagctgctattgtttctggtgctggtggtgttatggcagcttacaatgacctcaatggaattccagctgccaacaatacttggcttttaaataaagtcttaaagaagcaaatgatgttccacggttttgtcaccagtgattggtggggtactaaggataagtatgaaattatgaatggtttagatattaatatgccaggcggtactgactggggtgaatcagttactgaaagttactggggtgaagaacttaaggcctctgttgagtctggtgaaatagatgtttcatatgttgatgatgcttgcgtacgtataatgaccat

SEQ ID NO: 24698 - DNA, 777 bp, Neocallimastix californiae
  Glyco_hydro_3
tagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactat

SEQ ID NO: 24699 - DNA, 795 bp, Anaeromyces robustus
  Glyco_hydro_3
ggtcactggttcccaaaatagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactat

SEQ ID NO: 24700 - DNA, 798 bp, Anaeromyces robustus
  Glyco_hydro_3
ttacatgaatatgcaaggtacctgtgttggtaatattaaaccaaatagtagaaaaaattttaagggtttatgtcttcaagatggtccagccggtgttcgttttaatgaaggaacttcaacaacttggcaaactggtattaacagtgcagccacttttaataaggatttattatataaaattggtaaagatcaaggtgccgaattttatgctaaaggtataaacgttgctcttgctccttcaatgaacattcttcgtgccccagcttctggtagagtttgggaaaactttggtgaagatccatatttatcaggtgtatgtggtacacaaattacaaagggtatgcaagattctggtgttattgtttcagctaaacactatgttgctaatgatattgaacataatcgtgaagcttctacatctaacatggatgaacaaaccttaatggaaattcatgtagaaccattctatagaactgtcactgaaggtgaagctggttctgttatggcttcatataatgctgttaatggtgtatatgtggttcaaaataaaaaggtacttactgaaatcttaaaggaaggaatgaacttccaaggtttcattgtttctgattggtgggctattcatgatttagaaggtagtttcaatgctggtgttgatatgaacatgccaggtggtaaggcttggggtccaaattatattaatgattcattctggggttctaacatttctaacgctataagaagtggtaaagttagctccgctcgtttagatgatgctgttaaacgtattattcgttc

SEQ ID NO: 24701 - DNA, 834 bp, Anaeromyces robustus
  Glyco_hydro_3
atttgtttcacaaatgactttagatgaaaagattggcatggttacaggttctcaaaacagttttggaccatgtattggttaccttgaaccaattgaaagattaggtttcaagggtttatgtttacaagatggtccagctggtgtacgtagtgctaaacatagtactactttcccatctggtttaaatattgcatctacttttgatgttgaattaatgcatgatcttggtgttgctcttggtgaagaatgtagagcaaagggtgttaatgttattttaggtccagctatgaatatgtatcgttcacctgctgctggtagaaactgggaaggttacggtgaagatacttatcttgcttctgttgcttcaaagaatgttgttgcaggtattcaaagtcaaggtgtacttgctactgctaaacattttgttggtaatgaacaagaatataaacgtgattcttcaaattctattattgatgaacgtgttttacaagaagtttatcttccaccatttaaagcagctgtagtttctggtgctggtgcttttatggcttcttataattctattaatggtattcctgctactaatcatactcaacttttaaataaagttttgaaaaaacaattcttattccatggttttgttactagtgattggtggggtactaaagataaaattgaaattactaatggtttagatatgaatatgccaggtggtaaagtttggggtccaacggtaaaagaaagttattggggtgaagaattaaaagatgctattgaaaatgaagaaattgatatttcttaccttgatgaatcttgtgaacgtattatgactat

SEQ ID NO: 24702 - DNA, 783 bp, Piromyces finnis
  Glyco_hydro_3
tgaaaatagttttggtccatgtgttggttacattcctccaattgaaagattaggtttcaaaggtttatgtttacaagatggtccagctggtgttcgttctgctaaacattcaaccactttcccatctggtttaaatattgcttctacttttgatcaaaatcttatgaagaaacttggtgttgctcttggtgaagaatgcagagctaagggtgttaacgttattttaggtccagctatgaacatgtaccgttctccagctgctggtagaaactgggaaggttatggtgaagatactttcctcgctactgttgcttcaaagaatgttgttgctggtattcaaagtcaaggtgtttttgctactgctaagcactttgctggtaatgaacaagaatacaagcgtgaatcttctaactctattattgatgaacgtgttttacaagaagtttacttcccaccatttaaggctgctgttgtttctggtgctggtgcttttatgtcagcttataatgatcttaatggtattccatctgctaacaacacttatcttttaaaccaagttttaaagaagcaatttaaattccacggttttgtcactagtgactggtggggtactaaggataagtatgaaattactaatggtttagatgttaatatgccaggtggtaagcaatggggtccaactgaaaaagaaagttactggggagaagaactcaaggctgctattgaaagcgaagaaattgatatttcttatcttgatgaagcttgtgaacgtattttaactat

SEQ ID NO: 24703 - DNA, 783 bp, Piromyces finnis; identical to SEQ ID NO: 24702
  Glyco_hydro_3

SEQ ID NO: 24704 - DNA, 696 bp, Neocallimastix californiae
  Glyco_hydro_3_C
tgttcttttaaagaatgatgaagatattttaccaatttctggtgacaagtacaaaaagattgctatcatcggtgatggtgctcttccaactaagcaatgtactgataatggttgttccgaaggtaagatgtctggtgttgttgctttaggttggggttccggtactaccaacatggaaaacataagtgatccactttctgctcttactgaacgtgctgaaaaggatggtattactatcactagcttcactgatgatgatagtgatacagataaggctgccgaagttgctgctgatgctgatctcgctattgttgttgtagttgctgattctggtgaagagtacattagtgttgaaggtaataagggtgacagaaagaaccttgatttatggcataatggtaatgaattagtttctgctgttgctgctgctaacaagaacactgttgttgttatttactctccaggtgttgttaatttacctttcattgatgaagttaatggtttagtttatgctggtatgccaggtcaagaagctggtcacggtcttgctgatattttatttaatgatgttgctccatctggtaagttaccatttacttggggtaagaaacgtgaagattactgttgtgacgttgttacaggcggtaaaggaaaaactcaagttccatacgaagaaggttattacattggttacaa

SEQ ID NO: 24705 - DNA, 807 bp, Neocallimastix californiae
  Glyco_hydro_3_C
aggtcatgcagaagttgttcgtgaagctgctgctgctagtgttgttcttttaaagaatgatgaagatattttaccaatttctggtgacaagtacaaaaagattgctatcatcggtgatggtgctcttccaactaagcaatgtactgataatggttgttccgaaggtaagatgtctggtgttgttgctttaggttggggttccggtactaccaacatggaaaacataagtgatccactttctgctcttactgaacgtgctgaaaaggatggtattactatcactagcttcactgatgatgatagtgatacagataaggctgccgaagttgctgctgatgctgatctcgctattgttgttgtagttgctgattctggtgaagagtacattagtgttgaaggtaataagggtgacagaaagaaccttgatttatggcataatggtaatgaattagtttctgctgttgctgctgctaacaagaacactgttgttgttatttactctccaggtgttgttaatttacctttcattgatgaagttaatggtttagtttatgctggtatgccaggtcaagaagctggtcacggtcttgctgatattttatttaatgatgttgctccatctggtaagttaccatttacttggggtaagaaacgtgaagattactgttgtgacgttgttacaggcggtaaaggaaaaactcaagttccatacgaagaaggttattacattggttacaaatggttcgataagaaaaacattgaaccacacttctcctttggtcatggtcttacctatgctaagttcaa

SEQ ID NO: 24706 - DNA, 798 bp, Neocallimastix californiae
  Glyco_hydro_3_C
gcatgctgaaactaatagacaagctgctattgaaagtactgttttattaaagaatgctgattctattttaccattaactaacaaatataagaagattgctattattggtaaggatgctgataaagctcagaaatgtaatgattcagcatgtactaatggtaatattattcaaggatggggttcaggtactactgatttcgttggtgtttctgatccatttagtgcgattaaaaacagagcttctaaagatggtatttctgttgtaagttcactttctgataattctagtgaaggtgctaatgccgcaagaggagctgatgttgctcttgttttcgttagagcttcttctggtgaagaatacattgttgtcgataataacaaaggtgatcgtaacaacttagatttatggcatggaggtaatgatttagtaaagagtgttgctgctgttaataagaataccattgtcgttattcatgctccagctactgttaaccttccattccttgataatgttaaggctgttattcatgctggtatgccaggtgctgaatctggtaatgctattgcctctattttattcggagattctaacccatctggtcatcttccatttacttgggctccaagagaagattactgttgtgatgtttcttatccaggagaacttccaaaaggtggaaactccaagactgtatatgactataaggaaggattattcgttggttaccgttggttcgataaaaagggaattgttccaaccttcccattcggtcatggtctttcttacactacttttga

SEQ ID NO: 24707 - DNA, 690 bp, Neocallimastix californiae
  Glyco_hydro_3_C
tgttttattaaagaatgctgattctattttaccattaactaacaaatataagaagattgctattattggtaaggatgctgataaagctcagaaatgtaatgattcagcatgtactaatggtaatattattcaaggatggggttcaggtactactgatttcgttggtgtttctgatccatttagtgcgattaaaaacagagcttctaaagatggtatttctgttgtaagttcactttctgataattctagtgaaggtgctaatgccgcaagaggagctgatgttgctcttgttttcgttagagcttcttctggtgaagaatacattgttgtcgataataacaaaggtgatcgtaacaacttagatttatggcatggaggtaatgatttagtaaagagtgttgctgctgttaataagaataccattgtcgttattcatgctccagctactgttaaccttccattccttgataatgttaaggctgttattcatgctggtatgccaggtgctgaatctggtaatgctattgcctctattttattcggagattctaacccatctggtcatcttccatttacttgggctccaagagaagattactgttgtgatgtttcttatccaggagaacttccaaaaggtggaaactccaagactgtatatgactataaggaaggattattcgttggttaccg

SEQ ID NO: 24708 - DNA, 795 bp, Neocallimastix californiae
  Glyco_hydro_3_C
aggtcatgctgagattgctcgtgaagctgctgctgccagtgttgttcttttaaaaaatgatgaagaaattttaccaatttctgctgataaatacaagaaaattgctattattggtaacggtgctcttccaacagaagtttgtactgataatggttgtaaaagtcaaatatctggtgtagtcgcgttaggttggggttctggtacaacaaacatggaaaacattagtgacccactttcagctcttactgaacgtgctgaaaaggatggtatcactattactagtttcacagaagatgatagtgatactgaaaaggctgccgaagttgctgctgatgctgatcttgcaattgttgttgttgtcgctgattccggtgaaggatacttaactgttgaaggtaacagtggtgatagaaaagatcttgatttatggcacaatggtaatgatttagttgctgccgtagctgctgcaaataaaaatactgttgttgttatctactctcctggtgttgttaatttaccattccttgatgatatcaatggtttagtttatgctggtatgccaggtcaagaagctggtcatggtcttgctgatgttttattcaatgatgtagcaccatctggtaaactaccattcacctggggtaagaagcgcgaagattactgttgcgatattgttccaggtagaggaaatgaaattacccaagttaaatataccgaaggttactacattggttacaaatggtttgataaagaaaagattgaaccacacttctcatttggtcatggtcttactta

SEQ ID NO: 24709 - DNA, 696 bp, Neocallimastix californiae
  Glyco_hydro_3_C
tgttcttttaaaaaatgatgaagaaattttaccaatttctgctgataaatacaagaaaattgctattattggtaacggtgctcttccaacagaagtttgtactgataatggttgtaaaagtcaaatatctggtgtagtcgcgttaggttggggttctggtacaacaaacatggaaaacattagtgacccactttcagctcttactgaacgtgctgaaaaggatggtatcactattactagtttcacagaagatgatagtgatactgaaaaggctgccgaagttgctgctgatgctgatcttgcaattgttgttgttgtcgctgattccggtgaaggatacttaactgttgaaggtaacagtggtgatagaaaagatcttgatttatggcacaatggtaatgatttagttgctgccgtagctgctgcaaataaaaatactgttgttgttatctactctcctggtgttgttaatttaccattccttgatgatatcaatggtttagtttatgctggtatgccaggtcaagaagctggtcatggtcttgctgatgttttattcaatgatgtagcaccatctggtaaactaccattcacctggggtaagaagcgcgaagattactgttgcgatattgttccaggtagaggaaatgaaattacccaagttaaatataccgaaggttactacattggttacaa

SEQ ID NO: 24710 - DNA, 795 bp, Neocallimastix californiae
  Glyco_hydro_3_C
aggtcatgctgaaattgttcgtaaagctgctgctaatagtgttgttattttaaagaatgatgatgatgttttaccaatttctccaaagaaatacaagaagattgctattattggtgatggtgctcttccaatgaaactttgtgaagataatggttgtaaggataaaatatctggtgttgttgcattaggttggggttctggtactactaatatggaaaatattagtgatccactttctgcaattactgaacgtgctgaaaaggatggtattaccattactagttttactgaagatgatgacgatactgataaagctgctgaagttgctgctgatgctgatcttgctattgttgtcgttgttgctgattctggtgaaggttacttaactgttgaaggtaacagtggtgacagaaaagatcttgatttatggcacaatggtaatgaattagttgctgctgttgctgctgctaacaagaatacagttgttgttatttactcacctggtgttgttaatttacctttcgttgatgatgttaaaactattctttacgctggtatgccaggtcaagaagctggtcatggtcttgctgatattttattcaatgatgttgctccaactggtaaattaccatttacttggggtaagaaacgtgaagattattgttgtgatgttgttaaaggtaaaggtaattctattactcaagttgaatactctgaaggttattacattggttacaagtggttcgataaacaaaatattaaaccactcttcccattcggtcatggtcttactta

SEQ ID NO: 24711 - DNA, 756 bp, Neocallimastix californiae
  Glyco_hydro_3_C
tgttattttaaagaatgatgatgatgttttaccaatttctccaaagaaatacaagaagattgctattattggtgatggtgctcttccaatgaaactttgtgaagataatggttgtaaggataaaatatctggtgttgttgcattaggttggggttctggtactactaatatggaaaatattagtgatccactttctgcaattactgaacgtgctgaaaaggatggtattaccattactagttttactgaagatgatgacgatactgataaagctgctgaagttgctgctgatgctgatcttgctattgttgtcgttgttgctgattctggtgaaggttacttaactgttgaaggtaacagtggtgacagaaaagatcttgatttatggcacaatggtaatgaattagttgctgctgttgctgctgctaacaagaatacagttgttgttatttactcacctggtgttgttaatttacctttcgttgatgatgttaaaactattctttacgctggtatgccaggtcaagaagctggtcatggtcttgctgatattttattcaatgatgttgctccaactggtaaattaccatttacttggggtaagaaacgtgaagattattgttgtgatgttgttaaaggtaaaggtaattctattactcaagttgaatactctgaaggttattacattggttacaagtggttcgataaacaaaatattaaaccactcttcccattcggtcatggtcttacttacgc

SEQ ID NO: 24712 - DNA, 756 bp, Anaeromyces robustus; identical to SEQ ID NO: 24711
  Glyco_hydro_3_C

SEQ ID NO: 24713 - DNA, 795 bp, Anaeromyces robustus; identical to SEQ ID NO: 24710
  Glyco_hydro_3_C

SEQ ID NO: 24714 - DNA, 687 bp, Anaeromyces robustus
  Glyco_hydro_3_C
tttattaaagaacgatgataatgtattaccattaaccaagaaatacagaaagattgctgttattggtaaagatgctgataaagctgaatcttgtaccgatactgcttgtactaatggtaatattattcaaggttttggttctggtactaccgatttcactggtattactgatccatatagctccattaaaaatagagcttcaaaggaaggaataactgttgttggttccatttctgatagtgctaatgaaggtgctaatgctgctagagatgctgatgttgctattgttttcgttagagccacctctggtgaagaatatattgttgttgataataataaaggtgaccgtaataatttagatttatggcatggtggtaatgatttagttaaaagtgttgctgctgttaataagaatactattgtcgttattcatgctccagctactgttaatcttccattcattaacaatgttaaagctattattcatgctggtatgccaggtgctgaatcaggtaatgctatcgcttccgtcttatttggtgatcataatccatctggtcaccttccatttacatgggctaagagagaagaatactgttgtgatgtttcctatccaggagaacttccacatggaggagactcaaagactacttatgattataaggaaggcttattcgttggttaccg

SEQ ID NO: 24715 - DNA, 798 bp, Anaeromyces robustus
  Glyco_hydro_3_C
gcatactgaaacacacagacaagctgccactgaaagtcaaattttattaaagaacgatgataatgtattaccattaaccaagaaatacagaaagattgctgttattggtaaagatgctgataaagctgaatcttgtaccgatactgcttgtactaatggtaatattattcaaggttttggttctggtactaccgatttcactggtattactgatccatatagctccattaaaaatagagcttcaaaggaaggaataactgttgttggttccatttctgatagtgctaatgaaggtgctaatgctgctagagatgctgatgttgctattgttttcgttagagccacctctggtgaagaatatattgttgttgataataataaaggtgaccgtaataatttagatttatggcatggtggtaatgatttagttaaaagtgttgctgctgttaataagaatactattgtcgttattcatgctccagctactgttaatcttccattcattaacaatgttaaagctattattcatgctggtatgccaggtgctgaatcaggtaatgctatcgcttccgtcttatttggtgatcataatccatctggtcaccttccatttacatgggctaagagagaagaatactgttgtgatgtttcctatccaggagaacttccacatggaggagactcaaagactacttatgattataaggaaggcttattcgttggttaccgttggttcgataaaaagggtactaagccaatttacccattcggtcatggtctttcttacactacctttga

SEQ ID NO: 24716 - DNA, 759 bp, Anaeromyces robustus
  Glyco_hydro_3_C
tgttcttttaaagaatgatgaagatattttaccaatttctcctaaaaaatataaaaaaattgctattattggtgatggtgctcgtccaactaaaccttgtactgataatggttgtgctcaaggtaaaatgtctggtgttgttgttttaggttggggttctggtactactaatatggaaaatattagtgatccactttctgctttaactgaacgtgccgaaaaggatggtattacaattactagttttactgaagatgatagtgatactgataaagctgctgaagttgctgctgatgctgatcttgctattgttgttgttactgcttcttcaggtgaagaatatattactgttgaaggtaatcaaggggatagaaaaaatcttgatttatggcataatggtaatgaattagtttcagctgttgctgctgctaataaaaacacagttgttgttatttattctcctggtgttgttaatttacctttccttgatgatattaaaggtttagtttatgctggtatgccaggtcaagaagctggtcatggtcttgctgatattttatttaatgatgtagctccttctggtaaattaccatttacttggggtaaaaaacgtgaagattattgttgtgatattgtctatggtaatgataaaattattgatattccttactctgaaggtttttaccttggttataaatggtttgataaggaaaaaattgaaccacatttctcattcggtcatggtcttacctatgctaa

SEQ ID NO: 24717 - DNA, 807 bp, Anaeromyces robustus
  Glyco_hydro_3_C
aggtcatactgaactcgtacgtaaagctgctgctgctagtgttgttcttttaaagaatgatgaagatattttaccaatttctcctaaaaaatataaaaaaattgctattattggtgatggtgctcgtccaactaaaccttgtactgataatggttgtgctcaaggtaaaatgtctggtgttgttgttttaggttggggttctggtactactaatatggaaaatattagtgatccactttctgctttaactgaacgtgccgaaaaggatggtattacaattactagttttactgaagatgatagtgatactgataaagctgctgaagttgctgctgatgctgatcttgctattgttgttgttactgcttcttcaggtgaagaatatattactgttgaaggtaatcaaggggatagaaaaaatcttgatttatggcataatggtaatgaattagtttcagctgttgctgctgctaataaaaacacagttgttgttatttattctcctggtgttgttaatttacctttccttgatgatattaaaggtttagtttatgctggtatgccaggtcaagaagctggtcatggtcttgctgatattttatttaatgatgtagctccttctggtaaattaccatttacttggggtaaaaaacgtgaagattattgttgtgatattgtctatggtaatgataaaattattgatattccttactctgaaggtttttaccttggttataaatggtttgataaggaaaaaattgaaccacatttctcattcggtcatggtcttacctatgctaaattcaa

SEQ ID NO: 24718 - DNA, 795 bp, Piromyces finnis
  Glyco_hydro_3_C
aggtcacactgaacttgttcgtgaagctgctgctgcttctgttgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatgttgtctacggtaatgataaaattattgatgttccatacactgaaggtttctaccttggttacaagtggttcgataaggaaaagattgaaccacacttctcattcggtcacggtcttactta

SEQ ID NO: 24719 - DNA, 756 bp, Piromyces finnis
  Glyco_hydro_3_C
tgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatgttgtctacggtaatgataaaattattgatgttccatacactgaaggtttctaccttggttacaagtggttcgataaggaaaagattgaaccacacttctcattcggtcacggtcttacttatgc

SEQ ID NO: 24720 - DNA, 795 bp, Piromyces finnis
  Glyco_hydro_3_C
aggtcacactgaacttgttcgtgaagctgctgctgcttctgttgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatattgttagtaacaatgatgtctatccaaagattgaatacagtgaaggtttctaccttggttacaagtggttcgataaggaaaagattgaaccacacttctcattcggtcacggtcttactta

SEQ ID NO: 24721 - DNA, 696 bp, Piromyces finnis
  Glyco_hydro_3_C
tgttcttttaaagaacgataaggatattttaccaatttctggtaagaaatacggtaagattgctattattggtgacggtgctcttccaaccaagttatgtactgataatggttgtactcaaggtaagatgtctggtgttgttgctttaggttggggttcaggtactactaatatggaagatattagtgatccactttcagctcttactgaacgtgctgaaaaggatggtattacagttactagttttactgatgatgatgaagatactgaaaaggcagctcaagttgcttctgatgctgatcttgctattgttgttgttactgccaattctggtgaaggttatttaactgttgaaggtaacagtggtgacagaaagaatcttgatttatggcataatggtaatgaattagttgccgcagttgctgcagccaatccaaatactgttgttgttatctattctccaggtgttgttaacttaccatttattgacgatgttgatggtttagtttacgctggtatgccaggtaaggaagctggtcatggtcttgctgatattttattccatgatgtttcaccatctggtaaattaccattcacttggggtaagaagcgcgaagattactgttgtgatattgttagtaacaatgatgtctatccaaagattgaatacagtgaaggtttctaccttggttacaa

SEQ ID NO: 24722 - DNA, 897 bp, Neocallimastix californiae
  Glyco_hydro_3_N
gtcagaatctgaagacttagctaaagctttagttgaagaaatgactttagatgaaaagattggaatggttactggttctcaaaatagttttggtccatgtgttggatatattgaaccaattgaaagattaggtttcaagggtatgtgtttccaagatggtccagctggtgttcgtagtgctaaacatactacaactttaccatctggtttaaatattgcttctacttttgatccagaaattatgaagaaaattggtgttgtattaggtgaagaatcaagagctaagggtgttaatgccattttaggtccagctatgaatatgtaccgttctccagctgctggtagaaattgggaaggttatggtgaagatacctatcttgcttcagttgcttcaaagaatgttgtagctggtattgctagtcaaggtgtccttgctactattaagcactttgctggtaatgagcaagaaactaaccgtgaaacatctaattctgagattgatgaacgtgttttacaagaagtttacttcccaccattcaaggctggaattgtttctggtgctggtggtgttatggctgcttacaacgaccttaatggtattccatctgctaataatacctggcttttaaacaaagttttaaagaaacaaatgttattccatggtttcgttaccagtgactggtggggtactaaggataagtacgaaattatgaatggtttagatattaatatgccaggtggtaaacaatggggtccaaccgtaactgaaagttactggggtgaagaacttaaggaagctgttgaatctggtgaaattgatgtctcttatgttgatgaagcttgtactcgtatcttaactatgttatacaagtacagacaatttgatgactatccaga

SEQ ID NO: 24723 - DNA, 915 bp, Neocallimastix californiae
  Glyco_hydro_3_N
tgctactacttgggaagaagcagaccaaaaggcaaagacctttatgagcgatttaactgaaagtgaaaaaattgatattgtcactggttatatgaataatcaaggttcatgtgttggtaatgttaaaccactcagcagaaagaatttcaaaggtatatgtttacaggatggtccagcaggtgttcgttttaatgatggaacttcaactacatggcaagttggtattaataatgctgccacttttaataaggaattattatacaaaattggtaaggaccaaggtgctgaattcaaggctaagggtattaatattgctcttgctccatctatgaatattcttcgtgctccagcttctggaagagtttgggaaaactttggtgaagatccatatttatctggtgtttgtggtactgaaatgactaagggttaccaagattctggttgtattgtttccgcaaagcattatgttgctaatgatgttgaacacaatcgtgaagcttcaacttctaatatggatgaacaaactttaatggaaattcatgttgaaccattctatagaactgttactgaaggtcaagctggttctgtcatggcctcctacaacgctgttaatgatgtatatgttgttcaaaataagaaggtgcttactgaaattttaaaggaaaaaatgaatttccaaggttttgttatgtctgattggtgggctattcatgatttagaaggtagtttcaatgctggtgttgatttgaatatgccaggtggtaaagcttggggtccagattatattaatgattctttctggggtaacaatatttctactgctatcagaaatggaaaggtatcttcagctcgtttggatgatgctgttagacgtattattcgtacattatacagattcgatcaaatgagtggtta

SEQ ID NO: 24724 - DNA, 897 bp, Neocallimastix californiae
  Glyco_hydro_3_N
gtcagaatctgaagatttagctaaggcttttgttgaaaaaatgactttagatgaaaagattggaatgataactggttctaaaaacagttttggtccatgtgttggttatattgaaccaattgaaagattagacttcaaaggtatgtgcttacaagatggtccagctggtgttcgtaatgctaatcatagtactactttcccctcaggtttaaatattgcttcaacatttgatccagaaattatgaagaaacttggtgttgctttaggtgaagaatgtagagccaagggtgttaatgcacttttaggtccagctatgaacatgtaccgttctccagctgctggtagaaattgggaaggttatggtgaagatacttaccttgcttcagttacttctaaaaatgttgttgctggtgttgttagtcaaggtgtacttgctacagttaaacactttgccggtaatgaacaagaaacaagacgtgaacattctaactcagttgttgatgaacgtgtcttacaagaagtatatttcccaccattcaaagctgctattgtttctggtgctggtggtgttatggcagcttacaatgacctcaatggaattccagctgccaacaatacttggcttttaaataaagtcttaaagaagcaaatgatgttccacggttttgtcaccagtgattggtggggtactaaggataagtatgaaattatgaatggtttagatattaatatgccaggcggtactgactggggtgaatcagttactgaaagttactggggtgaagaacttaaggcctctgttgagtctggtgaaatagatgtttcatatgttgatgatgcttgcgtacgtataatgaccatgttatacaagtacagacaatttgatgactatccaga

SEQ ID NO: 24725 - DNA, 846 bp, Neocallimastix californiae
  Glyco_hydro_3_N
tgaaaaaattaatatggtcactggttcccaaaatagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactatgttatacaagtacagacaattcgatgattacccaga

SEQ ID NO: 24726 - DNA, 897 bp, Anaeromyces robustus
  Glyco_hydro_3_N
gtcagaatctgaagatttagctaaagcttttgttgaagaaatgactttagatgaaaaaattaatatggtcactggttcccaaaatagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactatgttatacaagtacagacaattcgatgattacccaga

SEQ ID NO: 24727 - DNA, 912 bp, Anaeromyces robustus
  Glyco_hydro_3_N
ttgggaagaagccgataaaaaggcttcatcctttgttagtgatttaagtgaagctgaaaaaattgacattgtaactggttacatgaatatgcaaggtacctgtgttggtaatattaaaccaaatagtagaaaaaattttaagggtttatgtcttcaagatggtccagccggtgttcgttttaatgaaggaacttcaacaacttggcaaactggtattaacagtgcagccacttttaataaggatttattatataaaattggtaaagatcaaggtgccgaattttatgctaaaggtataaacgttgctcttgctccttcaatgaacattcttcgtgccccagcttctggtagagtttgggaaaactttggtgaagatccatatttatcaggtgtatgtggtacacaaattacaaagggtatgcaagattctggtgttattgtttcagctaaacactatgttgctaatgatattgaacataatcgtgaagcttctacatctaacatggatgaacaaaccttaatggaaattcatgtagaaccattctatagaactgtcactgaaggtgaagctggttctgttatggcttcatataatgctgttaatggtgtatatgtggttcaaaataaaaaggtacttactgaaatcttaaaggaaggaatgaacttccaaggtttcattgtttctgattggtgggctattcatgatttagaaggtagtttcaatgctggtgttgatatgaacatgccaggtggtaaggcttggggtccaaattatattaatgattcattctggggttctaacatttctaacgctataagaagtggtaaagttagctccgctcgtttagatgatgctgttaaacgtattattcgttctatgtataagatgaaccaaatgggtaatttcccaaa

SEQ ID NO: 24728 - DNA, 897 bp, Anaeromyces robustus
  Glyco_hydro_3_N
gtctgaatctgaagatttagctaaagaatttgtttcacaaatgactttagatgaaaagattggcatggttacaggttctcaaaacagttttggaccatgtattggttaccttgaaccaattgaaagattaggtttcaagggtttatgtttacaagatggtccagctggtgtacgtagtgctaaacatagtactactttcccatctggtttaaatattgcatctacttttgatgttgaattaatgcatgatcttggtgttgctcttggtgaagaatgtagagcaaagggtgttaatgttattttaggtccagctatgaatatgtatcgttcacctgctgctggtagaaactgggaaggttacggtgaagatacttatcttgcttctgttgcttcaaagaatgttgttgcaggtattcaaagtcaaggtgtacttgctactgctaaacattttgttggtaatgaacaagaatataaacgtgattcttcaaattctattattgatgaacgtgttttacaagaagtttatcttccaccatttaaagcagctgtagtttctggtgctggtgcttttatggcttcttataattctattaatggtattcctgctactaatcatactcaacttttaaataaagttttgaaaaaacaattcttattccatggttttgttactagtgattggtggggtactaaagataaaattgaaattactaatggtttagatatgaatatgccaggtggtaaagtttggggtccaacggtaaaagaaagttattggggtgaagaattaaaagatgctattgaaaatgaagaaattgatatttcttaccttgatgaatcttgtgaacgtattatgactatgttatacaagtataaacaaatggatgatttcccaga

SEQ ID NO: 24729 - DNA, 897 bp, Piromyces finnis
  Glyco_hydro_3_N
gtctgaatcagaagatttagctaaagcttttgttgaagaaatgactttagatgaaaagattaacatggttactggttctgaaaatagttttggtccatgtgttggttacattcctccaattgaaagattaggtttcaaaggtttatgtttacaagatggtccagctggtgttcgttctgctaaacattcaaccactttcccatctggtttaaatattgcttctacttttgatcaaaatcttatgaagaaacttggtgttgctcttggtgaagaatgcagagctaagggtgttaacgttattttaggtccagctatgaacatgtaccgttctccagctgctggtagaaactgggaaggttatggtgaagatactttcctcgctactgttgcttcaaagaatgttgttgctggtattcaaagtcaaggtgtttttgctactgctaagcactttgctggtaatgaacaagaatacaagcgtgaatcttctaactctattattgatgaacgtgttttacaagaagtttacttcccaccatttaaggctgctgttgtttctggtgctggtgcttttatgtcagcttataatgatcttaatggtattccatctgctaacaacacttatcttttaaaccaagttttaaagaagcaatttaaattccacggttttgtcactagtgactggtggggtactaaggataagtatgaaattactaatggtttagatgttaatatgccaggtggtaagcaatggggtccaactgaaaaagaaagttactggggagaagaactcaaggctgctattgaaagcgaagaaattgatatttcttatcttgatgaagcttgtgaacgtattttaactatgatgtacaaatacaagcaaatggatgatttcccaga

SEQ ID NO: 24730 - DNA, 897 bp, Piromyces finnis; identical to SEQ ID NO: 24729
  Glyco_hydro_3_N

SEQ ID NO: 24731 - DNA, 258 bp, Neocallimastix californiae
  Glyco_hydro_39
atctggtttaaccaactggtatggtttagaaatctggaatgaaccagatggtacttgggataatgccaatggaagtttcaacgatatgtggaaaaagacttatgaccttattcgtcaagctgatccaggagaaaaaattattggtccatgtttcagttggtatgaagaaaacaaaatgaagaacttcttacaatactgtaaacaaaacaactgtattccagatattattagttggcatgaattaagtggtattgaagg

SEQ ID NO: 24732 - DNA, 252 bp, Neocallimastix californiae
  Glyco_hydro_39
aaaagcttctggtttaaaaaattggtatggttatgaaatttggaatgaagctgaaaatacttggagagattctaacggtttatcgttctttgaaatgtggaaggaaacctatagagttattcgtgaaatggatccagatgaaaaaattattggtccatgtgatggtttatacagtgaacaaagaatgcgtccattcttagaatactgtttaaagaatgatgttatgccagatattatgtgttggcacgaatt

SEQ ID NO: 24733 - DNA, 288 bp, Neocallimastix californiae
  Glyco_hydro_39
atggttagaactagttagacagttcattcgtgataaaaaggctgctggtattaaaaatttctatggttatgaaatttggaatgaagctgaaaacacctggagagattctaatggttatactttctttgaaatgtggaaagaaacctacaaggtcatccgtgaaatggatcccgatgaaaaaattattggtccatgtgatggtttgtacagtgaagaaagaatgcgtccatttttacaatattgtttagataatgatgtcatgccagatattatgtgttggcacgaatt

SEQ ID NO: 24734 - DNA, 270 bp, Neocallimastix californiae
  Glyco_hydro_39
aatttggaatgaaccagatgttacttggaaggattctaatggtttaagtttcaatcaaatgtggaaacaaacctacgatttacttcgtcaaattgatccaaatgaaaaaattattggtccaagtttcagttggtacgaagaaaataaaatgaaaaacttcttacaattcagtaaacaaaataattgtcttccagatattatcgcttggcatgaattaagtggtattgatggtgtctccagtcacttcagaagttatcgtaacttagaaaa

SEQ ID NO: 24735 - DNA, 276 bp, Neocallimastix californiae
  Glyco_hydro_39
gaagtcaggattaaccaattggtatggtttagaaatttggaatgaaccagatggtacttggaaagattctaatggaagtttcaatcaaatgtggaaacaaacatatgatgttattcgtcaagctgatccaggagaaaaaattattggaccatgttacagttggtatcaagaaaataagatgaaagactttttacaattttgtaaacaaaataactgtttaccagatattattagttggcatgaattgagtggtattgaaggagtttctagtcactt

SEQ ID NO: 24736 - DNA, 291 bp, Neocallimastix californiae
  Glyco_hydro_39
  modified_base (13)..(13): a, c, t, g, unknown or other
cattaatgataanaagaagtcaggattaaccaattggtatggtttagaaatttggaatgaaccagatggtacatggagagattctaatggaagttttaatcaaatgtggaaacaaacatatgatcttattcgtcaagctgatccaggagaaaaaattattggaccatgttacagttggtatcaagaaaataagatgaaagactttttacaattttgtaaacaaaacaactgtataccagatattattagttggcatgaattgagtggtattgaaggagtttctagtcactt

SEQ ID NO: 24737 - DNA, 285 bp, Neocallimastix californiae
  Glyco_hydro_39
gttagaattagttagacaattcattcgtgataaaaaggcttctggtttaacaaattggtatggttatgaaatttggaatgaagctgaaaatacttggagagattctaatggctatactttcttagaattttggaaagaaacttataaggtcattcgtgaaatggatccagatgaaaaaattattggtccatgtgatggtttatacgttgaaagtagaatgcgtccatttttggaattttgtaaagaaaatgatgttatgccagatatcatgtgttggcatgaatt

SEQ ID NO: 24738 - DNA, 261 bp, Neocallimastix californiae
  Glyco_hydro_39
ttggtatggttatgaaatttggaacgaaccagatggtacatggaaagattccaatggtatgaactttaatgaattttggaaacaaacttatcaatttattcgtcaaaaagatccaaatgaaaaaattattggtccatgtattagttggtataatgaaaataatattcgttctttcttacaattcgctaaagctaacaattgtcttccagatattattagttggcatgaattaagtggtattgatggtatgtcttcacattt

SEQ ID NO: 24739 - DNA, 291 bp, Anaeromyces robustus
  Glyco_hydro_39
aaaatggttagaattagttagacaattcattcgtgataaaaaggcttctggtttaacaaattggtatggttatgaaatttggaatgaagctgaaaatacttggagagattctaatggctatactttcttagaattttggaaagaaacttataaggtcattcgtgaaatggatccagatgaaaaaattattggtccatgtgatggtttatacgttgaaagtagaatgcgtccatttttggaattttgtaaagaaaatgatgttatgccagatatcatgtgttggcatgaatt

SEQ ID NO: 24740 - DNA, 258 bp, Anaeromyces robustus
  Glyco_hydro_39
ttggtatggttatgaaatttggaacgaaccagatggtacatggaaagattccaatggtatgaactttaatgaattttggaaacaaacttatcaatttattcgtcaaaaagatccaaatgaaaaaattattggtccatgtattagttggtataatgaaaataatattcgttctttcttacaattcgctaaagctaacaattgtcttccagatattattagttggcatgaattaagtggtattgatggtatgtcttcaca

SEQ ID NO: 24741 - DNA, 243 bp, Anaeromyces robustus
  Glyco_hydro_39
tttaacaaattggtatggttatgaaatttggaatgaagctgaaaatacttggagagattctaatggttataactttttagaattctggaaagaaacttataaggtcattcgtgaaatggatccagatgaaaaaattattggtccatgtgatggtttatatagtgaagaaagaatgcgtccatttttacaattttgtaaagaaaataatgtattaccagatattatgtgctggcacgaattaat

SEQ ID NO: 24742 - DNA, 252 bp, Anaeromyces robustus
  Glyco_hydro_39
tggtttaactaattggtatggttatgaaatttggaatgaaccagatggtacatggaaagatcctaatggattaaactttaatgaattttggaaacaaacttatcaataccttcgtcaaattgatccaaatgaaaaaattattggtccagctttaagttggtataatgaagatagaattcgttctttcttacaatatgctaaagctaataattgtcttccagatattatttgttggcatgaattaagtggtat

SEQ ID NO: 24743 - DNA, 294 bp, Piromyces finnis
  Glyco_hydro_39
tattgctgataaaaaaaagtctggtttaaccaattggtacggtttagaaatttggaatgaaccagatggtacatggaaagattctaatggtttaaactttaacgaattttggaaacaaacttaccaagtaattcgtcaaaatgatccaaatgaaaagattattggtccatgtgatagttggtacaatgaaagtagaatgcgttcattcttacaattctgtaaaactaataatgttattccagatattatgtgttggcatgaattaagtggtattgaaaatgtttcaaaccacat

SEQ ID NO: 24744 - DNA, 837 bp, Neocallimastix californiae
  Glyco_hydro_43
caacccaatcatcactcaaaagtatagtgctgatccaggtgttatggtttacaacggtagagtttatgtttatgctactaatgatggtgatgctggtaccagatacaattcagaaaacacttacggacaaattaacactattaatgttatgtcttctgctgatttagttaactggatggatcacggttcaattccagctgctggtggtggtggtgctgctagatgggcatctaactcatgggctccatgtgctgcttggaaaaagattaatggtaaggataagttcttcctttactttgccaataacgctagtggtattggtgttttaactgccgattctccaactggtccattcaaggatccaattggtagagctcttatctcacgtcaaactccaaatagtaatgttgaatggcttttcgatccagctgttatcgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattctggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaaccaccacactattattgaattcaagaataagtactacatcttctaccacgctgaatggcttaa

SEQ ID NO: 24745 - DNA, 813 bp, Neocallimastix californiae
  Glyco_hydro_43
taatccaattatatgggctgatgtacctgatccagatattattagagtagatgatacatattatatggttagtactactatgtacttcactccaggtgctccaattatgaaatcaaaggatcttgtatcatgggaaattgttacttacacctatgatattttagccaatggtgatgttcaaactctttctagaggtcaacatgattattctcatggttcatgggctgcaagtttacgttataataaaggaattttctatgtattctttggtagttatggtacaaataaatcttatatatttaaaactaaggatattgaaagtggaaaatgggaacgttttgaaattaacggaatgtaccatgatgcttccattcttttcgatgatgatggtagaaattacctcgtttatggaggtggtggtgaaattaagattaaggaatttaatgcggaaatgaccaattttaaatggggaggtcttgataaaactttatttagaactaatctttctggtctcgctggtgaaggatctcatgttatgaaaattaatggatattactatgtatttattattgcttggccaagtggtaaaggtcgtattgaaatttgttaccgtagtaaagacctcactggttactatgaaaacaaaacagttttagattcaggattaggttcctatggtagtggtgttgcccaaggtggtattgtagatacccctgatggtaaaaaatggtttggattattattccaagatcatggtgctgtcggtagaattccagttcttgttccagttaattggcaaaatggatggccaat

SEQ ID NO: 24746 - DNA, 843 bp, Neocallimastix californiae
  Glyco_hydro_43
tccaattaatactattaagtacagtgctgatccaggtgtcatggtttatgatggtagagtttatgtttatggtaccaatgatggttatgctggagaattaggaagaaacccacaggataatacttatggtcaaattaatactattaatgttatgtcttctgatgatttagttaattggatcgatcatggtactatcccagctgctggtagaaatggtgctgctaagtgggccggtaactcatgggcaccatgtgctacacacaagaaaatcaacggtaaggaaaagttcttcctttactttgcaaacagtggtaatggtattggtgttttaactagtgattctccaactggtccatttgttgatccaattggtcatgctcttatttctcgtagtactccaaattgttccaatattgtttggttattcgatccagctgtatttgttgatgatgatggtactggttatctttacttcggtggtggtgttccagataatcaatcttctaatccaaagactgttcgtgctgttaagttaggtaatgatatgactagtcttgctggtaatccagttactattgatgctccatgggtatttgaagattctggtattaacaaatccggtgatacttacttctactcatattgtactaactggaatggtggtccatacggtaatgctaagattgcttacatgactagtaagaatccattaggtccatttactatgcaaggaactgttttaaataacccaggtgatttctttggaactactggtaacaaccatcacactatcattgaatttaaggaccaatggtacatcttctatcacgctgaatggcttaa

SEQ ID NO: 24747 - DNA, 834 bp, Neocallimastix californiae
  Glyco_hydro_43
cccaactattactcatagatatagtgctgatcctggtgttatggtttacaatggtagagtttatgtatatgccaccaatgatggtgatgccgctactagatataattcagaaaacacttacgctcaaattaataccattaatgttatgtcatcagctgatttagttaattggatggatcatggttcaattaatgctactggtggtggtggtgctgctaaatgggctaaaaactcttgggccccagctgccgcctggaagaaaattaatggtaaggataagttcttcctttactttgctgataatgctagtggtattggtgttttaactgctgattctccaactggtccattcagggatccaattggtagagctcttatttctcgtcaaactccaaacagtaacgttgaatggcttttcgatccagctgttttcgttgatagtgatggtactggttatctttactatggtggtggtgttccaaaaggtagagaagctaacccaaataccattcgtgttgctaaattaggtggtgatatgactagtatttctggtactccagctaatattgatgctccatgggtatttgaagattctggtattaataagattggtaacacttatgtttactcctactgtactaactggaatggtggtccatacggtaatgctagaattgcttacatgaccagtaacaatccaatgggaaaattcactttccaaggtacctgtttcaacaatccaggtgatttcttccaaactactggtaataatcaccacaccattattgaatttaagaacaaatactacatcttctaccatgctgaatggcttaa

SEQ ID NO: 24748 - DNA, 1026 bp, Neocallimastix californiae
  Glyco_hydro_43
agttcatgatccatctatcgttaaaagtggtaacaaatattatatttttggatctcacatggacgctgcatatactaccgatttatggaaatttacaaaattgtatacaggtgttgatgaaaataataaaatgtttacaaatttattctcaaaatccaactatgatgcatttaaatttgtaggaaagaatagtgatggaggttattctgtatgggcagcagatgttatgtataataagaaaatgaaaaaatgggttcaatatttctgtacttcttctacttatattaaatcaagtctttgttatggtatagctgataaggttgaaggaccatatacttataaaagttgttttctccattcaggtatggattcaggatctgttggcaaaactaatttaagggctattacaggaactgaagataaaaatcgttattatccaaataacagatataacaacaaagtttatccaaatgctattgatccaaatgcattctatgattttaatggtagactatggcttgcttatggttcttggtcaggtggtatttacattttagaattagatgaaagcactggtcttccaaagcataatatttcaaatggtaataatgttgataaatattacggtaagaaacttgcaggtggaggtcatcaatctattgaaggtccatacattttaccatacaaagctgctggatactattatttgtttgtatcatatggtactcttacttcaaatggtggttaccaaattcgtttgttccgttcaaagaatccagatggtccatatactgatgttgctggtaaagaatttatgagtggtactaattcaaactttggtgttaagattatgggtaattatggtattccaggaagagaaaaggcttatatggcaccaggtcacaactctgtattaattgacgatgatggtaaaattttactttgctaccatactcgttttaatgatggtcaagaataccacgaaccacgtgttcaccaaatgttccttaataaggaaggttggtt

SEQ ID NO: 24749 - DNA, 855 bp, Neocallimastix californiae
  Glyco_hydro_43
tccaattattaaggatatgtacactgctgatccagctccaatggtttatggtgataccctttacctttacactagtcatgatgaaactgaacttaagaacaacttctacactatggaaaactggtatgtcttctctactaaggatatggttaactggactaaccatggtcaaatcttgtctttagatgatattgaatgggctgatgaaagagcttgggctccacaaactgttgaaaagaacggtaagttctatttctacttcccagctcacaagattgatggtggtatggctattggtgttgctgttgctgattctccaattggtccattcaaagaaattggacatccaattgtttatgaagatgactggaatgactttgacccaactgttttcattgatgatgatggtaaggcttacttatacttcggtaatccagaacttagatatgttgtcttaaacgatgatatgatttcttatgatgaagaaattggagttgttaaggttccaatgactgaagaatccttcggtaagggtagtcacgataccggtacatcctatgctgaaggtccatacttctacaagagaaacggtctttactacttagtctatgctgctttcagagaaggttctcaaactgaatctcttgcttacgcaacttctgaaaagccaactggtccatggaagtacggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctat

SEQ ID NO: 24750 - DNA, 849 bp, Neocallimastix californiae
  Glyco_hydro_43
tccaattattaaggatatgtacactgctgatccagctccaatggtttatggtgataccctttacctttacactactcatgatgaagatgtacttaagaacaacttctacacaatggaaaattggtatgtcttctctactaaggatatggttaactggactaaccatggtcaaattttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaagaaattggacatccaattgtttacgaagatgactggaatgactttgacccaactgttttcattgatgatgatggtaaggcttacttatacttcggtaatccagaacttagatacgttgtcttaaacgatgatatgatttcttatgatgaagaaattggtgttgttaaggttccaatgacagccgaatccttcggtaagaatggtgatcgtactacttatggagaaggtccatacttctacaagagaaacggtctttactacatggtctttgctgctttcagagaaggtgcttttactgaatctcttggttatgctacttctgaaaagccaactggtccatggaagtacggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctat

SEQ ID NO: 24751 - DNA, 660 bp, Neocallimastix californiae
  Glyco_hydro_43
tccaattattaaggatatgtacactgctgatccagctccaatggtttatggtgataccctttacctttacactactcatgatgaagatgtacttaagaacaacttctacactatggaaaactggtatgtcttttctactaaggatatggttaactggactaaccatggtcaaatcttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaggaaattggacatccaattgtttatgaagatgactggaatgactttgacccaactgttttcattgatgatgatggtaaggcttacttatacttcggtaatccagaacttagatatgttgtcttaaacgatgatatgatttcttatgatgaagaaattggagttgttaaggttccaatgactgaagaatccttcggtaagggtagtcacgataccggtacatcctatgctgaaggtccatacttctacaagagaaacggtctttactacatggtctatgctgccttcagagaaggttctcacactgaatctcttgcttattctacttc

SEQ ID NO: 24752 - DNA, 855 bp, Neocallimastix californiae
  Glyco_hydro_43
tccaattattaaggatatgtacactgctgatccagctccaatggtttatggtgataccctttacctttacactactcatgatgaagatgtacttaagaacaacttctacactatggaaaactggtatgtcttctctactaaggatatggttaactggactaaccatggtcaaatcttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaagaaattggacatccaattgtttatgaagatgactggaatgattttgacccaactgttttcattgatgatgatggtaaggcttacttatatttcggtaatccagaacttagatatgttgtcttaaacgacgatatgatttcttatgatgaagaaattggtgttgttaaggttccaatgactgaagaatccttcggtaagggtggtcacgataccggtacatcctatgctgaaggtccatacttctacaagagaaacggtctttactacatggtctatgctgccttcagagaaggttctcacactgaatctcttgcttattctacttctgaaaagccaactggtccatggaagtatggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctat

SEQ ID NO: 24753 - DNA, 912 bp, Neocallimastix californiae
  Glyco_hydro_43
tccattgtttactcatagatatagtgctgacccaggtgttatggtttataataatagagtttatgtctatgctactaatgatggtgatgttgccactaaatttacagacgataatacctatagtcatattaattcacttaatgtcatgtcttctgaagatttagttaattggacagatcatggttcaatcttagttgctggtaataatggtgctgctaaatgggctggtaattcatgggctccatgtgctacttataaaaaaattaatggaaaggataagttcttcctttactttgctaataatgctaatggaattggtgttttaactagtgattctcctactggtcctttcaaagatccaattggtaaagctcttatcactcgtcaaactccaaattgtggtgatgtcgcttggctttttgacccagctgttttagttgatactgatggtactggttacctttacttcggtggtggtgtaccagacggtaaggatgctgcaccaaaaactattagagttgttaaattaggagccgatatggtaagtcttgccggaactccacaacttattgatactccatatgtatttgaagattctggtataaataaaattggaaatacctattactattcttactgtaccaattggtctgcaggtgaaccttatggacaagctagaattgtttatatgaccagtagtaatccaatgggtccattcacatatcaaggtgtctgtttaaataatccaggagaagatttccaaacttatggaaataatcatcatactattattgaattcaaaaataaatattacattttctatcataccgaatggcttaataagcaagttttcggaactcaaaagggttatcgtacttcctttgttaatgaaattacattcagtaatggcaa

SEQ ID NO: 24754 - DNA, 810 bp, Neocallimastix californiae
  Glyco_hydro_43
aaaccctatcatatgggctgatgttcctgatgatgatatcatcagagttgatgatacttattatatggtaagtacaacaatgttctttagtccgggtgctcctattatgaagtcaaaggatctcttttcatgggaaatttgcaactatgtttatgatatccttgctgatggtgacgttcaaactcttaagaatggaaagcatgattattctcatggtcaatgggctgctagtttacgttatcatgagggtactttttatgtcttctttggtagttatggtactaataagtcatatatctttaaaaccaaagatattgaaaaaggtacttggactcgtaatgaaatctttggtatgtatcatgatgcttcaattctctttgatgatgacggtaggaagtatctcgtctatggtggtagtggtgaaatcaaaattaaagaatttaacaatgaaatgaccgacttcaagagaggtggtgctgataaagttttatttagaactggtctttctggtcttgctggtgaaggttctcatattcaaaaaattggtaaatattactatatatttattattgcttggccaaatggaaagggtcgtattgaaatttgttaccgtagtagagatcttcttggaaattatgaaaacaagattgttcttgattccggtttaggttcctatggaagtggtgtagctcaaggtggaatcgttgatacacctgatggtaaatggtatggtcttttattccaagatcatggttctgttggtagaattccagtacttgttccagtcaattggcaaaatgattggccaat

SEQ ID NO: 24755 - DNA, 411 bp, Neocallimastix californiae
  Glyco_hydro_43
aggtaccggatgtttacgtgatccatacatctttaagggagaggatggattttactatttacttgctacagatatgaagtcttcccttggttggaatagtaatcgtaatcttttaagtgcaaaatcaatggatcttatccattggactggtataactattattgaaattgctaataagtatcctctcatgaaaggagctgatcgtgcgtgggctcctcaagccatctatgatcgtgaaaagggctcctatatgatatactatgctgctagagttcctggaagggataatagaactataatgtattatgcttatagtaaggacatgaaaagacttgagactgatcctcaagttttatttgctccagctaatggtaatgatgctattgattctgatattattttccaaaatgg

SEQ ID NO: 24756 - DNA, 837 bp, Neocallimastix californiae
  Glyco_hydro_43
aaatcctttaattactcatagatatagtgcagatccaggtgttatggtttacaatggtagagtttatgtttatgcaactaatgatggtgatgttgctaatagaaatgttggtgaaaataaatatgatcaaattaatactattaattgtatgtcatctgatgatttaattaactggatggatcacggaccaattccagctgctggtggtaatggtgctgccaaatgggctaaaaattcatgggctccaactgctgcttggaagaaaatcaatggtaaggataagtttttcctttactttgccaataacgctagtggtattggtgttttaactgccgattctccaactggtccattcaaggatccaattggtagagctcttatctcacgtcaaactccaaatagtaatgttgaatggctttttgatccagctgtttttgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattcaggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaatcaccacactattattgaattcaagaataagtactacatcttctaccacgctgaatggcttaa

SEQ ID NO: 24757 - DNA, 411 bp, Neocallimastix californiae
  Glyco_hydro_43
aggtactggttgtattcgtgatccctttattttaaagggtcaagatggttattattatatgttggctactgatatgagatcgtacagtggctgggatagtaatcgtaatattttaagtgcgaagtcaaaagatttaatacattggaatgatgtcacaagtatagaaattgctaataaatatcctcttactcaaggagctgatcgtgcctgggctccacaagctatctatgatcatgaaaagaattcttatatgatctattttgctgttagagttccaaaccgtggtaataaaaccattatgtattatgcttatagtaaggacatgaaaaaattagatactgctccagcccttttattccaaccaagaaatggtaatgaagctattgattctgatattattttccaaaataa

SEQ ID NO: 24758 - DNA, 843 bp, Neocallimastix californiae
  Glyco_hydro_43
tccaatcaatgtattaaagtacagtgctgatccaggtgttatggtttatgatggtagagtttatgtttacgctactaatgatggtattggtgaaaatattggaaataacccaagagataacgattacagtcacattaacactattaatgttatgtcatctagtgatatggtaaactgggttgatcatggtacaattccagctgctggtaacagtggtgctgctaagtgggctggtaattcatgggctccatgtgctgctcacaaaaagattaatggtaaggaaaagttcttcctttactttgctaatagtggtaatggtattggtgttttaactagtgactctccaactggtcctttcgttgatccaattggtggaccacttgtttctcgtagtactctaaactgtaacagtattgtttggttatttgatccagctgttatggttgatgatgatggtactggttatctttacttcggtggtggtgttccagaaaatgctaagtctaacccaaaaactgttcgtgcagttaaattaggtaatgatatgattagtcttgctggtactccacaaactattgatgctccatgggtcttcgaagattctggtattaacaaggctggaaacacttacttctattcttactgtactaactgggataatggaccatacggtaatgctaagattgcttacatgactagtagcagtccattaggtccattccaataccaaggtactgttcttaacaacccaggagatttctttggaactgttggtaacaatcaccacaccattattaacttcaagaacaaatggtatatcttctatcacgctgaatggcttaa

SEQ ID NO: 24759 - DNA, 369 bp, Neocallimastix californiae
  Glyco_hydro_43
tgttcatgatccgtctgtagttaagtatggtaataaatattatatatttggttcccacatggatactgcctatactaccgatttatggaagtttactaaattgtatactggtgttaatgataacaataaaatgtttacaaatttattttcaaaatcaaattatggtgcatttaattttgtaggaaaaaatagtgatggtggttattctgtttgggctcctgatattatatataataatagaatgaaaaaatgggttcaatatttttgtacatcttccacatatattaaatctagtatttgttacgctttagctgataacgttgaaggtccatacacttataaaaattgctttattttctctggtatgga

SEQ ID NO: 24760 - DNA, 558 bp, Neocallimastix californiae
  Glyco_hydro_43
caatgcaattgatccaaatgcattttatgattttaaggggaagttatggcttgtttatggttcttggtcgggtggtatatatattttagaattagatgaaagtacaggtcttccaaaacacaatatttctaatggcaataatactgatagatactatggtaagaagcttgcaggtggtaatcaccaatctattgaaggtccatttattttaccacacaaagctgttggttattattatttatttgtatcctatggctctcttacgtcaaatggtggttaccaaattcgtatgttccgttctaaaaatccagatggtccatatacagatgttgctggaaaagaatttatgagtggtaataattcaagctttggtgttaaagtcatgggtaattataatattcctggaagagaacaggcatatatggctccaggccacaattctgctttacttgatgatgatggtaaagtgttaatattctatcatactcgttttaatgatggtcaagaatatcacgaaccacgtattcatcaaatgtttcttaataaggaaggatggtt

SEQ ID NO: 24761 - DNA, 825 bp, Neocallimastix californiae
  Glyco_hydro_43
caacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaata

SEQ ID NO: 24762 - DNA, 843 bp, Anaeromyces robustus; identical to SEQ ID NO: 24758
  Glyco_hydro_43

SEQ ID NO: 24763 - DNA, 843 bp, Anaeromyces robustus
  Glyco_hydro_43
caacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaatacaataaggatggtagtat

SEQ ID NO: 24764 - DNA, 807 bp, Anaeromyces robustus
  Glyco_hydro_43
tccaattatctgggcagatgtacctgatccagatattattagagttgatgatacttactatatggtaagtactactatgttttttaatccaggtgctccaataatgaaatcaaaagatcttgtttcatggaaaatttgtaattatgtttatgataaacttgctgatggtgatgttcaaaatcttgcaagaggtcaacatgattattctcatggtcaatgggctactagtttacgttatcataaaggaactttctatgttttctttggtagttatggtactaataaatcttacatttttaaaacaaaagatatagaaaatggtccatggactcgtactgaacttggtggtatgtatcatgatgcttctatgatttttgatgatgatggtagaaattatcttgtttatggagctggtggtgaaattagaattaaagaatttaattctgaaatgaccgattttaagagaggtggtgccgataaaattttatttagaactaacctttcaggtcttgctggtgaaggttctcatgttcaaaaaattaataattattattatattttcattattgcttggccaaatggtaaaggtcgtattgaaatttgttaccgtagtaaagatattcttggtaattatgaaagtagaactgtattagattctggtgttggttcttatggtagtggtgttgcccaaggtggtattgttgatactccagaaggtaaatggtatggtttacttttccaagatcatggttctgttggtagaattccagttcttgttccagttaactggcaaagtgattggccaat

SEQ ID NO: 24765 - DNA, 906 bp, Anaeromyces robustus
  Glyco_hydro_43
taacccagtagtttctcacagatacagtgcagatccaggtgctatggtttatgatggtagagtttatatttatggtagtaatgatggtaatgttgctgaaagacaaggtaaaacaaatgattattctcaaattaaaacaattaatcttttatcatcatctgatttagttaattggatggatcacggtccaattccagcaactggacaaagtggtattgctaaatttgctagtaattcatgggctccagctgcttgtcacaaaaaaattaatggtaaagaaaaattctttgtttactttgctaacaatgctagtggtatttgtgttttagaatctgattctccaactggtccattcaaggatcctcttggaaaaccacttattactagacaaactccaaactcaaatgtagaatggcttttcgatccagcttgtttagttgatgatgatggtactggttacctttacttcggtggtggtgttccaaatggtcaagccgctaacccaagaactgttcgtgttgtcaaattaggagctgatatgaagagtcttgctggaaccccacaaacaattgatgctccatgggtattcgaagattctggtattaataaggttggtaacacttactactacaactattgtaccaactttaatggaggtccatacggtaatggtagaattgcttacatgagtagtaacagtccaatgggtccattcagttacaagggtacttgctttaacaaccaaggtgatttcttacaagatggtggaggtaacaatcaccacactattattgaatttaagaacaaattttacatggtctatcacgctcaatggcttgatatgaaggttaaaggtaaatcaaatggataccgtactactcacattgatgaattaccaatgaatgg

SEQ ID NO: 24766 - DNA, 1026 bp, Anaeromyces robustus
  Glyco_hydro_43
cgttcatgatccatctgttattaagaatggtaataagtattatattttcggttcacatatggatactgcttatactaccgatttatggaaatttactaaattatatacaggtgtcaatgaaaataatagaatgtttactaatttattctctaaatcaaattatggtgcattcaattttgttggtaaaaacagtgaaggtggatattctgtatgggctccagatgttatgtataacaaaaaaatgcgtaaatgggtacaatatttctgtacatcttctacttatattaaatcaagtatttgttatgctttagctgataatgttgaaggtccatacacttatcaaagttgtttcattttctctggtatggattctggaagtgttggaaagactaatttaagagctgttactggtactgaagatggaaatcgttattatccaggtaataaatataataatagagtttatccaaatgctattgatccaaatgtattctatgatttcaatggtagactttggcttgcttatggttcatggtctggaggtatttacattttagaattagatgaaagtacaggtcttccaaaacataatattagtaatggtactaatattgataaatattatggtaagaaacttgctggtggtggtcaccaatctattgaaggtccatacattttaccatataaagctgctggttattactatttatttgtttcatatggtactcttacttctaatggtggttaccaaattcgtttattccgttctaaaaacccagatggtccatatactgatccagctggtaatgaattcatgggtggtactaattcaaactttggtcttaagcttatgggtaattacaatattccaggtagaagtcaagcctatatggctccaggtcataattctgctatgattgatgacaatggaaaggttttaatgttctatcatactcgtttcaatgatggacaagaatatcatgaaccacgtgttcatcaattattccttaataaggaaggttggtt

SEQ ID NO: 24767 - DNA, 399 bp, Anaeromyces robustus
  Glyco_hydro_43
tttacgtgatccttatatttttaaaggtgaagatggtttatattatttacttgctacagatatgaaatctgcacttggttggaatagtaatcgtaatcttttaagtgcaaaatctaaagatcttattaattggtatgatacaacaagtatagaaattgccaataaatatcctttaatgcaaggagctgatcgtgcatgggctccacaagcgatttatgatccagaaaaaaaatcttatatgatttattatgctgcaagagttcctggacgtgataatagaactattatgtattatgcttatagtaaagatatgaaaaaattagatacagcaccagccttattatttgctccaagtaatggtaatgatgctattgattcagatattattttccaaaatgg

SEQ ID NO: 24768 - DNA, 834 bp, Anaeromyces robustus
  Glyco_hydro_43
tcctttaataactcatagatatagtgctgatcctggtgttatgatttacaatgatagagtttatgtatattcaaccaatgatggagatgttgatcttaataataaaaatgttaatggaaatacctatgaccatattaaaagtcttaatgttatgtcttcttcagatttagttaattggcaagaccatggttctattaatgttgcaggtggtgctgctaaatgggctcaatattcatgggctccatgtgctacctataaaaaaattaatggtaaagataaatttttcctttactttgctaataatgctaatggtgttggtgttttaactagtgattctccaactggtcctttcactgatccaattggtaaagctcttatttctcgtgatacaccaaattgtggtgatgttacttggctttttgatccagctgttttagttgatgatgatggtactggttatctttactttggtggtggtgtaccaaatggtatggatgctaatccaaaaactattcgtgttgttaaattaggaagtgatatgattagtcttgctggtcaaccacaattaattgatgctccatacgtttttgaagattctggtattaataaaattggtaatacctatttctattcttattgtactaattggactggtggtcaatatggtggtgctaatattgcttttatgactagtaatagtccaatgggtccatttaaagctggaagttcctgtttcaaaaatccaggagaatttttaggtaattatggtaataatcatcatactattattcaatttaaaaataaatggtacattttctatcataccgaatggct

SEQ ID NO: 24769 - DNA, 465 bp, Anaeromyces robustus
  Glyco_hydro_43
aggtacaggatgtttacgtgatccatttattcttaaaggtgaagatggtacttactttttattagccactgatatgagatcttatagtggttgggatagtaatcgtaatattttaactgctagatctactgacttaattcattggacaaacgtttctcttattgaagtttgtaataaatatcctattttccaaagaggtgatcgtgcttgggctccacaagcaatttacgatccagaaaaacaagcttatatgatatactttgctgttagagttccaagtaatggtaacaaaactattatgtattacgctcatagtaaggatatgactagatttgataccaccccacaacttttatttgctcctaagaatggtaatgaagctattgatgctgatattatttaccaaggtggtagatattatatgtattataaagatgaaacaagaaaaactattaatttagctct

SEQ ID NO: 24770 - DNA, 852 bp, Anaeromyces robustus
  Glyco_hydro_43
aaatccattgattactcatagatatagtgcagatccaggtgttatggtttacaatgatagagtttatgtttatgccacaaatgatggtgatgttgctaatagaaatgttggtgataatacatatgaacaaattaatactattaattgtatgtcttcagatgatttagttaactggactgatcatggaccaattgctgctgctggtcaaggtggtgcagctaaatgggctaaaaattcatgggctccaactgctgcccataaaactattaatggtaaggaaaaattcttcctttactttgctaacagtggtgctggtattggtgttttagttagtgactctccaactggtccattcactgatccaattggtaaagctcttattactccacaaactccaaattgtgctagtgttacttggcttttcgatcctgctgttttagtcgatactgatggtactggttatctttactttggtggtggtgtcccacaaggtcaagatgctaatccaaaaactattcgtgttgttaaattaggtccagatatgacaagtcttgctggtaatccagaaactattgatgctccatgggtattcgaagattctggtattaataagattggtaatacttatgtttactcttactgtactaactgggctaatggtccacatggtaatgctagaattggttatatgacaagtaatagtccaatgggtccattcactttccaaggtacttgtttcaacaacccaggtgatttcttccaaactactggtaataatcatcacactattattgaattcaagggtaaatattatatcttctatcacacagaatggcttaacaaacaagtttt

SEQ ID NO: 24771 - DNA, 894 bp, Anaeromyces robustus
  Glyco_hydro_43
aaatccaataattactcatagatatagtgctgatccaggtgttatggtttataatggtagagtttatgtttatgccactaatgatggtgatgttgctaatagaaatgttggtgataatacatatgaacaaattaatactattaattgtatgtcttcagatgatttagttaactggactgatcatggaccaattaaggctgctggtcaaggtggtgcagctaaatgggctaaaaattcatgggctccacatgctgctcacaaaactattaatggtaaggaaaaattcttcctttactttgctaacagtggtgctggtattggtgttttagttagtgattctccaactggtccattcactgatccaattggtaaagctcttgttactccacaaactccaaattgttctagtgttacttggcttttcgatcctgctgttttagttgattctgatggtactggttatctttactttggtggtggtgtcccacaaggtcaaaattctaatccaaaaactattcgtgttgttaaattaggtccagatatgacaagtcttgctggtaatccacaaactattgatgctccatgggtatttgaagattctggtattaataaggttggtaatacttatgtttactcttactgtactaactgggctaatggtccatatggtaatgctagaattgcctatatgacaagtaacagtccaatgggtccattccaatatcaaggtacttgtttcaacaacccaggtgatttcttccaaactactggtaataatcatcacactattattgaatttaaggataaatattatatcttctatcacacagaatggcttaacaaacaagttttaggtagtcaaaagggttatcgtaccactcatgttaatgaaat

SEQ ID NO: 24772 - DNA, 843 bp, Anaeromyces robustus
  Glyco_hydro_43
aatgtacacagctgatccagctccattaattgttgatgatactctttacatttacactactcatgatgaagatgttcttataaacaatttctatactatgagagattggtatgtattctctactaaggatatggttaactggactaatcatggtccaatcctctctttagatgatattacttgggctgatgacagagcttgggctccacaaactattgaaagaaatggtaaatactacttctattacccagctcataagattgatggtggtatggctgttggtgttgctattggtgactctccagttggtccattcaaagatattggcgaaccacttgtttatcaagatgattggattgatttcgatccaactgttttcattgatgatgatggtcaagcctacttatactttggtaatccacaacttagatatgttctcttaaatgaagatatggtttcttacaatgaagaagttggtattgttgatgttgaattaactgttgaaggttttggtgaaggtaataataacccaacctcttatgatgaaggaccattcttctataagagaaatggtatttattatatgttattctctggtttcagaaagggttacgaatctgaatacattggttacgctacttcaacttctccaactggtccatggaagtatggtggtattcttatggaagaacatgaagacaaaactttcactaatcactcatctattgttgaattcaatggtcacacctacttcttcttccacactggtgaccttccagatggtggtgacttccacagaagtgttgcttacatcgaatttgaatacaatgaagatggttccat

SEQ ID NO: 24773 - DNA, 843 bp, Anaeromyces robustus; identical to SEQ ID NO: 24772
  Glyco_hydro_43

SEQ ID NO: 24774 - DNA, 438 bp, Piromyces finnis
  Glyco_hydro_43
ttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtcta

SEQ ID NO: 24775 - DNA, 582 bp, Piromyces finnis
  Glyco_hydro_43
aggtactggatgtttacgtgatccatatatttttaaaggaaaggatggatattactatttattagcaacagatatgaaatctgctttaggttggaatagtaatcgtaatattttaagtgcaaaatcctctgatcttattcattggacgaatgaaagtagtatagaaattgctaataagtatcctttaatgcaaggagctgatcgtgcctgggctcctcaagccatctatgatcctgaaaaagattcctacatgatttattttgctgcccgagtccctggtcgtgataaccgaaccattatgtactatgcctacagtaagaatatgcaaaaattagatacagccccacaattgttatttgctccaagtaacggtaatgatgccattgattccgatattattttccaaaacaataaatattacatgtattataaaaatgaaaccaacaaacgtatttatttagctaccgctagtcacgcaagtggtccatacagtgaaataaaacaagtttctgaaggaaatattggtgttgaaggacctaatatttatcaacttcaaggtaccaataaatggcttatgatgtc

SEQ ID NO: 24776 - DNA, 411 bp, Piromyces finnis
  Glyco_hydro_43
aggtactggatgtattcgtgatccatttatcttaaagggtcaagatgattattactatttattagctactgatatgaaatcttacttaggttgggacagtaaccgtaatattttaactgcaaaatcaaaggatcttattcattggaatgatgttaccagtattgaaattgctaataaatatcctttaactcaagctgctgatcgtgcctgggctccacaggctatttatgatccagaaaagaaatcttatatgatctattttgctgttagaactccaggaaatggtaataaaactattatgtactatgcctacagtaaggatatgaaaaaattagatactgctccagctcttttatttgcaccaagaaatggtaacgaagccattgattctgatattattttccaaaacaa

SEQ ID NO: 24777 - DNA, 849 bp, Piromyces finnis
  Glyco_hydro_43
cactaatatgtacactgctgatccagctccaatggtttacggtgataccctttacctttacactactcacgatgaaaacaaccttaaaaacaatttctacactatgcttgattggtacgttttctccactaaggatatggttaactggactaaccatggtaagattttctctttagatgatattagctgggctgatgacagagcttgggctccacaagctattgaaagaaacggtaaattctacctttactgtccagttcacaaaactaacggtggtatggctattgctgtcggtgtttctgacaagccaaccggtccatttaaggatattggtcatccacttgttgatgaaggtgactggaacgatattgacccaactgttttcattgatgatgatggtcaagcttacttatacttcggtaacccagaacttagatatgttcttttgaacgaagatatgatttctatcaataaatctgttggtgttaagaagattaagatgactgaagaagccttcggtaagggtagtcacgataccggtacaacttatggtgaaggtccatacttctacaagagaaacggtatttattacatggcctatgctgccttcagacaaggtaagaacattgaatctcttggttactctacttctacttctccaactggtccatggaagtacggtggtccacttatgactgaagaaggtggtgctttcactgttcacccaggtattgttgatttcaagggtcattcttacctcttctaccacactggtgaacttccaggtggtggtgacttccacagaagtgttggtttcgctgaattcagatataataaggatggttctat

SEQ ID NO: 24778 - DNA, 1026 bp, Piromyces finnis
  Glyco_hydro_43
tgttcacgatccatctgttgtcaaaaatggtaataaatattatattttcggttctcatatggatactgcttttactactgatttatggaagtttacaaagttatatacaggtgttaatgaaaacaataaaatgttttcaaatttattctcaaaatcaaattatggtgctttcaactttgttggtaaaaatagtgaaggtggattctcagtttgggctccagatgttatgtttaataagagaatgaataaatgggttcaatatttctgtacttcttctacatatattaaatccagtatttgttatgctttagctgataatattgaaggtccatacacttataaggattgcttcatcttctctggtatggattcaggtagtgttggtaaaacaaatattagagctattactggtagtgataacggtaatcgctatttcccaggtaacaaatacaataataaggtctatccaaatgccattgatccaaatgcattctacgatttcaatggtaaattatggttggcttatggttcatggtctggtggtatctatatcttagaattagatgaaagtactggtcttccaaaacataacatcaataatggaaataacatagataaatactatggtaagaagttagctggtggtaatcatcaatctattgaaggcccatacattttaccacataaagctgctggatattactatcttttcgtttcctatggtactcttacatctaacggtggttaccaaattcgtttattccgttcaaagaacccagatggtccatatactgatgctgctggtagagaatttatgagtggtactaattccaactttggtgtcaagattatgggtaattacaatattccaggaagaagccaagcttacatggctccaggtcacaattctgctttaattgatgacaatggaaaaatcttactcttctatcacactcgtttcaatgatggtcaagaatatcacgagccacgtattcatcaaatgttccttaacaaggaaggatggct

SEQ ID NO: 24779 - DNA, 840 bp, Piromyces finnis
  Glyco_hydro_43
cccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggct

SEQ ID NO: 24780 - DNA, 852 bp, Piromyces finnis
  Glyco_hydro_43
cccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtcta

SEQ ID NO: 24781 - DNA, 846 bp, Piromyces finnis
  Glyco_hydro_43
gaatccattaattacccacagatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaa

SEQ ID NO: 24782 - DNA, 855 bp, Piromyces finnis
  Glyco_hydro_43
cccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtcta

SEQ ID NO: 24783 - DNA, 840 bp, Piromyces finnis; identical to SEQ ID NO: 24779
  Glyco_hydro_43

SEQ ID NO: 24784 - DNA, 852 bp, Piromyces finnis; identical to SEQ ID NO: 24780
  Glyco_hydro_43

SEQ ID NO: 24785 - DNA, 858 bp, Piromyces finnis
  Glyco_hydro_43
gaatccattaattacccacagatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtattggtgttttaagtagtgattcaccaaccggtccatttaccgatccacttggtggaccaattatttcacgtagtcttccaaactgtaataacattgtttggttatttgatccagctgtttttgttgatgatgatggtacaggttacatttactttggaggaggtgttccagaaggacaatctagcaatccaaagacagtccgtgctgccaagttaagtgatgatatgattagaatttccggtactccacaaaccattgatgctccatgggtctttgaagattcaggtattcacaagtatggcgatacttacttctactcctactgtactaactgggataatggaccatacggtaatgccaagattgcctacatgaccagtaagagtccattaggaccattcacataccaaggtactcttttcaacaacccaggtgaattctttggtactactggtaacaatcaccacactattattgaattcaagggtaagtggtacatcttctaccacgctgaatggctcaatgtccaagtcta

SEQ ID NO: 24786 - DNA, 837 bp, Piromyces finnis
  Glyco_hydro_43
cccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggct

SEQ ID NO: 24787 - DNA, 843 bp, Piromyces finnis
  Glyco_hydro_43
cccagtcaacactcttaaattcagtgctgatccaggtgtaatggtttatgatggtagagtttacgtttatgctactgatgatggtcatgttgatcaattaggtaacaacccagaaactaacacttatggacaaattaacaccattaatgttatgtcttctgatgatttagttaactggattgaccatggttccattccagcagcaggtagaaatggagcagctaagtgggctaacaactcatgggcaccaaccgcagctcacaaaaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggataatggaccatatggtaatgctagaattgcatacatgactagtaacagtccaatgggaccattcagttacaaaggtacatgtttcaacaatccaggagatttcttccaaactactggtaataatcaccacactattattgaatttaaaaacaaatattatattttctatcacactgaatggcttaa

SEQ ID NO: 24788 - DNA, 855 bp, Piromyces finnis; identical to SEQ ID NO: 24782
  Glyco_hydro_43

SEQ ID NO: 24789 - DNA, 855 bp, Piromyces finnis
  Glyco_hydro_43
cccacttagtactcttaaatacagtgctgatccaggtgttatggtctatgatggtagagtttacgtttacggtactaatgatggtcatgccgatgagttaggtgataatccagaagataacacttaccaacaaattaacactattaatgttatgtcttctgacgatttaattaactgggttgatcacggttccattccagcagccggtgaaaatggtgctgctaagtgggctgtcaactcatgggctccagctgctgctcacaagaagattaatggtaaggaaaagttcttcctttactttgctaacagtggtaatggtgttggtgttttaagtagtgattctccaacaggtccatttgttgatccaattggtggaccacttgtttcatttgatgttccaaactgtggtgatattgtttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtcta

SEQ ID NO: 24790 - DNA, 858 bp, Piromyces finnis; identical to SEQ ID NO: 24785
  Glyco_hydro_43

SEQ ID NO: 24791 - DNA, 843 bp, Piromyces finnis; identical to SEQ ID NO: 24787
  Glyco_hydro_43

SEQ ID NO: 24792 - DNA, 597 bp, Neocallimastix californiae
  Glyco_hydro_45
taagactactcgttactgggattgttgtcttgcatcatgttcatggcaagaaaacactaagaaagctggagctagtggtgttgttagatcatgtagcaaagatggtatgactccatttactgatctttctaatctctggagagttaagagtggatgtgaaggtggttctgtctacatgtgtaatgaccaacaaccatgggctgttaacgacaacgttgcttatggttttgttgcttctcacgaaaagtgttgtacttgtcaacgtcttaagttcacttctggtccagttgctggtaagcaaatgattgtccaaactaccaacaccggtggtgatctttcttccaaccacttcgatattcaaatgccaggtggtggtttcggtatctttgatggatgtacctcacaattcggaggaggtcacaactggggtgaacgttatggtggtattaagagtgcttctgaatgtgctaaccttccatctgtcttaaagcaaggttgtgaatggagattcaactggttcaagaatgctgataacccaaatgttgtttttgaacgtgtccaatgtccaaaggaacttactgacattactggttgtgt

SEQ ID NO: 24793 - DNA, 603 bp, Neocallimastix californiae
  Glyco_hydro_45
gggtaccactaccagatactgggattgttgtaaaccatcatgtgcttggccaggtaaattcgaatacaagactaatattaaattatgtgctgccgatggaagtgcacttctcgataataatttaatttctggatgtgaaggtggcccaacttatacttgtgaagatcaaactccatgggctgttgatgacgttactgcttatggttatgctgccgctaacattccaggtttaactgaagctgattggtgttgtacttgttatgctttaactttcacttccttcccaattaagggtaagcaaatgattgttcaaattacaaacactggtggtgatttaggtgaaggtcacttcgatcttcaaattccaggtggtggttttggtttattcaatggttgttctccaagatacccagatattccagatgaagactggggtgaccgtaatggtggtgttacttctcgtgaaggttgttacaagttaccagtaagtatgcaagaaggttgtctcttcaaatttgactggttcagaggagctgataatccagaagttacttatgttaaggttgactgtcctcaagaattaattgatgtcagtggatgtac

SEQ ID NO: 24794 - DNA, 603 bp, Neocallimastix californiae
  Glyco_hydro_45
aggtactaccactcgttactgggattgctgtaagccatcttgttcatggccagacaaggcaccagtttctgctccagttagacaatgtaaggctgatggttttaccgctcttaccaactataatgctaagtctggttgtgaaggtggtgaatcttacatgtgttctgaccaaagaccatgggctgtttctgaagttttatcatatggttatgctgctgcttctatcaaaggtttaaccgaaaaggaatggtgttgtcgttgttatgccttaactttcacctctggtccagttaaaggtaagcaaatggttgtccaagttactaacactggtggtgatcttggtgataatcactttgatattcaaattccaggtggtggtttcggtattttcaatggttgttctgcacaatttaatactcctgatgaagtttggggtactcgttacggtggtgtcgctagccgtgatgattgtgaaggtcttccagaagctattaaagagtcttgctactggagattcgactggttcctcaatgctgataacccaactatggtctttgatgaagttgaatgtccagttgaattaactagaaataccgactgtat

SEQ ID NO: 24795 - DNA, 612 bp, Neocallimastix californiae
  Glyco_hydro_45
tgttaccactcgttactatgattgttgtaaaccatcttgttcatggccaggtaaggctgatgtcttccatccagtaagacattgtactgttgatggtactactcttattgaagatcaagaagctccatctgcttgtcaaaaggatgttgttggtactgctcatatgtgtgaaaaccaacaaccatgggctgtaagtgactcactttcatacggttttgctgctgctgctttaccaggtggtgaatctgtttcctgctgtaaatgctatgctttaactttcattgatccaccaattcgtggtaagcaattagttgttcaagttactaacactggtgctgatgtcggttctaaccaattcgatcttcaaattccaggtggtggtgtcggtattttcgatgcttgcactaacatgtatggtttacctgctggttcaaatggttggggtaaacaatatggtggtattactggtattgaagattgtgaaaccttcccagaatccttaaaggaaggttgtaaatggagattcaactggttattaggagctgataacccaagaatgaaatttgccgaagttgattgtccaaaagaacttactgatattactggttgtat

SEQ ID NO: 24796 - DNA, 615 bp, Neocallimastix californiae
  Glyco_hydro_45
gggtgttacaactcgttactacgattgttgtaaaccatcttgttcatggccaggtaaggctgacgttactcaaccagtcagacaatgtgctgtcgatggtaaaactcttttaactgatttcagtgctccatccgcttgtcaaactgatgttgaaggtatttctcacatgtgtgaagatcaacaaccatgggctgttagtgatgtcttatcttacggttttgccgctgctgctttaccaggtggtgaatctaaatcttgctgtgcttgttatgctattaccttcagtgaaccaccaattagaggtaagcaaattgttgtccaagttactaataccggttctgatgttggttccaaccaatttgatcttcaaattccaggtggtggtgttggtatttttgatgcttgtaccaacatgtacggtttaccagctggttctaatggttggggtaagaaatatggtggtatttccagtatcgaagactgtgattccttcccagaagctttacaagctggttgtcgttggagattcgaattcttattaggtgctgataatccaaagatgacctttgttgaagttgaatgtccaaaggttcttactgatattactggttgtat

SEQ ID NO: 24797 - DNA, 600 bp, Neocallimastix californiae
  Glyco_hydro_45
taagactacacgttactgggattgttgcaaaccttcatgtgcttggaactataaagccaacgtaagtaaggaagttaattcctgttacagggatggttccattgtatctattccatggattacaagtggttgtggaggtggtgatgccttcatgtgtaacgatcaacaaccatgggctattaatgataagttatcctatggttttgctgctgctaatatttctggtagtgatgaagaacattggtgttgtgcttgtttcaaaattacatttactagtacttcaattgcaggtaaggaaatgattgttcaagttacaaatactggtggtgatcttggtgaaaatcatttcgatattcaaatgccaggtggtggtcttggtcttttcgatggttgttccccacaatttggtgttgatgcatctaaatggggtgaacgttatggtggacttacttctgaagctggctgtgataatttaccaaaagttcttcaaccaggttgtcactggagattcggttggtttgaaaacgctgataatccagctatggaatttgaagaagttgaatgtccagctgaattaattaagattactggttgtgctcg

SEQ ID NO: 24798 - DNA, 612 bp, Neocallimastix californiae
  Glyco_hydro_45
tgttactactcgttactacgattgttgtaagccatcttgttcatggccaggtaaggctgatgttttccatccagtaagacactgtaaagttgatggtactactcttattgaagatcaagaagctccatctgcttgtcaaaaggatgttgttggtactgctcatatgtgtgaaaatcaacaaccatgggctgtaagtgactctctttcatatggtttcgctgctgctgctttaccaggtggtgaatctgtttcctgttgtaaatgttatgctttaacattcactgatccaccaattcgtggtaaacaattagttgttcaagttactaacactggttctgatgttggttctaatcaatttgatcttcagattccaggtggtggtgtcggtattttcgatgcttgtactaatatgtatggtttaccagctggttcaaatggctggggtaaacaatatggtggtattactggtattgaagattgtgaatccttcccagaatccttaaaggaaggatgtaaatggagattcaactggttattaggagctgataatccaaaaatgaaattcgctgaagttgaatgtccaaaagtacttactgatattaccggctgtat

SEQ ID NO: 24799 - DNA, 606 bp, Neocallimastix californiae
  Glyco_hydro_45
taagaccactcgttattgggattgttgtcttgcttcttgttcttggtccgaaaacactaatgcttctcacccagtaaatgcctgtcaaaaggatggtaaaactgttttcaacaagttcgattggactattggtagtgcttgctctggtggtcaaggttatatgtgtactgacaatcaaccatgggctattaatgacaacgtttcatatggttttgttgccgctggtttcagtagcggtagtcaaaaggattggtgttgtacttgtcaaagacttgaattcacttcaggtccagttgctggtaagcaaatggttgtccaaattactaacactggtggtgatctttctaacaatcatttcgatattcaaatgccaggtggtggtgttggtatctttaatggatgtcaatctcaattcggagctccaagtgatggttggggtgaacgttatggtggtgttaagtctgcttctgactgtagtagtcttccagccgaattacaagatggttgtaagtggagattcgattggttcaagaatgctgataatccatccgttactttcgaacgtgttcaatgtccaaaagaacttactgatattaccggctgtat

SEQ ID NO: 24800 - DNA, 603 bp, Neocallimastix californiae
  Glyco_hydro_45
aggtactactactcgttactgggattgttgtaagccatcttgttcatggccagacaaagcacctgtttctgctccagtcagacaatgtaaggctgatggtttcactgctcttacaaactacaatgctaaatctggttgtgaaggtggtgaatcttacatgtgttcagaccaaagaccatgggctgtttctgaagttttatcctatggttatgccgctgcctctatcaagggtttaaccgaaaaggaatggtgttgtcgttgttacgctttaaccttcacttctggtccagttaagggtaagcaaatggttgtccaagttactaacactggtggtgatcttggtgataatcactttgatattcaaattccaggtggtggtttcggtatcttcaacggttgttccgctcaattcaatactccagatgaagtttggggtactcgttacggtggtgttgccagtcgtgatgattgtgaaggacttccaaaagaaattcaagaatcttgttactggagattcgattggttccttaacgctgataacccaaccatggtcttcgatgaagtagaatgtccagctgaattaactaagaatactgactgtat

SEQ ID NO: 24801 - DNA, 606 bp, Neocallimastix californiae
  Glyco_hydro_45
taagacaactcgttactgggattgttgtcttgcttcttgttcatggagtgaaaataccaatgctaaacatccagttaatgcttgtcaaaaggatggtaagaccgttattaataacttcagttatttaattggtagtgcttgttctggtggtagtggttacatgtgtagtaataatcaaccatgggctattaacgacaacgtttcctatggtttcgttgctgctggtttcagtagtggtagtcaaaaggattggtgttgtacttgtcaaagacttgaattcacttctggtccaattgctggtaaacaaatggttgtccaaattactaacactggtggtgatctttctaataatcactttgatattcaaatgccaggtggtggtgttggtatcttcaatggttgttcttctcaatttggtgctccaaatgatggttggggagaacgttatggtggtgtcaagtcagctgctgactgtagccaacttccaactgaattacaagaaggttgtaaatggagatttaactggttcaaaaatgctgataatccatccgttacttttgaacgtgttcaatgtccaaaagaacttactgatattactggttgtgt

SEQ ID NO: 24802 - DNA, 588 bp, Neocallimastix californiae
  Glyco_hydro_45
tactactacaggttactgggattgttgtgttgcttcctgttcatgggatggtaatgttgaaggaagtaagcctgttaaagcatgtaagaaggatggtgtctccttaattactgaggaactttggaaggtaaaaagtgtctgtgataatgaaggagatggatatatgtgtaatgataatcaacccattgtcataaatgataatcttgcccttggttttgctgcttctcatgaaaagtgttgttcctgtcaactcttacaatttacttcaagtaatgtaaagggtaaaaaaatgattgttcaagtcactaacactggttcagatattggtagtaatcactttgatcttcaaattcctggtgctggtgtcggtatcttcaacggttgtagtaagcaatggggtgctccaggcgatggttggggtagacgttatggtggtgtcactacaaaagccgaatgtagtcaacttccagctcaattaagagccggttgtgaatggagatttggatggtttgccagttctgataatccaggtgttgtctatgaacgtgttcaatgtccaaaacaacttactgatatcaccggttgtgt

SEQ ID NO: 24803 - DNA, 603 bp, Neocallimastix californiae
  Glyco_hydro_45
gggtactactaccagatattgggattgttgtaaaccatcttgtgcctggccaggtaaatttgaatacaagaccaatattaaattatgtgctgctgatggtagcccacttctcgataataatttaatttctggttgtgaaggtggaccaacttatacttgtgaagatcaaactccatgggctgttgatgatgttactgcttatggttatgctgccgcaaacattccaggtttaacagaagctgattggtgttgtacttgttatgctttaactttcacttccttcccaattaagggtaaacaaatgattgttcaaattactaacactggtggtgatttaggtgatggtcactttgatcttcaaattccaggtggtggttttggtttatttaatggttgttccccaagatatccagatattccagatgaagactggggtgatcgtaatggtggtgttatatctcgtgaaggttgttataaattaccaaaaagtatgcaagaaggttgtctcttcaaatttgactggttcagaggagctgataatcctgatgttacttatgttaaggttgattgtccacaagaattacttgatgtaagtggatgtac

SEQ ID NO: 24804 - DNA, 585 bp, Neocallimastix californiae
  Glyco_hydro_45
aaaaactacgggttactgggattgctgtgttgcttcctgttcatgggatgctaatgttcctggagctaagccagttagagcttgtagaaagaatggtgtcagcttaattactgaagaactttggaaagttaagagtgtctgtgataatggagaaggctacatgtgtaataataatcaacctattgttatcaatgataagcttgcctacggtttcgctgcttcacatgaaaagtgttgtacctgtcagagacttcaattcacttccggtaatgtgaagggtaaacaaatgattgttcaaattacgaatactggttctgatcttggtagtaatcactttgatcttcaaattccaggtgctggtgttggtattttcaatggttgtactaaacaatggggagctccaaatgatggttggggcagacgttatggtggagtcacctcgaaatcccaatgtagtcaacttccatctcaattaagagcaggttgtgaatggagatttggatggtttgaaggatcagataatccagatgtcgtctttgaacgtgttcgttgtccaaaagctctcactgatattactggttgtat

SEQ ID NO: 24805 - DNA, 612 bp, Neocallimastix californiae
  Glyco_hydro_45
taagactactcgttactgggattgttgtcttgcttcctgttcatggagtgaaaatgttggtgcctctcacccagttaatgcctgtaaaaaggatggtactactcttattactgatatttccaacttatggagaattaagagtggttgtcaaggtggtgaagcttacatgtgtaatgctcaacaaccatggattattaatgataaggtttcttacggtttcgttgctgccggttttgacagtggtaaccaaaagcaatggtgttgttcctgtcaaaaacttcaattcacttctggtccagttgctggtaagcaaatgattgttcaagttactaacactggtactgatctttctgaaaaccactttgatattcaaatgccaggtggtggtgttggtattttcaacggttgttcttctcaatggaatgctggttctgatggttggggtcaacgtttcggtggtatttcctccgtttctgaatgttctcaacttccagctgaattaagagatggttgtaaatggagattcgattggttcaagaacgctgataatccagctgttgtttttgaacgtgttcaatgtccaaaggaacttactgacattactggttgtat

SEQ ID NO: 24806 - DNA, 612 bp, Anaeromyces robustus; identical to SEQ ID NO: 24805
  Glyco_hydro_45

SEQ ID NO: 24807 - DNA, 598 bp, Anaeromyces robustus
  Glyco_hydro_45
tcaaaccactcgttattgggattgttgtaaaccatcttgtgcctggaattataaagctaaggtcactcatgaagtttattcttgtagaaaagatggtagtattgaaccagtagtatatgctactagtggttgtggaggtggtcaagcctttatgtgtaatgaccaacaaccatgggagattaatgataaattatcttatggttttgctgcagccaatatttcaggtagtgatgaagaacattggtgttgtgcttgtttcaaacttactttcacatctacttcaattgctggtaaacaaatgattgttcaagttactaatactggtggtgatcttggtaataatcattttgatattcaaatgccaggtggtggtcttggtctttttgatggttgttcaccacaatttggtgttgatgcttctaaatggggtaataaatatggtggtcttacatccgaaagtcaatgttccctcttacctaaagtacttcaaccaggttgtcattggagatatggttggtttgaagatgctgataatccagctatggaatttgaagaagttcaatgtccacaagaattagttgatattactggttgtgct

SEQ ID NO: 24808 - DNA, 603 bp, Anaeromyces robustus
  Glyco_hydro_45
aggtacaaccactagatactgggattgttgtaaaccatcctgtgcctggccaggtaaattcgaatacaaaactaatattaaattatgtaatgccgataacagtccacttcttgataacaacttaaaatctggttgtgaaggtggtccaacttacacttgtgaagaccaaacaccatgggctgttgatgaagttactgcttatggttttgctgctgccagtattccaaatcaaactgaagccgattggtgttgtacttgttatgctttaactttcacttccttcccaattaaaggtaagcaaatgattgttcaagtcacaaacactggtggtgatttaggtgaaggtcactttgatattcaaattccaggtggtggtttcggtttatttaatggatgttcaccaagatatccagaaattccagatgaagactggggtgaccgtaatggtggtgttacttctcgtgaaaactgttataaattaccaaagactatgcaagaaggttgtctcttcaaatttgactggttcagaggagctgataacccagatgttacttatgttaaggttgattgtccaaaggaattacttgaagttagtggatgtac

SEQ ID NO: 24809 - DNA, 603 bp, Anaeromyces robustus
  Glyco_hydro_45
gggtaatactactcgttactgggattgttgtaaaccatcttgttcatggccagaaaaggctttagtttctcaaccagttcaacaatgtaaaaaagatggtattactccaattactaatttcaatgctaaatctggttgtgaaggtggtgaatctttcatgtgtttaaaccaacaaccatgggctgtttcagaagtattatcttatggttatgctgccgcatctattgcaggtttaactgaagctgattggtgttgtcgttgttacgctttaactttcactactggtccagctaaaggtaaacaaattgttgttcaagttactaacactggtggagatcttggtgaaaatcactttgatcttcaaatcccaggtggtggtgttggtattttcaatggttgttccactcaatttaatactgatactgatggttggggtgaacgttatggtggtattggtaaacgtagtgactgtgaaatgcttccagaagaaattcgtcaagcttgttactggcgtttcgattggttccttggatctgataacccagaaatggtctttgatgaagttgaatgtccaattgaattaactcaaaacactggttgtat

SEQ ID NO: 24810 - DNA, 612 bp, Anaeromyces robustus
  Glyco_hydro_45
tgttaccactcgttattatgattgttgtaaaccatcttgttcatggccaggtaaagctgatgtcttccatccagtaagacattgtgctgttgatggtactaccttaattgatgatcaagaagcaccatctgcttgtcaaaaagatgttaaaggaaccgctcatatgtgtgaaaaccaacaaccatgggcaattaatgatcatctttcctttggtttcgctgctgctgctttaccaggaggtgaatctgtttcttgttgtaaatgttatgcattaactttcactgacccaccaattcgtggtaaacaattagttgttcaagttactaatactggtgctgatgtcggttctaaccaattcgatcttcaaattccaggtggtggtgttggtattttcgatgcttgtactaatatgtatggtttaccagctggttccaatggttggggtaaacaatatggtggtattacttctattgaagattgtgaatctttcccagaatcattaaaagaaggttgtaaatggagattcaactggttattaggagctgataatccaaaaatgaaattcgctgaagttgattgtccaaaagaacttactgatattactggttgtat

SEQ ID NO: 24811 - DNA, 600 bp, Anaeromyces robustus
  Glyco_hydro_45
tcaaaccactcgttattgggattgttgtaaaccatcttgtgcctggaattataaggctaaagtcactcatgaagtttattcttgtagaaaagatggtagtattgaaccagtagtatatgctactagtggttgtggaggtggtgaagccttcatgtgtaatgatcaacaaccatgggcaattaatgataaattatcttatggttttgctgcagccaatatttcaggtagtgatgaagaacattggtgttgtgcttgtttcaaacttactttcacatccacttcaattgctggtaaacaaatgattgttcaagttactaatactggtggtgatcttggtaataatcattttgatattcaaatgccaggtggtggtcttggtctttttgatggttgttccccacaatttggtgttgatgcttctaaatggggtaataaatatggtggtcttacctcagaaagtcaatgttccctcttacctaaagtacttcaaccaggttgtcattggagatatggttggtttgaagatgctgataatccagctatggaatttgaagaagttcaatgtccacaagaattagttgatattactggttgtgctcg

SEQ ID NO: 24812 - DNA, 588 bp, Anaeromyces robustus
  Glyco_hydro_45
tactactacaggttattgggattgttgtgttgcttcttgttcatgggaaaataatgttaaaggtggaggtcaacccgttaaagcatgtaaaaaggatggtatgactttagttactgaagaattatggaaagttaaaagtgtttgtgataatggtgatgcttatatgtgtaatgatcaacaacctattgttgttaatgatcaattggctcttggttttgctgcttcccatgaaccatgttgtacttgtcaattattacaatttacttctagtaatgttaaaggtaagaaaatgattgtacaagttactaatactggtgatgatattggtaataatcactttgatcttcaaattccaggtgctggtgttggtattttcaatggttgttctaaacaatggggagctggtaatgatggttggggtagacgttatggtggtgttacttcacaagctgaatgtagtcaacttccatctgaattaagagctggttgtgaatggagatttggttggtttgccagttctgataatccaacagttacttatgaacgtgttcaatgtccacaacaacttacaagtattactggttgtgt

SEQ ID NO: 24813 - DNA, 301 bp, Piromyces finnis; identical to SEQ ID NO: 14811
  Glyco_hydro_45

SEQ ID NO: 24814 - DNA, 612 bp, Piromyces finnis
  Glyco_hydro_45
tgttactactcgttactacgattgttgtaagccatcttgttcatggccaggtaaggctgatgtcacccaaccagttagacaatgtgctatggatggtaagactcttttaactgatttcagttctccatctgcttgtcaaaccgatgttgaaggtatttcacatatgtgtgaagaccaacaaccatgggcagtcagtgatgttttatcttacggttttgctgctgctgctttaccaggtggtgaatctgtttcttgctgtgcttgttacgctattactttctctgaaccaccaattagaggtaagcaaattgttgttcaagttactaacactggtgctgatgtcggttcaaaccaattcgatcttcaaattccaggtggtggtgttggtattttcgatgcttgtactaatatgtacggtttaccaagtggatctaacggttggggtaagaagtacggtggtattgacaagattgaagattgtgactccttcccagaagctcttcaagctggttgccgttggagattcgaattcttattaggtgctgataatccaaagatgacctttgttgaagttgaatgtccaaaggttcttactgatatcactggttgtat

SEQ ID NO: 24815 - DNA, 615 bp, Piromyces finnis
  Glyco_hydro_45
aggtgtcaccactcgttactacgattgttgtaagccatcttgttcatggccaggtaaggctgatgtcacccaaccagttagacaatgtgctatggatggtaagactcttttaactgatttcagttctccatctgcttgtcaaaccgatgttgaaggtatttcacatatgtgtgaagaccaacaaccatgggcagtcagtgatgttttatcttacggttttgctgctgctgctttaccaggtggtgaatctgtttcttgctgtgcttgttacgctattactttctctgaaccaccaattagaggtaagcaaattgttgttcaagttactaacactggtgctgatgtcggttcaaaccaattcgatcttcaaattccaggtggtggtgttggtattttcgatgcttgtactaatatgtacggtttaccaagtggatctaacggttggggtaagaagtacggtggtattgacaagattgaagattgtgactccttcccagaagctcttcaagctggttgccgttggagattcgaattcttattaggtgctgataatccaaagatgacctttgttgaagttgaatgtccaaaggttcttactgatatcactggttgtat

SEQ ID NO: 24816 - DNA, 1866 bp, Neocallimastix californiae
  Glyco_hydro_48
tgctcaacgtgccattgaacattacaatgttgttactggtaatggttcatactcttctgaatatttctcaccagaaaatgttccataccactcaattgaaactatgatggttgaagctccagatcatggtcacgaatctgtctctgaaacttactccttctgggtttggttagaagctgttaacggtaagcttactggtaactatgatggtgttgaaaccgcctggagttacttagaaaagcatcttattccagacagcaagaaccaaccaggtaacagtagatacaatgcttcatctccagctacttacgctccagaagatgatgatattgaaaactatccagctcaacttgtcttccaagatggtattgttggtcaagatccaattgctaaggaacttcaacaagcctatggtacttgggatatctacgccatgcactggattattgatggtgataactggtacggttacggtcaacaaggtgatggtaagtccaagccatccttcattaacactttccaacgtggtgcctctgaatccgcttggaaaactgttccacacccatgttgggaatccatgaagtggggtggtcgtaacggtttcttagatcttttcactggtgataactcttacgctaagcaatggagatacactgctgctccagatgctgatgctcgtgctattcaagctgcttacttcggttacatctgggctgaagaagacggtcaagatctttcttctgttgcttctaaggctgctaagcttggtgattacttacgttactctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgacattactaccttctacggtatgtactacgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaaagcaaacactcgtgttaacggtggtgaagttgtccatgctaccaacttagaatggactggtaacccagatgaatggaagtcctccaacttcaacaagaatggtcttaacgcttcccttcacggtaccgtttcttctgaaggtactgatcttggttccattgcctctatgatcaaggctttaatgtgggtctccttaaaggatggtgatactgaaggtcttcaacttgttcttgatgttatggatgccattgaaaactacaaggatgatcttggttatgctgttgaagaagctcgtgaagattacatcaaattcaacgaagatgtttacattccatctggttggactggtaagaatgctcaaggtgctaacatcagaagtggtgttaagttcattgatattcgtccaaagtacaaggaagatccagattgggctcaagtcgaagacttcctcaacggtggttctgctccaagattcacttaccacagattctggggtcaaaccgaaattatggttgctaacggtcttatctccattta

SEQ ID NO: 24817 - DNA, 1866 bp, Neocallimastix californiae
  Glyco_hydro_48
cgctgaacgtgctattgaacattacaacaaggttactggtaatggttcctatcaatctgaatatttctctccagaaaatgttccataccactccattgaaactatgatggttgaagctccagatcaaggtcacgaatctgtatctgaaacttactccttctgggtttggttagaagctgttaacggtaaacttactggtaattacgaaggtgttgaaactgcttggagtttcttagaaaagcatcttattccagacagtaagaatcaaccaggtaatagtagatacaatgcttcttctccagctacttacgctccagaagatgatgatattgaaaactatccagctcaacttgtcttccaagatggtattgttggtcaagatccaattgctaaggaacttcaacaagcctatggtacttgggatatctacgccatgcactggattattgatggtgataactggtacggttacggtcaacaaggtgatggtaagactaagccatccttcattaacactttccaacgtggtgcctctgaatccgcttggaaaactgttccacatccatgttgggaaaccatgaagtggggtggtagcaacggtttcttagatcttttcactggtgataactcttacgctaagcaatggagatacactgctgctccagatgctgatgctcgtgctattcaagctgcttacttcggttacatctgggctgaagaagacggtcaagatctttcttctgttgcttctaaggctgctaagcttggtgattacttacgttactctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgacattactaccttctacggtatgtactacgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaagcaaaacactcgtgttaacggtggtgaagttgtccacgctaccaacttagaatggtctggtaacccagatgaatggaatgcttccaactttgacaaatctggtcttaacgcttcccttcacggtaccgtttcttctgaaggtactgatcttggttccattgcctctatgatcaaggctttaatgtgggtctccttaaaggatggtgatactgaaggtcttcaacttgttcttgatgttatggatgccattgaaaactacaaggatgatcttggttatgctgttgaagaagctcgtgaagattacatcaaattcaacgaagaagtttacattccatctggttggtctggtaagaacgctcaaggtgctcaacttaagagtggtatcaaattcattgatattcgtccaaagtacaaggaagatccagattgggctcaagttgaagacttccttaacggtggttctgctccaagattcacttaccacagattctggggtcaaactgaaattatggttgctaacggtcttatctccatcta

SEQ ID NO: 24818 - DNA, 663 bp, Neocallimastix californiae
  Glyco_hydro_48
cgacccaccatccaacaactggactggtatgcaaggttggggtatggaacgtgtctgttccctttactacctttccggtaacgaaaaggctggtaaggtttgtcaagaatgggctaaatggattaagaaaaacactcgtgttaacggtggtgaaattgtccatgctaccaacttagcctggactggtaacccagatgaatggaagtcctccaacttcaacaagagtggtcttaacgcctcccttcacggtaccgtttcttctgaaggtactgatcttggttccattgcctctatgatcaaggctttaatgtgggtctccttaaaggatgaagatactgaaggtcttcaacttgttcttgatgttatggatgctatggaaaactacagggatgatcttggttatgcagttgaagaagctcgtgaagattacattaaattcaacgaagatgtttacattccatctggttggactggtaagaatgctcaaggtgccaacatcagaagtggtgttaagttcattgatattcgtccaaagtacaaggaagatccagattgggctcaagtcgaagacttcctcaacggtggttccgctccaagattcacttaccacagattctggggacaaactgaaattatggttgctaacggtcttatctctattta

SEQ ID NO: 24819 - DNA, 1083 bp, Neocallimastix californiae
  Glyco_hydro_48
ctctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgatattacctccttctacggtatgtactatgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaaagaaaccactcgtgttaacggtggtgaaattgtccatgctactaacttagaatggtctggtaatccagatgaatggaaatcttctaactttaacaagtccggtcttaatgcctcacttcatggtactgtttcttctgaaggtactgatcttggttctattgcctctattatcaagggtttgatgtgggtttctatgaaggatggagatgaagaaggtctccgacttgttcttgatgtcatggatgctattgaaaactacaaggatgaccttggttatgctgttgaagaggctcgtgaagattacatcaagttcaatgaagaagtatacattccatcgggatggtcaggtaagaacgctcaaggtgccaatattaagagtggagtcaagttcattgatattcgtccaaagtacaaggaagataaggattgggctcaagtggaagacttccttaatggaggatcggctccaagatttacttaccacagattctggggacaaactgaaattatggttgctaatggtcttatctctatcta

SEQ ID NO: 24820 - DNA, 675 bp, Neocallimastix californiae
  Glyco_hydro_48
accagtttaccacgacccaccatccaacaactggactggtatgcaaggttggggtatggaacgtgtctgttccctttactacctttccggtaacgaaaaggctggtaaggtttgtcaagaatgggctaaatggattaagaaaaacactcgtgttaacggtggtgaaattgtccatgctaccaacttagcctggactggtaacccagatgaatggaagtcctccaacttcaacaagagtggtcttaacgcctcccttcacggtaccgtttcttctgaaggtactgatcttggttccattgcctctatgatcaaggctttaatgtgggtctccttaaaggatgaagatactgaaggtcttcaacttgttcttgatgttatggatgctatggaaaactacagggatgatcttggttatgcagttgaagaagctcgtgaagattacatcaaattcaacgaagatgtttacattccatctggttggactggtaagaatgctcaaggtgctaacatcagaagtggtgttaagttcattgatattcgtccaaagtacaaggaagatccagattgggctcaagtcgaagacttcctcaacggtggttctgctccaagattcacttaccacagattctggggacaaactgaaattatggttgctaacggtcttatctctattta

SEQ ID NO: 24821 - DNA, 1866 bp, Neocallimastix californiae
  Glyco_hydro_48
cggtaatcgtgttactgaactttacaacaaagtaactggtaatggttcttacagttctgaatatttctcagctgaaaaggttccatatcactccgttgaaactcttatggttgaagctccagatcatggtcatgaatctgtatctgaaactttctctttctggatttggttagaagccgttaatggtaagattaccggtaactacgatggtgttgaagaagcttggagttacttagaaaagcacattattccagatagcaagaaccaaccaggtaacagtagatacaatccatcttctccagctacttatgctgctgaacatgatgatattgatggttatccatcacaacttgtcttccaagatggtattgttggagaagatccaattgctaaggaacttcaacaagcctatggtaattgggatatttacattatgcactggatcattgatggtgataactggtatggatatggtcaacaaggagatggtaagactaagccatctttcattaacaccttccaacgtggtccttccgaatctacttggaagactgttccacatccatgttgggaatccatgaagtggggtggttctaacggtttcttagatcttttcaccattgataattcctacgccaaacaatggagatacactgcagctccagatgctgatgctcgtgccattcaagctgcttacttcgcttacatttgggctgaagaagatggagttaatctttcatctgttgcttctaaagctgctaagcttggtgattacttacgttatgctcaatacgataagtacttcaagaaggtaggtaactgtgttggttatcaacaatgtcaagctggtcgtggtaagaattcagctcactatcttatttcatggtacttcgcttggggtggaggtttacaaggagattgggcttggagaattggttcatctcacactcacactggttaccaaaatccattagccgcttgggttctttctactcaatctgctttcaagccaaagtcttctactggtgctaaggattgggctacttctcttgaccgtcaattagaattattcagatggttacaatcagctgaaggttgtattgctggtggagccactaactcatggcaaggttcttatgctcaaccatccagtgatatcacatccttctatggtatgtggtatgattggcaaccagtttaccacgatccaccatccaacaactggactggtatgcaaggttggggtatggaacgtgtttgttctctctactacctttctggtaatgaaaaggctggaaagatttgtcaagaatgggccaaatgggttaagaacactactcgtgtcagtggtggtgaagttgtccatgctactaacttagaatggtcaggtaatccagatgaatggaattcttccaacttcaacaaatctaaccttaaccgttccctacacggtactgtttcttctgatggtattgatattggtaccattgcttctattatcaagggattaatgtgggtttctatgaaggatggagatcaagaaggtattaatctttctattgatgttatggatgctattgaaaattacaaggatgatcttggttatggtactaccgaagctcgtggtgattacgataaattcggaggagaagtttacattccaagaggatggagtggtaagaatgctcaaggtgctaacattagaaatggagttactttcattgatattcgtccaaaatataagcaagatccagattgggaacaagttgaagcttaccttaatggaggagaaccaccagtattcacttatcacagattctgggctcaaactgaaattgctgttgctaatggtcttatttctattta

SEQ ID NO: 24822 - DNA, 1866 bp, Neocallimastix californiae
  Glyco_hydro_48
tgcacaacgtgctattaacacatataatactgttactggtaatggttcatacaaatcaagttatttctcaccagaagttgttccataccactctattgaaactcttatggttgaagctccagatcaaggtcacgaatctgtatctgaaactttttctttctgggtttggttagaagccgttaatggtaaacttacaggtgattactcgggtgttgaaaaagcatggtcttacctagaaaagcacatgattccagatagtaagaatcaaccaggtatgagtagatacaatccatcctcaccagctacttatgctccagaagatgatgatattacgaactacccagctagacttgtcttccaagatggtattgtcggtcaggatccaattgctcaggaacttcaacaagcttatggtacttgggatatttatgctatgcactggattattgatggtgataactggtatggatatggtcaacaaggtgatggtacatctaagccatctttcattaacactttccaacgtggtgcttccgaatctgcttggaagactgttccacatccatgttgggaaacattcaagtggggtggttcaaatggtttcttagatcttttcactttagataacaattactctaagcaatggagatacactgatgcaccagatgctgatgctcgtgctattcaaggtgcttactttgcttggctttgggctaaggaggatggtaaaaacctttcatcccttgcttctaaggctgctaagcttggtgattacttacgttactctcactatgataagtatttcaagaagattggtaactgtgttggctatcaacaatgtcaagctggatctggtaagaattcagctcactaccttatttcatggtacttctcatggggtggtggtttacaaggtgattggtcttggagaattggttcttctcacactcacagtggttaccaatctccattagctgcatggattctttctactgaatctgctttcaaaccaaagtctgcttctggtgctaaggattgggctacttctttagaacgtcaaatagaattattcagatggttacaaacttctgaaggttgtattgctggtggtgccaccaattcatggcaaggtcattacgctcaaccagatagctcaattacttccttctacggtatgtggtacgattggcaaccagtttaccacgacccaccatccaataactggactggtatgcaaggttggggtatggaacgtacttgttgttactattacctttctggtgatgaaaaagctggtcttgtttgtcagaactgggctaaatgggttaaggcaaatactcgtgttagtggtggtcaaattgttcatgctactaacctttcctgggaaggtagtccagatgaatggaattcttcaaacttcaacaaggctaatcttaacgcttcccttcatggtactgtttctgctgaaggtattgatcttggttcaattgcctcaattattaagggtttgatgtgggtctccatgaaggataatgatcaagaaggtattaaccttgttattgatgttatggatgctattgaaaactacaaggatgacgaaggttactgtgctgatgaagctcgtgaagactatgccaagttctcatctgaagtttacattccatctggatggtctggtaagaacgctcaaggtgcaaacattaagaatggtgttactttcattgatattcgtccaaaatacaaacaagatcctgattgggcacaagttgaaaacttcattaatggaggagaaccaccaagattccgttaccacagattctggggtcaaactgaaattatggttgccaatggtcttatttctattta

SEQ ID NO: 24823 - DNA, 1866 bp, Neocallimastix californiae
  Glyco_hydro_48
tagtcaacgtgctattgaacactataatattgttactggtaatggttcatatcaatctgaatatttctctccagaaaatgttccataccactcaattgaaactatgatggttgaagctccagatcatggtcatgaatctgtatctgaaacttactccttctgggtttggttagaagcagttcatggtaaacttactggtaactatgatggagtttccactgcttggagttacttagaaaagcatcttattccagatagtaagaatcaaccaggtaacagtagatacaatgcttcttctccagctacttatgctccagaagatgatgacattgaaaactatccagctcaacttgtcttccaagatggtattgttggtcaagatccaattgctaaggaacttcaacaagcttatggtacttgggatatctatgctatgcactggattattgatggtgataactggtatggttatggtcaacaaggtgatggtaagtctaagccatctttcattaacaccttccaacgtggtgcctctgaatcagcatggaagactgttccacacccatgttgggaaactatgaagtggggtggtcctaacggtttcttagatcttttcactggtgataactcctatgctaagcaatggagatacactgctgctccagatgctgatgctcgtgctattcaagctgcctactttggttatatttgggctaaagaagatggagttgatctttcttctgttgcttcaaaggctgctaagcttggtgattacttacgttactcacactacgataaatactttaagaagattggtaactgtattgattatcaacgttgtgctgctggtagcggtaagaactctgctcactaccttatctcatggtactttgcctggggtggaggtattcaaggtgactggtcatggagaattggttcttcccacacccacagtggttaccaaaatccattagctgcttgggttctttcaactgaatcagcctttaaaccaaagggatctactgccgtcaaggattggtcaacctctttagatcgtcaattagaattattcagatggttacaatctgctgaaggttgtattgctggtggagccaccaactcatggcaaggtcactatgctcaaccagatagtgatattaccactttctatggtatgttctacgactggcaaccagtttaccacgatccaccatccaacaattggactggtatgcaaggttggggtatggaacgtgtctgttccctttactacctttctggtaacgaaaaggctggaaagatttgtcaagaatgggctaagtgggttaaggaaaacactcgtgttattggtggtgaagttgttcatgccactaacttagaatggacaggtaatccagatgaatggaaatcttcaaactttaacaagaatggtcttaactctcaacttcatggtactgtttcttctgaaggtactgatcttggttcaattgcttctatcattaaggctttaatgtgggtttccttaaaggatgaagattctgaaggtctccgacttgttattgatgtaatggatgctattgaaaactacagagacgatcttggttacgctgttgaagaagctcgtgaagattacaataagttcgaagaaaatgtttacattccttcaggttggactggtaagaacgctcaaggtgctaacatcagaagtggtgttaagttcattgatattcgtccaaaatacaagcaagataaggattgggctcaagttgaagactaccttaacggtggtaaccctccaaaattcacttatcacagattctggggacaaacagaaattatggttgccaatggtcttatttctatcta

SEQ ID NO: 24824 - DNA, 684 bp, Neocallimastix californiae
  Glyco_hydro_48
cgactggcaaccagtttaccacgatccaccatccaacaattggactggtatgcaaggttggggtatggaacgtgtctgttccctttactacctttctggtaacgaaaaggctggaaaggtttgtcaagaatgggctaagtgggttaagaaaaacactcgtgttaatggtggtgaagttgttcatgccactaacttagaatggacaggtaatccagatgaatggaaatcttcaaactttaacaagaatggtcttaactctcaacttcatggtactgtttcttctgaaggtactgatcttggttcaattgcttctatcattaaggctttaatgtgggtttccttaaaggatgaagattctgaaggtctccgacttgttattgatgtaatggatgctattgaaaactacagagacgatcttggttacgctgttgaagaagctcgtgaagattacattaagttcaatgaagatgtttacattccttcaggttggactggtaagaacgctcaaggtgctaacatcagaagtggtgttaagttcattgatattcgtccaaaatacaagcaagataaggattgggctcaagttgaagacttccttaacggtggtagcgctccaagattcacttaccacagattctggggacaaacagaaattatggttgccaatggtcttatttctatcta

SEQ ID NO: 24825 - DNA, 1866 bp, Neocallimastix californiae
  Glyco_hydro_48
tgctcaaagagttattgatacttacaatgccgttactggtaatggaagttacaattctgattacttctcaccagaaaatgttccataccactcaattgaaaccatgatggttgaagctccagattacggtcatgaatctgtttctgaaacttattccttctgggtttggttagaagctattaatggtaagatgactggtgattacaagggtgttgaaactgcttggagtttcttagagaagcatcttattccaaatagtaagaatcaaccaggtatgagtagatataatacttcttctccagctacttatgccccagaagatgatgatattactaactatccagctcgtcttgttttccaagacggtattgttggtgaagatccaatcgctaaagaacttcaacaagcctatggtacttgggatatctacgctatgcactggatcattgatggtgataactggtatggttatggtcaaaatggtgatggtacctctaagccatccttcattaatactttccaacgtggtgcctctgaatccgcttggaaaactgttccacacccatgttgggaagaaatgaaatggggtggtcgtaatggtttcttagatcttttcactggtgataacagttactctaaacaatggagatacactgctgctccagatgctgattctcgtgctattcaagctgcttactttgcttacatctgggctaaagaagatggtcaaaatctttcctcccttgcttctaaggctgctaagcttggtgattacttacgttacgcccaatacgataaatacttcaagaagattggtaactgtatcggctatcaacaatgtcaagctggtcgtggcaaaaactctgctcactaccttatttcttggtacttctcttggggtggtggtctccaaggtgattggtcatggagaattggttcctctcacactcacaccggttaccaaaacccattagccgcctggattctttctactcaatctgctttcaagccaaagggttccactgctgttaaggattggacgacttccttagatcgtcaattagaattattcagatggttacaagctgccgaaggttgtattgctggtggtgccactaactcatggcaaggtcactacgctcaaccaccaagtgaaattacttccttctacggtatgtactacgattggcaaccagtttaccacgatccaccatccaacaactggactggtatgcaaggttggggtatggaacgtgtctgttctctttactacctttctggtaacgaaaaggctggaaaggtttgtcaagaatgggctaaatgggtcaagaacaatgttcgtgtcaacggtagcgaaattgttcatgccactaacttcgaatggtccggtaacccagatgaatggaaggcctccaactttaacaaatctggtcttaacgcttcccttcacggtgccgtttcctctgaaggtattgatcttggttctatcgcctctatcattaagggtttaatgtgggtttccatgaaggataatgatcaagaaggtattgatctttccgttcaagttatggatgccattgaacaatacaaggatcaatatggttatggagttgaagaagctcgtgaagattacattaagtttaatgaagaagtttacattccaagtggttggactggtaagaatgctcaaggtgctaacatcagaaatggtgtgaagttcattgatattcgtccaaagtataaggaagatccagactgggctcaagttgaaaacttccttaacggtggtgaagctccaagattcacttaccacagattctgggctcaaactgaaattgctgttgctaatggtcttatctctattta

SEQ ID NO: 24826 - DNA, 1866 bp, Neocallimastix californiae
  Glyco_hydro_48
tgctcaacgtgttattgatacttacaatgctgttactggtaacggtaactataactctgaatatttctcaccagagaatgttccataccactctgttgaaaccatgatggttgaagctccagattatggtcatgaatccgtttctgaaacttattccttctgggtttggttagaagctattaatggtaagatgaccggtgattacaaaggagttgaaactgcttggagttacttagaaaaacatcttattccagacagtagaaatcaaccaggtatgagtagatataacagctcttctccagccacttacgctccagaagatgatgatattgaaaactacccagctcgacttatcttccaagatggaattgtcggtgaagatcctcttgctagagaacttcaacaagcttatggtacttgggatatatatgctatgcattggattattgatggtgataactggtacggttatggtcaacaaggtgatggtagaagtaagccatccttcattaacaccttccaacgtggtgcttcagaatctgcttggaagactgttccacacccatgttgggaaaccatgaaatggggtggtagaaacggtttcttagatcttttcactggtgataacagttactccaagcaatggagatacactgctgctccagatgctgatgctcgtgctattcaagctgcttacttcgcctacatttgggctaaggaagacggtacaaatcttagttctcttgcttctaaagctgctaaacttggtgattacttacgttactctcattatgataaatatttcaaaaaaattggtaactgtattggatatcaacaatgtcaagctggtcgtggtaagaattctgctcactatcttatttcttggtacttctcttggggtggtggtttacaaggtgattggtcttggagaattggttcttctcacactcacactggttaccaaaatccattagctgcttgggttctttctactgaatctgccttcaaaccaaagagttccactgctgttaaggattgggctacttctatggaccgtcaattagaattattcagatggttacaagcttctgaaggttgtattgcaggtggtgccacaaattcatggcaaggtcattacgctgaaccaccaagtgatataactaccttctatggtatgtactatgactggcaaccagtttaccacgatccaccatctaacaactggactggtatgcaaggttggggtatggaacgtgtctgttccctttactacctttctggtaatgaaaaggccggaaaggtttgccaagaatgggctaagtgggttaagaagaatgttcgtgttaatggtaatgaaattactcatgctactaacttctcctggtccggtaaccctgacgaatggaatccaagtaatttcaataaatctggtcttaatgcttcccttcatggtactgtttcttctgaaggtattgatattggttcccttgcctctattattaagggtttaatgtgggtttctatgaaggataaagatcaagaaggtattaacctttctataaaggttatggatgctattgaaaactatagagatgatcttggttattcagtcgaagaagctcgtgaagattacatcaaattcaatgaagaagtttacattccatacggatggactggtaagaatgctcaaggtgccacccttgaacatggtgttaagtttattgatattcgtccaaaatacaaacaagataaggattgggcacaagttgaaaacttccttaatggtggtgaagccccaagattcacctaccacagattctgggctcaaactgaaatcgctgttgctaatggtcttatttctatcta

SEQ ID NO: 24827 - DNA, 1869 bp, Neocallimastix californiae
  Glyco_hydro_48
tgctcaacgtgctattgatcattacaacaaaatgactaacggtggtcaatacaatactgattatttctcaccagaaactgttccatatcactcaattgaaactcttatggttgaagctccagatcatggtcacgaatctgtatctgaaacttactctttctggatctggttagaagctgttaacggtaaacttactggtaactacgacggtattaacactgcctggagttacttagaaaagcacatgattccagatgctaagaaccaaccaggtaatagtaaatataacccatcttctccagctacttacgctccagaagatgatgatattactaactacccagctcaacttgtcttccaagatggtcttgttggtgaagatccaatcgctaaggaacttcaacaagcttacaacacttgggatatctatgccatgcactggattattgatggtgataactggtacggttatggtcaacaagctgatggtaagactaagccatctttcattaacactttccaacgtggttcttctgaatctacttggaagactgttccacacccatgttgggaagaattcaagtggggtggtagaaatggtttcttagatcttttcactggtgataacaactacgctaagcaatggagatacactgctgctccagatgctgatgctcgtgctattcaagctgcttacttcggttacatgtgggctgaagaagatggtgttgatctttctgatctcgcttctaaggctgccaagcttggtgattacattcgttacgctcaatacgataaatacttcaagaagatcggtaactgtattggtcatgacagatgttctgctggtcgtggtaagaactctgctcactaccttatctcctggtacttcgcttggggtggtggtttacaaggtgactgggcttggagaattggttcttctcacactcacactggttaccaaaacccattagccgcttgggttctttctactcaatctgctttcaagccaaaatctagaactggtgctgacgattgggctacttctcttgaccgtcaattagaattattcagatggttacaagcttctgaaggttgtattgctggtggtgccactaactcatggcaaggtcactacgctcaaccaagcagtgatattactaccttctacggtatgtactatgactggcaaccagtttaccacgatccaccatcaaacaactggactggtatgcaaggttggggtatggaacgtgtctgttctctttactacatttctggtaatgaaaaggccggaactatctgtagagattgggccaaatgggttaagaacactgttcgtgttaatggtaatgaagttattcactccactaaccttgaatggtctggtaacccagatgaatggaacagcaacaacttcaacaagtctggtcgtaacagatcccttcacggtacctcatcttctgatggtctcgatcttggtactcttgcctctatcattaagggtttattatgggtttctgctaaggataatgatgccgaaggtattcaacttgttcttgatgttatgaatgctattgaacaatacagtgacgatcttggttacgctgctgaagaaccacgtggtgattacagtaaattcggtgaagaagtttacattccatctggttggactggtaagaatgctcaaggtgctaacattcgtagtggtgttactttcattgatattcgtccaaaatacaagcaagatccagattgggctcaagttgaaaactaccttaatggtggtagtgaaccacgtttcacttatcacagattctgggctcaaactgaaattatggttgccaatggtcttatctctatcttagg

SEQ ID NO: 24828 - DNA, 1869 bp, Neocallimastix californiae
  Glyco_hydro_48
cgctcaacgtgctattgaacattacaacaaaatgactaacggtggtcaatacaatactgaatatttctcaccagaaaatgttccatatcactcaattgaaactcttatggttgaagctccagatcacggtcacgaatctgtatctgaaacttactccttctggatctggttagaagctgttaacggtaagcttactggtaactacgacggtattaacactgcctggagttacttagaaaagcacatgattccagatgaaaagaatcaaccaggtaacagtaaatataacccatcttctccagctacttacgctccagaagatgatgatattactaactacccagctcaacttgtcttccaagatggtcttgttggtgaagatccaatcgctaaggaacttcaacaagcttacagaacttgggatatctatgccatgcactggattattgatggtgataactggtatggttatggtcaacaagctgatggtaaatctaagccatctttcattaacactttccaacgtggtgcttctgaatctacttggaagactgttccacatccatcttgggaagaattcaagtggggtggtagaaatggtttcttagatcttttcactggtgataacaactacgctaagcaatggagatacactgctgctccagatgctgatgctcgtgctattcaagctgcttacttcggttacatttgggctgaagaagatggtgttgatctttctgatctcgcctctaaggctgccaagcttggtgattacttacgttactctcactatgataaatatttcaagaagatcggtaactgtgtcggatacgacaaatgttctgctggtcgtggtaagaactctgctcactaccttatctcctggtacttcgcttggggtggtggtttacaaggtgactgggcctggagaattggttcttctcacactcacactggttaccaaaacccattagctgcttggattctttctactcaatctgctttcaagccaaagggttctactgctgttaaggattggcaaacttctcttgaccgtcaattagaattaattagatggttacaagctactgaaggttgtattgctggtggtgccactaattcatggcaaggtcactatgctgaaccagacagtgatattactaccttctacggtatgtactatgactggcaaccagtttaccacgatccaccatcaaacaactggactggtatgcaaggttggggtatggaacgtacttgttctctttactacgtttctggtaatgaaaaggccggaactatctgtagagattgggccaaatgggttaaggaaactgttcgtgttagtggtggtcaagtaattcacgctactaaccttgaatggtctggtaacccagatgaatggaacaagaacaacttcaacaagtctggtgctaaccgttctcttcacggtactgtttctgctgaaggtcttgatcttggttcaattgcttctatcattaaggctttattatgggtttctgctaaggatggtgatgaagaaggtattgaccttgctattcaagttatggatgctattgaaaactacaaggatgatctcggttatgctgctgaagaagctcgtgctgattacagtaaattcggagatgaagtttacattccatctggttggactggtaagaatgctcaaggtgctaaccttaagagtggtgttactttcattgatattcgtccaaaatacaagcaagatccagattgggctcaagttgaaaactaccttaacggtggtagtgaaccaaccttcacttaccacagattctggggtcaaactgaaattatggttgccaatggtcttatctctatcttagg

SEQ ID NO: 24829 - DNA, 1500 bp, Neocallimastix californiae
  Glyco_hydro_48
tgttggtgaagatccaatcgctaaggaacttcaacaagcttacaacacttgggatatgtacgctatgcactggattattgatggtgataactggtacggttatggtcaacaagctgatggtaaatctaagccatctttcattaacactttccaacgtggttcttctgaatctacttggaagactgttccacacccatgttgggaagaattcaaatggggtggtagaaacggtttcttagatcttttcactggtgataacaactacgctaagcaatggagatacactgctgctccagatgctgatgctcgtgctattcaagctgcttacttcggttacatttgggctgaagaagatggtgttaacctttctgatctcgcctctaaggctgccaagcttggtgattacatgcgttacgctcaatacgataaatacttcaagaagatcggtaactgtattggtcacgacaaatgttctgctggtcgtggtaagaactctgctcactaccttatctcctggtacttcgcttggggtggtggtttacaaggtgactgggcctggagaattggttcttctcacactcacagtggttaccaaaacccattagccgcttgggttctttctactcaatctgctttcaagccaaagtctaaatctggtgctgacgattgggctacttctcttgaccgtcaattagaattattcagatggttacaagcttctgaaggttgtattgctggtggtgccactaactcatggcaaggtcactacgctaaaccaggtagtgatattactaccttctacggtatgtactatgactggcaaccagtttaccacgatccaccatcaaacaattggactggtatgcaaggttggggtatggaacgtgtctgttctctttactacgtttctggtaatgaaatggccggaactgtctgtagagattgggccaaatgggttaagaacactgttcgtgttagtggtggtcaagtagttcacgctactaaccttgaatggtctggtaacccagatgaatggaacaagagcaacttcaacaagtctggtcttaaccgttcccttcacggtactgtttctgctgaaggtcttgatcttggttcaattgcttctattattaagggtttattatgggtttctgctaaggatggtgatgaagaaggtattgacctttctctccaagttatggatgctattgaaaactacaaggatgatctcggttatgctgctgaagaagctcgtgctgattacgataaattcggtggtgaagtttacattccatctggttggactggtaagaacgctcaaggtgctaaccttaagagtggtgttactttcattgacattcgtccaaaatacaagcaagatccagattgggctcaagttgaaaactaccttaacggtggtagtgctccaaccttcaaataccacagattctggggtcaaactgaaattatggttgccaatggtcttatctctatcttagg

SEQ ID NO: 24830 - DNA, 1440 bp, Neocallimastix californiae
  Glyco_hydro_48
cgctatgcactggattattgatggtgataactggtacggttatggtcaacaagctgatggtaaatctaagccatctttcattaacactttccaacgtggttcttctgaatctacttggaagactgttccacacccatgttgggaagaattcaagtggggtggtagaaatggtttcttagatcttttcactggtgataacaactacgctaagcaatggagatacactgctgctccagatgctgatgctcgtgctattcaagctgcttacttcggttacatttgggctgaagaagatggtgttaacctttctgatctcgcctctaaggctgccaagcttggtgattacatgcgttacgctcaatacgataaatacttcaagaagatcggtaactgtattggtcacgacaaatgttctgctggtcgtggtaagaactctgctcactaccttatctcctggtacttcgcttggggtggtggtttacaaggtgactgggcctggagaattggttcttctcacactcacagtggttaccaaaacccattagccgcttgggttctttctactcaatctgctttcaagccaaagtctaaatctggtgctgacgattgggctacttctcttgaccgtcaattagaattattcagatggttacaagcttctgaaggttgtattgctggtggtgccactaactcatggcaaggtcactacgctaaaccaggtagtgatattactaccttctacggtatgtactatgactggcaaccagtttaccacgatccaccatcaaacaattggactggtatgcaaggttggggtatggaacgtgtctgttctctttactacgtttctggtaatgaaatggccggaactgtctgtagagattgggccaaatgggttaagaacactgttcgtgttagtggtggtcaagtagttcacgctactaaccttgaatggtctggtaacccagatgaatggaacaagagcaacttcaacaagtctggtcttaaccgttcccttcacggtactgtttctgctgaaggtcttgatcttggttcaattgcttctattattaagggtttattatgggtttctgctaaggatggtgatgaagaaggtattgacctttctctccaagttatggatgctattgaaaactacaaggatgatctcggttatgctgctgaagaagctcgtgctgattacgataaattcggtggtgaagtttacattccatctggttggactggtaagaacgctcaaggtgctaaccttaagagtggtgttactttcattgacattcgtccaaaatacaagcaagatccagattgggctcaagttgaaaactaccttaacggtggtagtgctccaaccttcaaataccacagattctggggtcaaactgaaattatggttgccaatggtcttatctctatcttagg

SEQ ID NO: 24831 - DNA, 1755 bp, Neocallimastix californiae
  Glyco_hydro_48
taaaaatcattataataaattaaatttacataattcaacatcttcattctataatttagactctatcccttatacaactttagaaactttatatatagatcaaacagtagattatggtcatataacaactataaaagaattttcatataaactttggatagaagcaatacaagggaaaatatcaggaaaatggaaatctttcgttaatgcttggaatatatttgaaatgaatatgattcctaaagaagaaaatcaaagaggaagttatatttattattcgaataatcataattcacagaataatcaagatacactatataaaagtttaaatgaatattatcaaacctggtcaatatatttaccgcattataaaattgatacagataattggaatatgtattttagtaaatcaaatgaaaaacgatttataaatacatacaaaaataataataaagactcaatatggagttcattgacatatccaagcttaataaattcaaaagattttgttaatccatatgttaaagcagatagtccagaaatgaaacaatgggagtatataagtgattcaaagtatgtttcaaaaataattgaaactatttattgggcttattgctggtcaaatgagcaaaaaaaaagaaaattcatggacactattttaaaaaaagttttaagaatgagtgattatatgttatattttataaatagtaacgaatcattacaagaatttaatgtagaatcaaaagatgatgacttaaattatcttgtatctcgctatttttcatggaaaggtgatatacatggaaaatggttaacaaagaaagtttcatcaaatattataggtattggaagccaaaatcctttagttgcttatatattatcgaacattaaggaatttaaatccgacaatgaagatattatattaaaatggaagaaaacgtacaaaaggcaaatagaatttattcgttggttacaaagttcagaaggagccattgttggaaatgctatttatatatcaagttctattgaaattaataaagtacccactttttataatctcgtgttttctaataattcaaatgaagaagaaaataatttatttagtactcaatgtttcgtttttgaaagtattgctgaactctattatattacaaaggataaagatattgagacaatcttatttaaatggttagattgggtattaacggttttccatttaacaagtgatagatcttttagaataccaaatagattatcatttgaaggtcaacctgaaaaatggataccaaatacgaaaattaaagatcataaaaataagcatttgaatgtaattatagaagactttaataatgatttaggggttgcggcatcattatcaaaaattttactttgggttggtaaaaaaataaataatgaagattatttaacacttggaagggaaattttagaaagacaagaaattttaaataaagatgaggatggttatgctactgaagaaaaattctatcaatatcgtctttttaataaaaaattaccaattcaaaaggattttaaaggtgtttatggtagatctacaaaaattaatgataaatctagtttcttgtcaatccgtccatactataaacgcgataaaaattggaaaaaaattcaaacttttttagataaaggaactcctgtaccaaaatttagatatcatcgattttgggaacaatgtgaaattttatcggctcaaggactttactccctattatatac

SEQ ID NO: 24832 - DNA, 1866 bp, Neocallimastix californiae
  Glyco_hydro_48
cgctaaaagagttactgatacatacaatgctgttactggtaatggaagttacaattctgattacttctcaccagaaaatgttccataccactcaatcgaaactatgatggttgaagctccagattacggtcatgaatctgtttctgaaacttattccttctgggtttggttagaagctattaatggtaagatgaccggtaattacaagggtgttgaaactgcttggagttacttagaaaagcatcttattccaaacagtaagaaccaaccaggtatgagtaagtacaacacttcttctccagctacttatgctccagaagacgatgatattactaactacccagctcaacttgtcttccaagacggtattgttggtgaagatccaattgctaaggaactccaacaagcttatggtacctgggatatctatgctatgcactggattattgatggtgataactggtatggttacggtcaaaatggtgatggtacttctaagccatcctttattaacactttccaacgtggtgcctctgaatccgcttggaaaactgttccacacccatgttgggaagaaatgaaatggggtggacgtaacggtttcttagatcttttcactggtgataacaattattctaagcaatggagatacactgctgctccagatgctgatgctcgtgctattcaagctgcttatttcgcttatatttgggctgaagaagatggtcaaaatctttcctcccttgcttctaaggctgctaagcttggtgattacttacgttactctcactacgataaatactttaagaagattggtaactgtataggataccaacaatgtcaaggtggtcgtggtaagaactctgctcactaccttatttcctggtacttctcttggggtggtggtttacaaggtgactggtcttggagaattggttcatcccacactcacactggttaccaaaacccattagctgcttgggttctttctactcaagctgctttcaagccaaagggttcttctgctgtcaaggattggtcaacttccttagatcgtcaattagaattattcagatggttacaagctgctgaaggttgtattgctggtggtgctactaactcatggcaaggtcactacgctcaaccaccaagtgacattacctccttttacggtatgtactatgattggcaaccagtttaccatgatccaccatccaacaactggactggtatgcaaggttggggtatggaacgtgtctgttccctttacttcatttctggtaacgaaaaggccggtaaggtttgtcaagaatgggctaaatgggttaagaacaatgttcgtgttaatggtagtgaaattgttcacgctactaacttcgaatggtctggtaacccagatgaatggaagccttctaacttcaacaagtctggtcttaacgcttctcttcatggtaccgtttcctctgaaggtgttgatcttggttctcttgcctctatcatcaaaggtttaatgtgggtttccatgaaggataatgatcaagaaggtattgatctttccgttcaagttatggatgccattgaacaatacaaggataaatatggttatggtgttgaagaagcccgtgaagattacattaaattcaatgaagaagtttacattccaagtggatggactggtaagaatgctcaaggtgctaacatcaggagtggagttaagttcattgatatccgtccaaaatacaaggaagatccagactgggctcaagttgaaaacttccttaacggtggtgaagctccaagattcacttatcacagattctgggctcaaactgaaattgccgttgctaacggtcttatctctatcta

SEQ ID NO: 24833 - DNA, 1026 bp, Anaeromyces robustus
  Glyco_hydro_48
tgctggtcgtggtaagaactctgctcactaccttatctcctggtacttcgcttggggtggtggtttacaaggtgactgggcttggagaattggttcttctcacactcacactggttaccaaaacccattagccgcttgggttctttctactcaatctgctttcaagccaaaatctagaactggtgctgacgattgggctacttctcttgaccgtcaattagaattattcagatggttacaagcttctgaaggttgtattgctggtggtgccactaactcatggcaaggtcactacgctcaaccaagcagtgatattactaccttctacggtatgtactatgactggcaaccagtttaccacgatccaccatcaaacaactggactggtatgcaaggttggggtatggaacgtgtctgttctctttactacatttctggtaatgaaaaggccggaactatctgtagagattgggccaaatgggttaagaacactgttcgtgttaatggtaatgaagttattcactccactaaccttgaatggtctggtaacccagatgaatggaacagcaacaacttcaacaagtctggtcgtaacagatcccttcacggtacctcatcttctgatggtctcgatcttggtactcttgcctctatcattaagggtttattatgggtttctgctaaggataatgatgccgaaggtattcaacttgttcttgatgttatgaatgctattgaacaatacagtgacgatcttggttacgctgctgaagaaccacgtggtgattacagtaaattcggtgaagaagtttacattccatctggttggactggtaagaatgctcaaggtgctaacattcgtagtggtgttactttcattgatattcgtccaaaatacaagcaagatccagattgggctcaagttgaaaactaccttaatggtggtagtgaaccacgtttcacttatcacagattctgggctcaaactgaaattatggttgccaatggtcttatctctatcttagg

SEQ ID NO: 24834 - DNA, 1035 bp, Anaeromyces robustus
  Glyco_hydro_48
caaatgttctgctggtcgtggtaagaactctgctcactaccttatctcctggtacttcgcttggggtggtggtttacaaggtgactgggcctggagaattggttcttctcacactcacactggttaccaaaacccattagctgcttggattctttctactcaatctgctttcaagccaaagggttctactgctgttaaggattggcaaacttctcttgaccgtcaattagaattaattagatggttacaagctactgaaggttgtattgctggtggtgccactaattcatggcaaggtcactatgctgaaccagacagtgatattactaccttctacggtatgtactatgactggcaaccagtttaccacgatccaccatcaaacaactggactggtatgcaaggttggggtatggaacgtacttgttctctttactacgtttctggtaatgaaaaggccggaactatctgtagagattgggccaaatgggttaaggaaactgttcgtgttagtggtggtcaagtaattcacgctactaaccttgaatggtctggtaacccagatgaatggaacaagaacaacttcaacaagtctggtgctaaccgttctcttcacggtactgtttctgctgaaggtcttgatcttggttcaattgcttctatcattaaggctttattatgggtttctgctaaggatggtgatgaagaaggtattgaccttgctattcaagttatggatgctattgaaaactacaaggatgatctcggttatgctgctgaagaagctcgtgctgattacagtaaattcggagatgaagtttacattccatctggttggactggtaagaatgctcaaggtgctaaccttaagagtggtgttactttcattgatattcgtccaaaatacaagcaagatccagattgggctcaagttgaaaactaccttaacggtggtagtgaaccaaccttcacttaccacagattctggggtcaaactgaaattatggttgccaatggtcttatctctatcttagg

SEQ ID NO: 24835 - DNA, 1866 bp, Anaeromyces robustus
  Glyco_hydro_48
tgcaaaacgtgctactgaacattacaatattattacaggtaatggttcttactcctcaaaatatttctcatcagaaaaagttccatatcactctgttgaaactcttatggtagaagctccagatcatggtcacgaatctgtatctgaaacttattctttctggatttggttagaagctgttaatggtaaacttacaggtaattatgaaggtgttgatactgcttggtcttacttagaaaagcatcttattccagacagtaagaatcaaccaggtaatagtaaatataatccatcatctccagctacctatgctccagaagatgatgatattactaattatccagctcaacttgttttccaagatggtattgttggtcaagatccaattgctcaagaacttcaacaagcctatggtaattgggatatgtatgctatgcactggattattgatggtgataattggtatggttatggtcaacaaggtgatggtacttctaaaccatctttcattaacactttccaacgtggttcctctgaatctacttggaaaactattccacatccatgttgggaagaattcaagtggggaggtccaaatggtttcttagatcttttcactggtgataattcttactcaaaacaatggagatacactgctgctccagatgctgatgctcgtgctattcaagctgcttactttggatatatttgggctaaggaagatggacaagatctttctgctgttgctgctaaagctgctaagcttggtgattatatgcgttatgctcaatatgataaatatttcaagaagattggtaattgtattggttataataaatgtgctgctggtagtggtaaaaattctgctcactaccttatttcttggtacttcgcttggggtggtggtttacaaggtgattgggcttggagaattagttcttcccacactcacagtggttaccaaaatccattagctgcttgggtactttcttctgaaccagctttcaaaccaaaatctagtactggtgctgaggattgggcaacatctcttgatcgtcaattagaattattcagatggttacaatcttctgaaggttgtattgctggtggtgccactaactcatggcaaggtcactatgctcaaccagatagttcaattactactttctatggtatgttctatgattggcaaccagtttatcacgatccaccatccaacaattggtctggtatgcaaggttggggtatggaacgtgtttgttcattatattaccttagtggtgatgaaagagctggtaaagtttgtcaagaatgggctaaatgggttaaaaagaatgttcgtgttagtaatggagaaattactcactgtactaatattaaatgggaaggtaatccagatgaatggaattcttctaactttaataaagctaaccttaatgcttcacttcacggtacttcctcttctgaaggtacagatcttggtaccgttgcttcaattattaaaggtttactctgggtttccttaaaagataatgaccaagaaggtattgatcttgttattgatgtaatggatgctatggaaaattacaaggatagtcttggttatgctgttaaagaagcacgtgaagattatgctaaattcggtggtgaagtttatgttccatctggttggactggtaagaatgctcaaggtgctaacattaagaatggtgttactttcattgatattcgtccaaagtataaacaagatccagattgggctcaagttgaaaacttccttaatggaggtgatccaccagaattcacatatcacagattctgggctcaaactgaaattatggttgctaatggtattctttccattta

SEQ ID NO: 24836 - DNA, 1899 bp, Anaeromyces robustus
  Glyco_hydro_48
tgctcaacgtgttattgaacagtacgaaaaattaaccaataatggtacttatgatacagattatttttcaaaagataattatttaccgttttattccattgaaactcttattgttgaagaggataatagtttttccagattagattatggtcacttatctacttctgaaactttatcttattggatttggttagaagctgttaatggtaaaattactggtaattatgaaggtgtagattgggcttggagtgtcatggaaaaatttttaattccctattcagagtatcaacgaggtaataatcgatataatagtaatgaaccatctatctatgttccagaatatgatggtatacaaaattatccaattccattaacttttcaaacaggaattgctggtatggatccaatagctaaagaacttcaagtcacctatggtacatgggatatgtattctctacattggcttgttgatggtgataattggtatggttatggtcaacaagaaaatggttataccagaccagtattaattaatacttttagacgtggtccatctgaatctgtttggcaaactattccacatccatcttttgatgaatttagatggggtggtagtaatggttttttagatctttttttcattgataataatttttattatcctaaacaatataaatatacaacttgtcctgatgctgatgctcgtgctattcaagctacctattttgcttatttatgggctaaagaagatggtatcaatcttccatattctattattttaagagctacaagacttggtgattatttacgttattctcattatgataaatattttaaaaaaattggtgattgttttaattataaattatgtacaccaggttccggtaaaaattcagcacattatcttatatcatgggcttattcttggggtggaggtataatgggagattggacttggagaagaggttcttcttatattcatagtggttatcaaaatccattagttgcttggatattttctactcaatcagcttttaaattaaaatcttccactggtaataaagattggtcggtttccttggatcgtcaattagaatttatgagatggttacaaactcctgaaggttgtattgctggaggtgcaacaaattcatgggaaggacaatataatacaccacctcaaaatataaccaatttttatggtatgtattatgattggcaaccggtttatcataatccatcctcaaataattggataggtatgcaagctcgaagtatagaacgagtttgttctttgtattatctttctggaaatcaaaaagctgaattaatatgtcaaacatgggtagaatggattaaaaaaaatatacaaattcatgattatgaaattattcatgctacaaaacttacatgggaaggtaatccagatgattgggattcatctagtttttataaaagtggcattaatacctctcttcatggtacagtttttgaaatgggatttgatcttggttctatggcttctattgttaaaagtcttttatgggtatcgatgaaagataatgatcaagaaggacttgatcttgctattcaaattatggatattattgaaaattataaggatgatttgggttatgccgtagaagaatttcatgataattattcaaaatttgcaaatccagtatattttcccaatgattggaagggtagaaatcctcaaggagcttatttaaaaagaggagcttgtttccttgatattcgaccaaaatataaagaagatcctgattggtatcaagttgaatattatcttaatgggtatgaaaatcctccagtatttacttatcatagattttgggttcaagctgaaattatgattgctaatggacttctttccattta

SEQ ID NO: 24837 - DNA, 1095 bp, Anaeromyces robustus
  Glyco_hydro_48
tttaaataaaattacaaaaatgagtgattatatgttatattttataaataatgatgcttcattacaatcttttaattctgactcaacggatgaaaataaaaattatctattatcacgttacttttcttggaaaggaagtatacatggaaaatggttaacaaagaaaataatttccaatataattggtattggaagtcaaaatccatttgttgcatatattttatcaaatgtcaaagaatttaattcagaaaatcctaattctgtaaataaatggaaaaaatcatataaaaggcaaattgaatttattcgttggttacaaagttcggaaggagcaatagtaggaaacgcaaaatatccttctaatattgatgatataaatcataaatcttctttttatgatcttatatttacttcatcaaatgaagaagaaaatgatttatttagtactcaatgctttgtttttgaaagtattgctgaactttattatattactaaagataaagatattgaaataattttatttaaatggcttgattgggtattatctgtttttcatttaacaagtgatagatcatttagaattccaaataaattatcatttgaaggtcatccggaaaaatggaaaccaaatacaagtattgaagatcatgaaaatgataatttaaatgttattgttgaagattacaataataatataggggttgcagcatcattatcaaaaattctattattggttggtaaaaaaaataataatgatgattatttaactttaggaagagatatattagaaaaaattgaattaataaataaagatgaatatggatatgctactgaagaaatattttataattatcgtttatttaataaaaaattaccaattcaaaaagatttcaaaggtgtttatggtcaatccgcaaaaattaatgataaatcaacatttatatctattcgtccttattataaaaaagataaaaattggaaaataattaaatcctatttaaatgatggaacaccagttccatcatttaaataccatagattttgggaacaatgtgaaattttattagcacaaggtctttattctcaatattatac

SEQ ID NO: 24838 - DNA, 1758 bp, Piromyces finnis
  Glyco_hydro_48
tcaaaatcattatgataaattaaatataaataattcttcctctatatactacaatgctgattcaataccatattctactttagaaaccctatatatagatcaaaatgtagattatggtcatttaacaacattaaaggaaatttcatataaactatggatagaagcattacaaggaaaaatttcaggaaaatggaaaccttttgttaatgcatggaacatatttgaaaataatatgataccaaaggatgaaagtcaaaaaggaaatagtaaatactattcaacaacaaataattcaataaatacaaaggattcactttataaagaattatatgaacaatatcaaacctggtctctatatttaccacataatattattgataccgataattggaataaatattttagtagcaaaaataaaaaaagattcattaaaaatcataaaaataatgataaagattcaatatggtgttcattattttatccaagtataattaactctaataattatttaaatccatatttggataatgaaattactgaaataaagcaatgggaatatattagtgattctcgttacatttcaaaaataatagaatcggtttatagggcttattgctggtcaactgagcaaaaaaagaataaatttatgaaaccaatacttaaaaaaatcataaaaatgagtgattatatgttatattttattaatagtgatgattcgctacaatcatttgattccgaatcaaatgaagacaataagaattatttattatctcgatacttttcatggaaaggcagtatggaaggaaagtggttagaaaaagaagttactacagatattattggtattggaagtcaaaatccattaattgcttatgtcttatcaaatgataaaaacttcaattcagaaaaccctgaatttgtatcaaaatggaagaaatcataccaaagacaaattgaatttatacgatggttacaaagttctgaaggagctattgttggtgtagctcaatacccttcaaatcataatttaagctcaaaaaaaatgccttccttttataatttaatattctcaaaaaattttgaagttgaagaaaataatttatttggtactcaatgttatgtttttgagagtcttgctgaactttattatattactaaagataaggatattgagattataataacaaaatggttagattgggttttatccgtttttcatttaacaagtgatcgattatttaaaattccaaataagctaacctttgaaggacaaccaaaagattggaatcaaaaggatggtataaagaatcacaaaaatgataaattaaatgttatcgttgaagactataacaatagtattggtgttgctgcctcattgtcaaaaatcttattattaattggaaaaaaaaataataatgaagattatctaacgcttggtagagatattttagaaagaatagaaatatcaagtaaagatagtcaaggttattcagtaaccgaaactttttatcaatatcgtcgttttaataaaaaattaccaataccagaaggatttaaaggaatgtatggaagatcatcaaaaattaatgataaatcaacctttatctccatacgtccatactataaaaaggacaaagattggaaaataataaatacctttttaaataaaggaacaaccattcctacttttaaatatcacagattttgggaacaatgtgaaatattattagcacaaggtctttactcacaatattacac

SEQ ID NO: 24839 - DNA, 603 bp, Piromyces finnis
  Glyco_hydro_48
gtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttattgccatttacga

SEQ ID NO: 24840 - DNA, 1866 bp, Piromyces finnis
  Glyco_hydro_48
tagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttattgccatttacga

SEQ ID NO: 24841 - DNA, 1863 bp, Piromyces finnis
  Glyco_hydro_48
tagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttacgctgctgaagaacaacgtcttgactacgaaaagttcggtggagaagtttacattccatctggctggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccattta

SEQ ID NO: 24842 - DNA, 600 bp, Piromyces finnis
  Glyco_hydro_48
gtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttacgctgctgaagaacaacgtcttgactacgaaaagttcggtggagaagtttacattccatctggctggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccattta

SEQ ID NO: 24843 - DNA, 600 bp, Piromyces finnis
  Glyco_hydro_48
gtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttatctctattta

SEQ ID NO: 24844 - DNA, 1863 bp, Piromyces finnis
  Glyco_hydro_48
tagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttacgctacctacgaagaacgtcttgactacgccaacttcggtcaagaaacttacattccatctggctggagtggtaagaacgctcaaggtgccaacattaagagcggtgctactttcattgacattcgtccaaagtacaaggaagatccagattgggctcaagtcgaagacttcctcaacggaggtaacccaccagccttcacttaccacagattctggggtcaaaccgaaattatggttgccaatggtcttatctctattta

SEQ ID NO: 24845 - DNA, 600 bp, Piromyces finnis
  Glyco_hydro_48
gtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccattta

SEQ ID NO: 24846 - DNA, 1863 bp, Piromyces finnis
  Glyco_hydro_48
tagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttccatggaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccattta

SEQ ID NO: 24847 - DNA, 1674 bp, Piromyces finnis
  Glyco_hydro_48
taccggtgattactctggtgttgaaactgcctggagctacattgaaaagcacatgattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttctcttgaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccattta

SEQ ID NO: 24848 - DNA, 1863 bp, Piromyces finnis
  Glyco_hydro_48
tagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccagacagcaagaaccaaccaggtaacagtaagtacaacccatcttccccagctacttacgctgctgaacacgatgatattgatggttacccatctaaacttatcttccaagatggtattgttggtgaagatccaattgctaaggaactttctcaagcctacggtaactgggatatctacatcatgcactggattattgatggtgataactggtacggttatggtcaacaaggtgatggtacttctaagccatctttcattaacaccttccaacgtggtgcttccgaatctacttggaagactgttccacacccatgttgggaagccatgaagtggggtggtcgtaacggtttcttagatcttttcactgttgataactcctacgctaagcaatggagatacactgctgctccagatgctgatgctcgtgctgttcaagctgcttacttcgcctacatctgggctgaagaagatggtgttaacctttcttctgttgctgctaaggctgccaagcttggtgattacttacgttacgctcaatacgataaatacttcaagaagattggtaactgtgttggttctgacaaatgctctgctggtcgtggtaagaactctgctcactaccttatctcctggtacttcgcctggggtggaggtttacaaggtgactgggcctggagaattggttcttctcacactcacagtggttaccaaaacccattagctgcctggattctttctactcaagctgcctttaagccaaagtcttccactggtgctaaggattgggctacttctcttgaccgtcaattagaattattcagatggttacaaactccagaaggttgtattgctggtggtgccactaactcatggcaaggttcttacgctcaaccatccagtgatatcactaccttctacggtatgtggtacgactggcaaccagtttaccacgacccaccatccaacaactggactggtatgcaaggttggggtatggaacgtgtctgttccttatactacgtttccggtgatgaaagagctggaaaggtttgccaagaatgggccaagtgggttaaggacactactcgtgtcagtggtggtgaaattgttcacgctactaaccttgactggtctggtaacccagatgaatggaattcttccaacttcaacaagtctaaccttaaccgttcccttcacggaactgtttcttccgaaggtgttgatcttggttccatcgcttctatcattaagggtttaatgtgggtttctatgagagatggtgaccaagaaggtattaacctttctattgaagttatggatgccattgaaaactacaaggatgatcttggttactcttcccacgaagctcgtggtgattacgacaagttcggtggtgaagtttacattccatctggttggactggtaagaatgctcaaggtgccaacattaagagtggtgttactttcattgatatccgtccaaagtacaagcaagatccagattgggctcaagttgaagaataccttaacggtggtaacccaccagaattcaactaccacagattctgggctcaaactgaaattgctgttgctaacggtcttatttccattta

SEQ ID NO: 24849 - DNA, 1098 bp, Neocallimastix californiae
  Glyco_hydro_53
taaaggtgttgatatctctagtattatttctttagaaaatagtggtgttcaattctacgatactaatggtcaacctcaagatatctttaaaacccttgcaagtgttggagtcaattgtattcgtgttagaatttggaattctccaagaagtactgatggaaaaacttatggaggaggaaataatgatcttgaagtagccagagaaataggtagtagagctgcgaaggctggacttccattatttgttgattttcattattcagatttctgggcagacccagccaaacaatctattccaaaagaatggaagggttttgatttaaataaaagaatttttgaaatttatagatttacaaaaggttgtttagaatggcttttagaaaatggatcatatatatctatggttcaaattggtaatgaaactacttgttttatgtgtggtgaaaatgaaatggtcaatgttatgaaaatgatgagtaatggtatccaagctgtacgtgatattaataaaaatatattaattgcacttcatttcaccaatcccaataaaacagataatatgttatggtatgcttctcaacttgctgaagcaaaagtagattatgatgttttctgtacttcctattatccattttggcatggaactactgaaaatttacaatggatattaggagaaattgctaataaatatggtaagaaagttatggttgctgaattttcatatccatatactgaagtagcaaagacatcagataattgtgaatacagtcatgttaatcataagttagaaggtaccgagtttaattatccattaacattagatggacaaattcaatgtataaaagatgtttatagtcacataaaaaatacaaagaatggtattggggccttctattgggaaccagcatggattgcacccaaagctagtaatgatttagaaagaagacaactttgggaaaaatatggttctagttgggctacaaaaactgcagctgagtatgatattaatgccgatagtagtcttaccggtgaatcagcatgggataatcaagcagtttttgatcaagaaggaaaacctttaaaatccatttgggcact

SEQ ID NO: 24850 - DNA, 1098 bp, Neocallimastix californiae
  Glyco_hydro_53
taaaggtgtcgacatttccagtattatttctctagaaaatagtggtattcgtttctacgacactaatggtcaacaaatagacatttttaaaatgtttgctagtgttggggttaattgtatccgtgttagaatttggaataacccaaagagtgctaatggaaaaacttatggtggtggtaataatgatcttgaagtagctagagaaataggtagtagagcagcaagtgcaggcctaccattatttgttgattttcattattctgatttctgggctgatccaggaaaacaaactattccaaaagattggaaaaactttaatcttgataaaagagtctctgaaatttatagatttactaaaggttgtttagaatggcttttacaaaatggttctcttatttcaatggttcaaattggtaatgaaactacatgctttatgtgtggtgataaaaatatgacaaatgttatgaaaatgatgagcaatggtgcaaaagctgtacgtgaaattaatagagatatattaattgctcttcattttacaaatccaaataaatcagacaatatgttatggtatgcttctcaactcgcttctgctagagttgattatgatgtttatagtacttcttactatccatattggcatggtactactgataatttaaaatgggtattaggagaaattgctaataaatatggtaagaaagttatgattgctgaatattcttacccatatactgaagttgcatatacatcagataattgtcattatggtgttgtagactctaaagcaagcggtactgtattccgttatccaattagtgttgatggtcaaattcaatgcattagagatatgtattctgttatgagaaatacaaagaatggtattggtgctttctattgggaaccagcatggattgctccaaaagcaagaaatgatatggaaagaagacaaatttgggagcaatatggttccagttgggctaccaaaactgcagctgaatatgattcaaatgctgatagaaaccttacaggaggtacatcatgggataatcaagctattttcgatcaaaatggaaaagttttaaaatctatttgggcttt

SEQ ID NO: 24851 - DNA, 1098 bp, Anaeromyces robustus
  Glyco_hydro_53
taaaggtgttgatatatctagtattatttcattagaaaatagtggtgtaaaattttataatcctttaggtcaagaacaagatctcttccaaattcttgccaatgttggtgtaaattgtattcgtgttagaatttggaattcaccaaagaatgccaatggaaaaacatatggtggtggtggtaatgatcttgaagttgcaagagccattggtagtagagctgctcgttatggtctttcattatttgttaatttccattattctgatttctgggctgatccatcaaaacaaactattccaaaagaatggaaaaattttgaccttgataaacgtatttttgaaatttacagatttactaaaggatgtttagaatggcttttagaaaatggttcaattatttctatggttcaaattggtaatgaaactactagttttatgtgtggtgaaaagaatatgactaatgtaatgaaaatgatgagtaatggtgttaaagctgttcgtgatattagcaagaatatagtagttgctcttcattttactaatccaaataaagctgatactatgttatggtatgcttctcaacttgcctctgctagagttgattatgatgtatttgccacttcatattatccatactggcatggtacccttgataatttaaagggagtattaaataaaatagctaaccaatatggtaagaaagttctcattgctgaatattcttatccatacacaaacgctgctttaactgatgatagatgtcattatgaattaatttcatctagtacaagtaatatccaactccgttatccagttagtattgacggtcaaattcaaagtattagagatatttacaaaactattaaagaaattaaaaatggtattggtgctttctattgggaaccagcttggattgctccaaaggcaagaaatgatgccgaaagaaaacaaatttgggaaaagtatggttctggttgggcaagtactcctgctgctgaatatgatagtgatgttgatagatatcaaactggtggaactacatgggataatcaagctgtttttacacaaaatggtaaaccattagattcactttatgcatt

SEQ ID NO: 24852 - DNA, 960 bp, Neocallimastix californiae
  Glyco_hydro_6
taatccatactatgttgaagaagttgatggagcaattgctcaaatgtccgattcttcccttattgctaaggctgaaaagatgaagacctactctaatgctatctggttagataccattaagaacatgcaaagttggttagaatctaacttacaaggagctcaatctcaacaccaatctagtggtaaggatgttttaactgttttcgtcgtttacgatttaccaggtcgtgattgtcacgctcttgcttctaatggtgaacttcttgctaacgatggtgattttactcgttacaagtctgaatacattgatgtcattgaaggtcacttaaagacttacaaatctcaaccagttgttcttattgttgaaccagattcacttgctaacatggttaccaatcttgattccactccagcatgtcgtgattctgaaaagtattacatggatggccatgcttacttaattaagaagtttggtgttcttccacatgttgctatgtatcttgatattggtcacgccttctggttaggttgggatgacaaccgtgaaaaggctggtaaggtttatgccaaggttatcagctctggtgctccaggtaaggttcgtggtttcactgataatgttgctaactacactccatgggaagatccaactctttctcgtggaccagaaaccgaatggaacccatgtccagatgaaaagagatacttacaagctattcaaaaggacttcaagtcagctggtattcaatcagtttacttcgtttgtgatacttctcgtaatggtaagaaggttgaccgtaagcacccaggagaatggtgtaaccaaactggagttggtattggagccagaccacaagccagtccagtttctggtatggaataccttgatgctttctactggattaagccacttggtgaatctgatggtacctctgatgaaagtgcagctcgtttcgatgg

SEQ ID NO: 24853 - DNA, 912 bp, Neocallimastix californiae
  Glyco_hydro_6
agattatcaaaagcaagttaagagttcttatgataaattaatggctgaaggtgaaactgaaattgctgaacttgtcgctaaagttgctagatatccaactccaacttggttagctaacacagctgcttctaagctcgttccaaaagttttagctcaagttactgaacaaatgaaaaagactggtaagaaggtattaacttctttcattatttacaacttaccaaacagagattgttctgctgttgcctctagaggtgaattaggtattgaacaccttggagtttacaaggaatggattgatgaaattgctggttactttgctgctcacgaaggaccaattgttgctattattgaaccagatgcccttggtaacatggttagtaacagtaacagtgaactctgtgctgaggctttcgaaactcaaatggaagctcttgtctatgctattactaagcttaacttaccaaatgttggtgtttaccaagatgttgcccaagttggttggttaggttggggaggtaacatgaatttacttattccaattcttgaacaactcttaaacaaggtcggtactggtgttttacgtggtttcagttccaacatttctaacaaccaaccattagttagaccagatccaccagaaagaactttaagtggtaactccagtcaaagtgaatacgaatacagtttgaaagttagagaaaacttaaaaaaggttggtatggttgactttggatgggttgttgatacctcacgtaatggtgtaccaaatatcaagaccaaaggtgaaaattggtgtaacattaagggtgccggtattggaagaagaccagaggcttctccagctgatttaccaggacttgatgctgtttactggttcaagccaccaggtgaatctgatggtagtgacag

SEQ ID NO: 24854 - DNA, 273 bp, Neocallimastix californiae
  Glyco_hydro_6
taatccatactatgttaaagaagtcgaaggtgccattgctcaaatgtcagattcttcccttattgctaaggctgaaaagatgaagactttctctaatgctatctggcttgattctatcaaaaacatgcaaagttggttagaatcaaatttgaaaggtgctcttgctcaacaaaatgcttctggtaaagatgttttaactgttttcgtcgtttacgatttaccaggtcgtgattgtcacgctcttgcttctaatggtgaacttcttgctaacga

SEQ ID NO: 24855 - DNA, 957 bp, Neocallimastix californiae
  Glyco_hydro_6
taatccatactatactgctgaagttgatgccgcaattgctcaaatgagtgattcttcccttatcgctaaggctgaaaagatgaagacatactctaatgctatttggttagataccattaagaatatgaatgagtggttagaaaagaatttaaagggagctcttgctcaacaaagtggaagtaagaaggttttaaccgtttttgtggtttacgatttaccaggtcgtgattgtcacgctcttgcttctaatggtgaacttctcgccaatgatggtgatttagctcgttacaagtctgaatacattgatgttattgaaggtcacttaaagacttataaatctcaaccagttgttcttattgttgaacctgattcacttgctaacttagttactaaccttgaatctactccagcttgtgctgactccgaaaaatactatcttgatggtcatgcttacttaattcaaaagtttggtattcttccacatgttgctatgtatcttgatattggtcacgccttctggttaggttgggatgataaccgtgaaaaggcagctaaggtttactctaaggttatcagttccggttccccaggtaaggttcgtggtttcactgataatgttgctaactacactccatgggaagatccaacactttctcgtggaccagacactgaatggaacccatgtccagatgaaaagagatacttagaagccatgcacaaggacttcaaggcagcaggtattagttccgtttacttcgtttgtgatacttctcgtaatggtaagaaggttgaccgtaagcacccaggagaatggtgtaaccaaactggagttggtattggtgccagaccacaagctagtccagtttctggtatggaataccttgatgctttctactggattaagccacttggtgaatctgatggtacctctgatgaatctgcagctcgtttcgatgg

SEQ ID NO: 24856 - DNA, 942 bp, Neocallimastix californiae
  Glyco_hydro_6
caatccatactatgttgaagaagttgatggagctattgctcaaatgtctgactcttccctcattgctaaggctgaaaagatgaagacttactctaatgctatttggttagatactattaagaatatgcaaagttggttagaatctaacttacaaggagctcaatctcaacaccaaagtagtggtaaagatatcttaacagttttcgttgtttatgatttaccaggtcgtgattgtcacgctcttgcctctaacggtgaacttcttgccaatgatggagatttagctcgttacaagtctgaatatattgatgttattgaaggtcacttaaagacttacaaatctcaaccagttgttcttattgttgaacccgattcacttgctaacttagttactaatcttgaatctactccagcttgtgctgattctgaaaaatactatcttgaaggacatgcttatttaattaagaagcttggtgttcttccacatgttgctatgtatcttgatattggtcacgctttctggttaggttgggatgataatcgtgaaaaggctggtaaagtttatgctaaggttattagttctggtgctccaggtaatgttcgtggtttcactgataatgtttctaactacactccatgggaagatccaactctttctcgtggaccagaaactgaatggaacccatgtccagatgaaaagagatacttagaagctatttctaaggacttcaaatcagcaggtatcaaatccgtttactttgtttctgatagttctcgtaatggtaagaaggttgatcgtaagcacccaggagaatggtgtaaccaaactggtgttggtgttggtgccagaccacaagccagtccaatttctagcatggaataccttgatgctttctactggattaagccacttggtgaatccgatggtacttctgatgacta

SEQ ID NO: 24857 - DNA, 852 bp, Neocallimastix californiae
  Glyco_hydro_6
cagtcaataccaaggtgaagttcaatcttctattaataaattaagtggtgaattacaacaacaagctaacagagtaaaatacactccaactgctgtttggttagcttgggatggtgctccaggtgaagttccaaagcatcttggtgctgctggtggtaacactgctgtcttcatgatgtactggatcccaactcgtgattgtaacagtaatgcttcccaaggtggtgcttctgacttaaattcttacaagaattacgttgacagtgtttacaattcattcagatcctatggtaacagtaaaattgttgttgtcgtcgaaccagatactcttggtaacatggtgacttctcaaggtaatgaaaactgtagaagaactgctgttattcataagcaagctcttgcttatgctataaacaaattcggtagtcttaacaatgttcaagtctaccttgatgccggtcacagtcaatggttaaccggttatgaagatgaaactgctgaaattattaaggaaatattagatatggctccacaaggtaagattcgtggtttctccactaatgtatctaacttccaacctgtccaaagagaatatgaatatcatactcgtctttacgatgctcttgaaaaggttggtgtcaagaatatgagattcatcgttgatactagtcgtaatggtgttgatatcagtgaagaatttgcaaagactaagacctggtgtaactttgttggtactggttttggtgaacgtccaaagggtaatccagacccagttaacatgccattattagatgcttatatgtggttaaagccaccagcagaatctgacggttcttctactggtgctcgtgc

SEQ ID NO: 24858 - DNA, 960 bp, Neocallimastix californiae
  Glyco_hydro_6
taatccatactatgttgaagaagttgacaatgccatttcccaaatgtctgactcttcccttattgctaaggctgaaaagatgaagacttactccaatgctatttggttagataacattaaaaacatgcaaagttggttacaaccaaacttagaaggtgctctctctcaacaaaatagtggtggtaccccagttttaactgtctttgttgtttatgatttaccaggtcgtgattgtcacgctcttgcctccaatggtgaacttcttgccaatgactctgatatggaacgttacaagtcagaatatattgatgttattgaaggtcacttaaagacttacaagtctcaacctgttgttcttgttattgaaccagattcccttgctaacatggtcactaacattgaaagtactccagcttgtgctgattctcaaaattactactttgatggacacgcctacttacttaagaagcttggtgtcttcccaaatgtagccttatatcttgatattggtcacgccttctggttaggttgggatgataaccgtgaaaaggctgcaaaggtctatgctaaggttattcaatctggtgcaccagctaaggttcgtggtttcgttgataacgttgctaactacactccatgggaagacccaactctttcacgtggtccagatactgaatggaacccatgtccagatgaaaagagatacttagaagctatgcacaaggactttactagtgccggtattcaatctgtctacttcttctctgattcctctcgtaacggtaagaagactgaccgtaagcacccaggtgaatggtgtaaccaaaccggttgtggtattggtgccagaccaaaagccagtccaatctctggtatggaataccttgatgccttctactgggttaagccaattggtgaatctgatggtacctcagatactagtgctaagcgttatgatgg

SEQ ID NO: 24859 - DNA, 579 bp, Neocallimastix californiae
  Glyco_hydro_6
taacccatactatgttgatgaagttgatggagccattgctcaaatgtccgattcttctcttattgctaaggctgaaaagatgaaaacttactctaatgctatttggttagataccattaagaacatgcaaagttggttagaatctaacttaaagggtgctcttgctgaacacaattcaactggaaaggatattttaactgttttcgttgtttacgatttaccaggtcgtgattgtcacgctcttgcttccaatggtgaacttcttgccaactctggtgatatggaacgttacaagtctgaatacattgatgtcattgaaggtcacttaaaggaatataactctcaaccagttgttcttattgttgaaccagattctcttgctaacttagttactaatcttgaatctactccagcttgtcgtgattctgaaaagtattatcttgatggtcatgcttacttaattcaaaagcttggtgttcttccacatgttgctatgtatcttgatattggtcacgccttctggttaggttgggatgataatcgtgaaaaggctggtaaggtttatgccaaggttattca

SEQ ID NO: 24860 - DNA, 844 bp, Neocallimastix californiae
  Glyco_hydro_6
taacccatactatgttgatgaagttaatggagccattgctcaaatgtccgattcttctcttattgctaaggctgaaaagatgaagacttactctaatgctatttggttagataccattaagaacatgcaaagttggttagaatctaacttagaaggagctctttctcaacaagaatctactggtaagaaagttttaactgttttcgttgtttacgatttaccaggtcgtgattgtcatgctcttgcttccaatggtgaacttcttgccaactctggtgatatggaacgttacaagaccgaatacattgatgtcattgaaggtcacttaaagaaatacaagtctcaaccagttgttcttattgttgaaccagattctcttgctaacatggttactaatattgaaactactccagcttgtgctgattcacaaaactattactatgatggtcatgcctacttacttaagaagtttggagttcttccacatgttgctatgtatcttgatattggtcacgccttctggttaggttgggatgataatcgtgaaaaggctggtaaggtttatgccaaggttattcaatcaggttcaccaggtaaggttcgtggtttcaccgataatgtttcaaactacactccatgggaagatccaactctttctcgtggaccagaaactgaatggaatccatgtccagatgaaaagagatatttagaagctatgcacaaggacttcaaggcggcaggtattgaatcagtttactttgtttccgatacttctcgtaatggacacaagactgaccgtaagcacccaggagaatggtgtaaccaaacaggagttggtattgga

SEQ ID NO: 24861 - DNA, 405 bp, Neocallimastix californiae
  Glyco_hydro_6
caatccatactatgttgaagaagttgatggagctattgctcaaatgtctgactcttcccttattgctaaggctgaaaagatgaagacttactctaatgctatttggttagataccattaagaacatgcaaagttggttagaatctaatttacaaggagctcaatctcaacaccaaagtagtggtaaggatatcttaactgttttcgttgtttacgatttaccaggtcgtgattgtcacgctcttgcttctaacggtgaacttcttgccaatgatggagatttagctcgttacaagtctgaatacattgatgttattgaaggtcacttaaagacttacaaatctcaaccagttgttcttattgttgaacccgattcacttgctaacttagttacaaatcttgaatc

SEQ ID NO: 24862 - DNA, 849 bp, Neocallimastix californiae
  Glyco_hydro_6
cccaaactatgttaaagaaattgaatcaactattccagatttgagtccagaattacaagcaaaagccaagaatgttgaaaaggtttcttctgctgtttggttagcctatgaaggtgctccaaatgatgttgctccacatcttaaagctgctggttcaaagactgttactttcattctttatatgattccaactcgtgattgtaatagtttagcttctgctggtggtgtttctgatcttgacaagtacaagggttatgttgacaagattgctaacactattaagaaattcccagaatctaaggttgttatggttattgaaccagatactcttggtaatcttattacaggtgaaactgaagcttgtaagaatgttcacactttacataagcaagctttagcttatgccgctaatgttttcggtaacatgagtaatgttagtgcttatcttgatgctgctcatagtaaatggttaggatgggctgctgataaggttgccgctgttgttaaggaaattttagacaatgctccaaatgctaatattcgtggttttagtactaatgtttctaattacatgccaattgaagctgaatatgaatatcatcaaaaactccatgatgctcttgaagaagtcggtattaaggacaaaagattcattgttgatactggtcgtagtggtgttgatgtacgtgaagaattcgatgttaaccaaacctggtgtaatttaatttatgctggtttaggtgaaccatcacgtggaagtccagatccagaaaatatgccattattagatgctttcatgtggctcaaaccaccaggtgaagctgatggttctgacactggttctagagc

SEQ ID NO: 24863 - DNA, 256 bp, Neocallimastix californiae
  Glyco_hydro_6
caatccatactatgttgaagaagttgatggagctattgctcaaatgtctgattcttccctcattgctaaggctgaaaagatgaagacttactctaatgctatttggttagatactattaagaatatgcaaagttggttagaatctaacttacaaggagctcaatctcaacaccaaagtagtggtaaggatatcttaacagttttcgttgtttatgatttaccaggtcgtgattgtcacgctcttgcctctaacggt

SEQ ID NO: 24864 - DNA, 960 bp, Neocallimastix californiae
  Glyco_hydro_6
taatccatactatgttgaagaagttgataatgccatctcccaaatgtctgactcttcccttattgctaaggccgaaaagatgaagacctactctaatgctatttggttagataatattaagaatatgcaaagttggttagaaccaaacttaaagggtgctctctctcaacaaaacagtggtggtactccagttttaactgtctttgtcgtttacgatttaccaggtcgtgattgtcacgctcttgcctccaatggtgaacttcttgccaatgactctgatatggaacgttataagtcagaatacattgatgtcattgaaggccacttaaagacttacaagtctcaacccgttgttcttgttattgaaccagattcccttgctaatatggttactaacattgaaagtactccagcttgtgctgattctcaaacttactattatgatggacacgcctacttacttaagaagcttggtgtcttccccaatgtagccttatatcttgatattggtcatgccttctggttaggttgggatgataaccgtgaaaaggctgcaaaggtttattctaaggttattcaatctggttctccagcaaaggttcgtggtttcgttgataatgttgctaactacactccatgggaagacccaactctttcacgtggtccagatactgaatggaacccatgtccagatgaaaagagatacttggaggctatgcacaaggacttcaaggcagctggtattcaatctgtctacttcttctctgattcatctcgtaacggtaagaagactgaccgtaaacacccaggtgaatggtgtaaccaaactggttgtggtgtcggtgcaagaccaaaagcaagtccaatctctggtatggaataccttgatgccttctattgggttaagccaatcggtgaatctgatggtacctctgatactagtgctaaacgttatgatgg

SEQ ID NO: 24865 - DNA, 220 bp, Neocallimastix californiae
  Glyco_hydro_6
taatccatactatgtcgaagaaattgaaggtgctattgctcaaatgtctgattcttcccttattgctaaggctgaaaagatgaagacttactctaatgccatctggcttgattccatcaaaaatatgcaaagttggttagaaactaatttgaagggtgctctttctcaacaaaatgcttctggtaaagatgttttaaccgttttcgttgtttacgattta

SEQ ID NO: 24866 - DNA, 921 bp, Neocallimastix californiae
  Glyco_hydro_6
taatccatattatactactgaagttgatgctgccattactaaaataagtaacgcttctcttattgctaaggctgaaaaaatgaaggaattctcaaatgccatttggttagattctattaaaaatatgaacgaattgcttgaaagcagtttaaatggtgctcttgctcaacaagaaagtggatataagaaagttttaaccgtttttgttgtttacaatttaccaggtcgtgattgtcatgctcttgcttctaatggtgaacttcttgccaatgatgctgactttgatcgttacaagtctgaatacattgatgttattgaaggtcacttaaagacttacaaatctcaaccagttgttcttattgttgaaccaaattcacttacaaacttagtgactaaccttgaatctactccagcttgttctgattccgaaaaatactatcgtgaaggaaatgcttacttaattaagaagtttggagttttaccacacgttgctctatatcttgatattggtcatgcctatttattaggttgggatgatactcgtgaaaaagctgctagactttaccatgatgttattagatcaggtgctccaggtaatattcgtggttttgctgataatattggtggcttcgttccatgggatgatccaaatctttctaatggaccagaaactgaatggaatccatgtccagatgagaagagatacttaaaagctatgtacagcgatttcgtgtctgcaggtattcatagcgttaaattcgttactgatacttcacataatggtaagaagtttgattatagtgatagggaattatggtgtaaatcaacatctgctggtgttggtgctagaccaatggctattccaattactactatagattatcttgatgctttctattggattaagccatttggtaacgt

SEQ ID NO: 24867 - DNA, 906 bp, Neocallimastix californiae
  Glyco_hydro_6
tcaaaagcaagttaagagttcatacgataaattaatagctgaaggtgaaacagaagttgcagaaattgttgccaaggttgctagatacccaactccaacttggttagccaacacagcggcttccaaactcgttccaaaggttttagcccaagttactgaacaaatgaaacagactggtaagaagattttaacttctttcattatttacaatttaccaaacagagattgttctgctgttgcctcaagaggtgaattaggtacagaacatcttggtgtctataaagaatggattgatgaaattgcaggttattttgccgctcatgaaggaccaattgttgcaattattgaaccagatgcccttggtaatatggttggtaatagtaacagtgaactttgtgctgaagcttttgaaactcaaatggaagctcttgtctatgccattacaaaacttaacttaccaaatgttagtgtttaccaagatgttgcccaagttggttggttaggttggggtggtaacatgagattacttattccaattcttgaacaactcttaaacaaagtcggtactggtgttttacgtggtttcagttctaacatttctaataatcaaccattaacaaaaccagatccaccagaaaaaactttaagtggctgcacaagtcaaagtgaatatgaatacagtttgaatgttagagaagccttaagaaaagttggtatggtagactttggatgggttgttgatacctctcgtaatggtgttccaaatattaagactaagggtgaaaattggtgtaatattaagggtgctggtattggtagaagaccagaagctacaccagaagatttacctggtcttgatgctgtttactggttcaaaccaccaggtgaatctgatggtagtgacag

SEQ ID NO: 24868 - DNA, 852 bp, Neocallimastix californiae
  Glyco_hydro_6
cttcaaattccaaggtgaagttgattcttccattaaaaagttaagtggtaatgttaagcaaaaggccgaaaaggtaaaatatgttccaacggctgcttggttagcttgggaaggtgcccccaatgaagttccacaataccttgatgaagctggctcaaagaccgtggtcttcgtcttatatatgattccaactcgtgattgtaatgctaatgcctctgctggtggtacagccaatattgataagtacaagtcctacgtggataagatttacaacaccattaacaaatatccaaactctagaattgttatgattcttgaaccagatactattggtaaccttgtcactgctaacaatgccaactgtagaaatgtccaaaatatgcataagcaagctctctcctacgccatcagtaaatttggtactcaaagtaatgtaagagtctatcttgatgccgctcacggtgcctggttaaacccacacgcggataagaccgctcaagtaattaaggaaatcttaaacaatgctggtaatggaaaacttcgtggtatcagtaccaatgtttctaactaccaaagcgttgccagcgaatacaaataccatcaaaaccttaacagagctcttgaaaaccttggtgtcagaggcttaaagtttattgttgatacctctcgtaacggtgctaacgttgaaggtgccttcaatgcctccggtacctggtgtaacttcaagggtgccggtttaggtgaacgtccaaagggtaatccaaacccaggtagtatgccattacttgatgcctacatgtggattaagactccaggagaagctgatggttcctctcaaggttctagagctga

SEQ ID NO: 24869 - DNA, 849 bp, Neocallimastix californiae
  Glyco_hydro_6
tagtcaataccaaagtgaagttcaatcatctattaacaaattaagtggtgaattacagcaacaagcttctagagtaaaatacaccccaaccgctgtttggttagcttggtatggtgctccaaatgaagttccaaaacatcttggggctgctggtggtaacactgctgtcttcataatgtactggattccaactcgtgattgtaacagtaatgcctctcaaggtggtgctagcgacttaaattcttacaagaattatgtcgatagtgtttataacaccttcagatctaacggtaacagtagaatcgttattgttattgaaccagatactattggtaacatagtgacttctcaagggaatgaaaattgtagaagaactgctattattcataaggaagcccttgcatatgccgttaacaaatttggtagtcttaacaatgttcaagtttatcttgatgccggtcacagccaatggttaaccggttatgaagatgaaactgctgctattattaaagaaattttagatatggcaccacaaggtaagattcgtggattctccactaatatttctaacttccaacccgttcaaagagaatatgaatatcatactcgtctttatgatgctcttgaaaaggttggtatcagcaatatgagatttattgttgatactagtcgtaatggggttgatatcagtgaagcctttgctaagactaagacctggtgtaactttgttggtactggttttggtgaacgtccaaagggtaatccagatcctataaatatgccattattagatgcttacatgtggttaaagccaccagcagaatctgatggttcttctcaaggtatgcg

SEQ ID NO: 24870 - DNA, 960 bp, Neocallimastix californiae
  Glyco_hydro_6
taatccttattatgttgaagaagttgatggtgccattgctcaaatgattgatgcttctcttatttcaaaggctgaaaaaatgaagactttctcaaatgctatttggcttgatactatcaaaaatatgcaaagttggttagaacctaatttaaagggagcccttgctcaacaaaagtctgccggaaaggaagttttaacggttttcgttgtttacgatttaccaggtcgtgattgtcatgctcttgcttccaatggtgaacttcttgctaataaaggagattgggctcgttacaagtccgaatatattgatgtcattgaagaaaagttaagaacttacaaatctcaacccgtcgttcttattgttgaaccagattcattggctaacatggtcactaatcttgattctactccagcttgtcgtgattctgaaagatattacatggatggccatgcctacttaattcaaaaattcggtgttcttccacatgttgctatgtatcttgatattggtcatgccttctggttaggatgggatgataatcgtcaaaaggccggaaaggtctattccaaggtgattcaatctggagcaccaggtaaagttcgtggtttcacggataatgtggctaactacactccatgggaagatccaaccctttctcgtggaccagaaaccgaatggaatccatgtccagatgaaaagagatacttagaagctattcacaaggacttcacggctgtaggcattccatcggtttactttgtttgtgatacttctcgtaatggtaaaaaggttgatcgtaagcatccaggagaatggtgtaaccaaactggagttggtattggtgccagaccacaagccagtccaatttccggtatgccataccttgatgccttttattggattaagccacttggtgaatctgatggtacctctgataccagtgctgctcgtttcgatgg

SEQ ID NO: 24871 - DNA, 960 bp, Neocallimastix californiae
  Glyco_hydro_6
taatccatactacgttgataaagttgacaaggccattgctcaaatgcacgactacgacagttcacttaaatttaaggccgaaaagatgaaggaatactctaacgctatttggttagataccattaataacatggaagcctggttagaaagaaaccttaagggtgctcttgctcaacaaaatgccgaaggtagtagagttttaactgtcttcgtcgtttacgatttaccaggccgtgactgtcaggctcttgcctccaacggtgaacttctcgccaacaatggtgatatgaaacgttacaaatctgaatacattgatatcattgatagacgcttatctacttacaagtctcaaccaattgttcttgttattgaaccaaattcccttgctaacttagttactaaccttgaaaacattccagcttgtgctgactctgaaaaatactacttagatggtcacgcttacttaattaagaagttcggttcccacccacacgttgccatgtacctcgatattggtcacgctttctggttaggttgggatgataaacgtgctagtgccgctaagatttactctaaagttattaaccctggtgctccaggtaaagttcgtggtttcgcttccaacgtcgctaactacactccatgggaagacccagaactttctcgtggcccagacactgaatggaacccttgcccagatgaaaagagatacatcaaagccatgtacaaggaattcaaggctgccggtatctcctctgtttacttcattgaagatacttctcgtaatggtcacaagacttaccgtaaccactcaggtgaatggtgtaaccaaatgggatctggtattggtgccagaccaaaggcttatccagtttccggtatggaatatctagatgctttctactgggttaaaccatacggtgaatctgatggtacttctgatgaatctgataagagttt

SEQ ID NO: 24872 - DNA, 957 bp, Neocallimastix californiae
  Glyco_hydro_6
taacccatactacgttgaagaagttgaaaatgctcttaacaatcttattgattcttctcttagatcaaaggttgaaaagatgaagactttctctaatgctatctggcttgataccattaataacatgcaaagttggttagaaccaaaccttaagggtgctcttgctcaacaccaatctactggtaaggatgtcttaactgtctttgttgtttacgatttaccaggtcgtgattgtcacgctcttgcttccaatggtgaacttcttgctaacgatgctgatgctcaacgttacaagaccgaatacattgatgttattgaatctcacttaaagcaatacactgctcaaccagttgttcttattattgaaccagattcacttgctaacatggttactaaccttgatgatccacactgttctcaatctgaatcctactatatggatggtcatgcttacttacttaagaagtttggtgttcttgaccacgttgctatgtaccttgatattggtcacgctttctggttaggttgggatgataaccgtgaaaaggctgctaagctttacaagaaggttattgactctgcttctccaggtaaggttcgtggtttcgttgataatgttgctaactacactccatgggaagacccaactctttctcgtggtccagatactgactggaacccatgtccagatgaaaagagatacttagaagctgttaagaaggactttacttctgctggtattaagtctgtttacttcgtcagtgatacttctcgtaatggtcacaagaccgaccgtaagcacccaggtgaatggtgtaaccaaactggtgttggtgttggtgctcgtccacaagctagtccagtttctggtatggattaccttgatgctttctactggattaagccacttggtgaatctgatggtacctctgatgaatctgctgttcgtttcgatgg

SEQ ID NO: 24873 - DNA, 960 bp, Neocallimastix californiae
  Glyco_hydro_6
taacccatactacgttgaagaagttgaaaatgctattaagcaaatgactagctcttctcttaaggctaaggctgaaaagatgaagacttactctaacgccatctggcttgataacattaagaacatgcaaagttggttagaaccaaaccttaagggtgctcttgctcaacaccaatctactggtaaggatgtcttaactgtctttgttgtttacgatttaccaggtcgtgattgtcacgctatggcttccaatggtgaacttcttgctaacgattctgatgctcaacgttacaagactgaatacattgatgttattgaaagtcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatggattaccttgatgctttctactggattaagccacttggtgaatctgatggtacctctgacgaatctgctgatcgtttcgatgg

SEQ ID NO: 24874 - DNA, 960 bp, Neocallimastix californiae
  Glyco_hydro_6
taacccatactacgttgaagaagttgaaaatgctattaagcaaatgactagctcttctcttaaggctaaggctgaaaagatgaagacttactctaacgccatctggcttgataacattaagaacatgcaaagttggttagaaccaaatcttaagggtgcactttcacaacaccaatctactggtaaggatgtcttaactgtctttgttgtttacgatttaccaggtcgtgattgtcacgctcttgcttccaatggtgaacttcttgctaacgattctgatgctcaacgttacaagactgaatacattgatgttattgaaaaacaattaaagcaatacactgctcaaccagttgttcttattattgaaccagattcacttgctaacatggttactaacattgaaaccactccagcttgtgctgaatctcaagattactacttcgatggtcacgcttacttacttaagaagttcggtgttcttgaccacgttgctatgtaccttgatattggtcacgctttctggttaggttgggatgataaccgtgaaaaggcctctaaggtttacaagaaggttattgactctggttctccaggtaaggttcgtggtttcgttgataacgttgctaactacactccatgggaagacccaactctttctcgtggtccagaaactgaatggaacccatgtccagatgaaaagagatacttacaagctatgtacaaggactttaccgctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatgg

SEQ ID NO: 24875 - DNA, 957 bp, Neocallimastix californiae
  Glyco_hydro_6
taatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacatcagatgaaagtgcagctcgtttcgatgg

SEQ ID NO: 24876 - DNA, 957 bp, Neocallimastix californiae
  Glyco_hydro_6
taatccatattacactgctgaagttgatgctgccatcgctcaaatgtccgattcttctcttatttctaaagctgaaaaaatgaaaactttttcaaatgctatttggttagatactattaaaaatatgaatgaatggttagaaaagaatttaaagggagctcttgctcaacaaactggaaataaaaaagttttaaccgttttcgttgtttatgatttaccaggtcgtgattgtcatgctcttgcttctaatggtgaactcctcgctaatgattcagattgggctcgttacaaaactgaatatattgatgtcattgaagaaaaattgaaaacttacaaatctcaacctgttgttcttattattgaaccagattcacttgctaatttagttaccaatctcgactctactcctgcttgtcgtgattccgaaaagtattatctcgatggacatgcctacttaattcaaaagtttggtgttcttaaacatgttgctatgtatcttgatattggacatgctttctggttaggttgggatgataatcgtgaaaaggctgctaaagtttattcaaaggttatcagttccggagcaccaggtgaagttcgtggtttcactgataatgttgctaattatactccatgggaagatccaactctttctcgtggtccagatactgaatggaatccatgtccagatgaaaagagatatttagaagctattcataaagatttcgtttcagctggaattaaatcagtttacttcgttagtgatacttcacgtaatggtaagaaggttgatcgtaaacatccaggagaatggtgtaaccaaacaggagttggtgttggtgctagaccacaagctaatccagtttcaggaatggattatcttgatgcattctattggattaaaccacttggagaatcagatggtacctcagatgaaagtgcagctcgtttcgatgg

SEQ ID NO: 24877 - DNA, 960 bp, Neocallimastix californiae
  Glyco_hydro_6
taacccatactatgttgaagaagtggatggtgctatcgctcaaatgtctgattcttccttgatttctaaggctgaaaagatgaagacttactccaatgctatctggcttgattccatcaaaaatatgcaaagttggttggaatcaaatttaaaaggtgctctctcccaacaaaatgcctctggtcaagatgttttaactgttttcgttgtctacgatttaccaggtcgtgattgtcatgctcttgcttctaatggtgaacttcttgccaatgatagtgattgggctcgttataagactgaatatattgatgtcattgaaggtcacttaaagacttacaaatctcaaccagttgttcttattattgaaccagattcacttgcaaatatggttactaatcttgattctactccagcttgtcgtgattccgaaaagtattacatggatggtcatgcttatttaattcaaaagtttggtgttcttcctcacgttgctatgtatcttgatattggtcacgccttctggttaggttgggatgataatcgtcaaaaagctggtaaggtctactccaaagttatcagctctggtgctccaggtaaggttcgtggattcactgataatgttgctaactacactccatgggaagatccaactctttctcgtggaccagaaactgaatggaatccatgcccagatgaaaagagatatttagaagctatgtataaagactttaaggccgctggtattgaatccgtttacttcgtttgtgactcttctcgtaatggtaagaaagttgatcgtaaacacccaggtgaatggtgtaaccaaactggtgctggtgttggttatagaccacaagccaatccaatttcaggtatgagttatcttgatgctttctactggattaagccacttggtgaatccgatggtacttctgatgaaagtgcagctcgtttcgatgg

SEQ ID NO: 24878 - DNA, 849 bp, Neocallimastix californiae
  Glyco_hydro_6
cttcaagttccaaggtgaagttgatacatctattgctaaattaagtggtcaattacaagaaaaggctaaaaaggttaagtacgttccaactgctgcttggttagcttgggaaggtgccactaatgaagttccacaataccttaatgaagctggtgacaagactgttgtctttgtcttatatatgattccaactcgtgattgtaacgctaatgcttctgttggtggatctggtagtttagacaagtacaagggttatgtcgacaacatttacaacactattaacagatatccaaattcaagaattgttatgattcttgaaccagatactattggtaatcttgttactgctaacaatgataattgtagaaacgttcaaaacatgcacaaacaagctctttcttacgccattagtaaattcggtactcaaagtaatgttagagtttatcttgatgctgctcacggtgcttggttaaattcacacgccgatagaactgctcaagttattgctgaaatcttacgtaatgctggtaatggtaagattcgtggtattagtactaacatttctaactaccaacaagttagtgatgaataccaatatcaccaaaaccttaacagagctcttgaaagccaaggtttcagaggtatgaaattcattgttgatacttctcgtaatggtcaaaatgttactgctgccttctctagaaacaacacctggtgtaacttcaagggtgctggtttaggtccacgtccacaagccaatccaaatccaaacatgcctttacttgatgcttacatgtggattaaaactccaggtgaagctgatggttctgctactggttctagagctga

SEQ ID NO: 24879 - DNA, 846 bp, Neocallimastix californiae
  Glyco_hydro_6
ccaagattacgttaaaaagattgaatctactttaaaggatatgactccagaattacaagctaaggctaagaatgttgaaaaggttgcaactgctgtttggttagcttgggaaggtgctccaggtgaagttgaaccacaccttaaggctgctggtaacaagactattacctttattctttacatgattccaactcgtgactgtaatagtttagcttcagctggtggtgctgctgattttgaaaaataccaaggttatgttgacagtattgctgctactattaagaaatacccagatgctaaggttaacatggttattgaaccagatactcttggtaaccttattactggtgaaactgaagcttgtaagaaggttcatgacttacacagaaaagctttatcttacgccgttaacgttttcggtaacatgagtaatgttaatgcttatcttgatgctgcccaccacaaatggttaggttggggaacagacaaggttgctgctctcattaaggacattttagataatgctccagatggtgatattcgtggtattagtactaatgtttctaactaccaatccattgataatgaataccaataccacactgaccttcacgctgctcttgaagctgtcggtattactggaaagaaattcattgttgataccggtcgtagtggtgttgatgttactgaagaattcaatgttaaccaaacctggtgtaaccttatctacgctggtttaggtgaaaaatctcgtggtaacccagatccagaaaagtacccattattagatgccttcatgtggcttaaaccaccagcagaatctgatggttctgatgttggtagcag

SEQ ID NO: 24880 - DNA, 897 bp, Neocallimastix californiae
  Glyco_hydro_6
taagagttcatacgatcaattaattgctgaaggtcaaaacgatgttgctgaaattgttgctaaagttgctagatatccaactccaacttggttagctaatactcaagcttccaaacttgttccaaaggtcttagctcaagttactgaacaaatgaaggctaccggcaaaaagattttaactgctttcattatttataatttaccaaacagagattgttctgctgttgcttcaagaggtgaattaggtattgaacatcttggtgtttacaaggaatggattgatgaaattgcaggttattttaaagctcacgaaggaccaatcgttgctattattgaaccagatgcccttggtaatatggttagtaacagtaatagtgaactttgtgctgaagctttcgatactcaaatggaagctattgtttatgctattaataaacttagcttaccaaatgttagtgtttaccaagatgtagctcaagttggttggttaggttggactggtaacatgaatattcttgttccaattcttgaacaaatcttaaacaaggttggtacaggtaaattacgtggtttcagttctaacatttctaataatcaaccattagttaaaccagatccaccagaagctactttaagtggtaacaagagtcaaagtgaatatgaatacagtttgaatgttagagaagccttaagaaaggttggtattgccgatatgggttgggttgttgatacttctcgtaatggtagaactaacattaagactagaggtgaaaactggtgtaatattaagggtgctggtattggtagaagaccagaagctaatccagctgatttaccagaacttgatgctgtttactggtttaagccaccaggtgaatctgatggtagtgacagaaa

SEQ ID NO: 24881 - DNA, 435 bp, Neocallimastix californiae
  Glyco_hydro_6
taatccatactacgttgacgaagttgacaaggccattgctcaaatgaacggttcacttagaattaaggccgaaaagttgaaggaatactctaacgctatttggttagataccatccataaaatggaagtacgattagaaagaaaccttaggggtgctcttgctcaacaaaatgccgaaggtagtagagttttaactgtcttcgtcgtttacgatttaccaggtcgtgactgtcaggctcttgcctccaacggtgaacttctcgccaacgatggtgatatgaaacgttacaagactgaatacattgatatcattgatagtgtcttaattagttaccattctcaaccaattgttcttgttattgaaccaaattcccttgctaacttagttactaaccttgaaaacattccagcttgtgctgactctgaaaaatacta

SEQ ID NO: 24882 - DNA, 304 bp, Anaeromyces robustus
  Glyco_hydro_6
taacccatactacgttgaagaagttgaaaatgctattaagcaaatgactagctcttctcttaaggctaaggctgaaaagatgaagacttactctaacgccatctggcttgataacattaagaacatgcaaagttggttagaaccaaatcttaagggtgcactttcacaacaccaatctactggtaaggatgtcttaactgtctttgttgtttacgatttaccaggtcgtgattgtcacgctcttgcttccaatggtgaacttcttgctaacgattctgatgctcaacgttacaagactgaatac

SEQ ID NO: 24883 - DNA, 960 bp, Anaeromyces robustus
  Glyco_hydro_6
taacccatactatgttgatgaagttgataaggctattgctcaaatgaccaactcatctcttaaggctaaggctgaaaagatgaagactttctctaacgctatttggctcgataccattaagaacatgaatgaatggttagaaagaaaccttaagggagctcttgctcaacaaaacgcttctaacaagaatgttttaactgttttcgttgtttacgatttaccaggtcgtgattgtcacgctcttgcttctaatggtgaacttcttgctaatgattctgactttgctcgttacaagtctgaatatattgatgttattgaaactcacttaaagaaatacactgctcaaccagttgttcttattattgaaccagattcacttgctaacatggttactaacattgaaaacactccagcttgtgctgaatctgaaacttactactacgatggtcacgcttacttacttaagaagtttggtgttcttgaccacgttgctatgtaccttgatattggtcacgctttctggttaggttgggatgataaccgtgaaaaggctactaaggtttacaagaaggttattgactctggttctccaggtaaggttcgtggtttcgttgataacgttgctaactacactccatgggaagacccaactctttctcgtggtccagatactgaatggaacccatgtccagatgaaaagagatacttagaagctatgtacaaggactttacttctgctggtattaagtctgtttacttcgtcagtgactcttctcgtaatggtcacaagactgaccgtaagcacccaggtgaatggtgtaaccaaactggtgttggtattggtgctcgtccacaagctagtccaatctctggtatgagttaccttgatgctttctactggattaagccacttggtgaatctgatggtacctctgatgaatctgctgctcgtttcgatgg

SEQ ID NO: 24884 - DNA, 849 bp, Anaeromyces robustus; identical to SEQ ID NO: 24878
  Glyco_hydro_6

SEQ ID NO: 24885 - DNA, 259 bp, Anaeromyces robustus
  Glyco_hydro_6
taacccatactacgttgaagaagttgaaaatgctcttaacaatcttattgattcttctcttagatcaaaggttgaaaagatgaagactttctctaatgctatctggcttgataccattaataacatgcaaagttggttagaaccaaaccttaagggtgctcttgctcaacaccaatctactggtaaggatgtcttaactgtctttgttgtttacgatttaccaggtcgtgattgtcacgctcttgcttccaatggtgaa

SEQ ID NO: 24886 - DNA, 897 bp, Anaeromyces robustus; identical to SEQ ID NO: 24880
  Glyco_hydro_6

SEQ ID NO: 24887 - DNA, 615 bp, Anaeromyces robustus
  Glyco_hydro_6
ccaagattacgttaaaaagattgaatcatctttaaaatctatgtctccagaattacaagctaaggctaagaatgttgaaaaggttgcaactgctgtttggttagcttgggaaggtgctccaggagaagtcgctccacaccttaaggctgctggtaacaagactattacctttattctttacatgattccaactcgtgactgtaacagtttagcttcagctggtggtgctgctgactttgaaaaataccaaggttatgttgacagtattgccgctactattaagaaatatccaaatgctaaggttaacatggttattgaaccagatactcttggtaaccttattactggtgaaactgaagcttgtaagaaggttcatgacttacacagaaaagctttatcttacgctgttaacgttttcggtaacatgagtaatgttaatgcttatcttgatgctgcccaccacaaatggttaggttggggaacagacaaggttgctgctcttatcaaggacattttagacaatgctccagatggtgatattcgtggtattagtactaatgtttctaactaccaatccattgaaaatgaataccaataccactctgatcttcatga

SEQ ID NO: 24888 - DNA, 846 bp, Anaeromyces robustus; identical to SEQ ID NO: 24879
  Glyco_hydro_6

SEQ ID NO: 24889 - DNA, 714 bp, Anaeromyces robustus
  Glyco_hydro_6
taatccatattatgttgaagaagttgataatgccattgctcaaatgactgattcttctcttaaagctaaagctgaaaaaatgaaaacttatccaaatgctatttggcttgataacattaagaacatgcaaagttggttacaaccaaatcttgaaaaagctcttgctcaacaatctggtagtaaaaaggttttaactgttttcgttgtttacgatttaccaggtcgtgattgtcacgctatggcttccaatggtgaacttcttgctaacgattctgatgctcaacgttacaagactgaatacattgatgttattgaagaacaattaaagaaatacaaatctcaaccaattgtccttattattgaaccagattcacttgctaacatggttactaacattgaaaccactccagcttgtgctgaatctcaagattattactttgatggtcatgcttacttacttaaaaaattcggtgtcttacaacatgttgctatgtaccttgatattggtcacgctttctggttaggttgggatgataaccgtgaaaaggctgctaaggtttacaagaaagttattgattctggttctccaggtaaggttcgtggtttcgttgataacgttgctaactacactccatgggaagacccaactctttctcgtggtccagatactgaatggaacccatgtccagatgaaaagagatacttagaagctat

SEQ ID NO: 24890 - DNA, 852 bp, Anaeromyces robustus
  Glyco_hydro_6
ttaccaatatcaatctgaagtccaatcttctattaacaaattaagtggtaatttacaacaacaagctaatagagttaaatacgttccaactgctgtttggttagcttgggatggtgcaccaaaagaagttcaaagacaccttagttccgctaatggcagtactgctgtctttattatgtactggattccaactcgtgattgtaacagtaatgcttctcaaggtggtgctaatgatttaaatgcttacaaatcttatgttgatgatgttgctaatacctttagatctaatcaaggtagtagaattgttattgttgttgaaccagatactattggtaatatggttacttctcaaaacaatgaaaattgtagaagaactgcagttattcacaaacaagctcttgcttatgctgttaatagatttggtagtcttaataatgtacaagtttatcttgatgctggtcacagtcaatggttaactggttatgaagatgaaactgctgctgttattaaggaaattttagatatggctaatcaaggtaagattcgtggtttctctactaatgtttctaacttccaaccaattgataaggaatacgaatatcaaactagactttatgatgctcttgaaaatgttggtattactgatatgagatttgttattgatactagtcgtaatggtcaagatattagtgaagctttcgctaaaactaaaacttggtgtaatttagttggtactggttttggtgaacgtccaaagggtaatccagatccaattaatatgccattattagatgcttacatgtggttaaaaccaccagcagaatctgatggttcttctcaaggtatgcgtgc

SEQ ID NO: 24891 - DNA, 897 bp, Anaeromyces robustus
  Glyco_hydro_6
taaaagttcttatgatcaattaattgctgaaggtgaaccagaaattgctgaaattgttgctaaagttgctaaatatccaactccaacctggttaacaaacactgatgctgctaaacttgtaccacaagttttatctcaagttactaaacaaatgaaaaaaactggtaaaaaaattttaacttctttcattatttataatttaccaaacagagattgttcagccgttgcttctcgtggtgaattaggtattgaacatcttggtgtttataaggaatggattgatgaaattgcaggttatttcaaaaatcatgaaggaccaattgttgctgttgttgaaccagatgcttttggtaatatgattaatagtaatgataatgaactttgtaaggaagcctttgatactcaaatggaagctcttgtttatgctattactcatcttaatgctccaaatgttggtgtttatttagatcttgctcaagttggttggttaggttggagtggtaatatgcgtttccttattccacttcttgaagaagttcttaataaggttggtacaggtattttacgtggtttcacttctaatatttctaattatcaaccattagttaaaccagaagttccagaagttactttatccggtaatccaagtcaaagtgaatatgaatatagtttgaatgttagagaagccttaaagaaaattggtatggttgattttggttgggtagttgatacttctcgtaatggtgtatctaatattaaaactaaaggtgaatcatggtgtaatattaaaggtgcaggtataggtagaagaccagaagctaatccaccagatttaccaggacttgatgctgtttattggtttaaaccaccaggtgaatctgatggtagtgatagaaa

SEQ ID NO: 24892 - DNA, 912 bp, Anaeromyces robustus
  Glyco_hydro_6
tgatccaaattaccaacaagaacttgataatcttagttcaactataaaggatccaactgttattgaaaaagttgaaaaaatgaaacaatattctactggtatttggttagattctattcaatctgttaatgaattattagaaagtaatttagataatgcttatgctcaacaagtagaaagtggtaaaaatgttttaactacttttgttctttataatttaccaggtcgtgattgtcatgctattactacaaatggtgaacttcttgctaaagattctgatttagaacgttataagcatgaatatattgatgttattgaagaaattataaagaaacataataatcaaccaattgcttttgttgttgaaccaacttctcttccaagtatagctacttttaaaaaaagtactccagcttgtgctgatacagaaaaatattatttagaaggtcattcttatttaattaaaaaacttggtgtattaccaaatgtctttttatatcttgatgttggtcatgctttctggttaggttgggatgatcttcgtgaagaaactgctaaactttatgctaaagttattcaatctggtgctccaggtattgttcgtggttttgctgataatatttcaaattatgttccatgggatgatgctaatcttactaatggtccaaatactgaatataatccatacccagattcaaaaagatatattgaatctttacgtaaagattttgtaagtgttggtattaaaaatgttaatttcatttctgatacttcccttaccactattaataatggttctagtcctgttgaagattggtgttataatgctcctcttggtattggtgctcgtccacaagctaatccagtttcagatatgtcttatcttgatgcttttgtttggattaaaccatt

SEQ ID NO: 24893 - DNA, 849 bp, Anaeromyces robustus
  Glyco_hydro_6
ccaagaccgtaaagatcgtgttcaatcttctattaatagattaagtggtgaattaaaagctaaagcccaaaaaatccaagacgccccaacagctatttggttatcttgggataaagcaccagaaacagtttcgttccatcttgatgaagctggtaatcaaacagccgttttcattttatattggattccaactcgtgattgtaacagtatcgcctctcaaggtggtgctcaaagcatggatgaatatcacacttatgttaacagaattgttaacggtttcaaaagtcatccaaacagtaagatcgttgttgttgttgaaccagatactcttggtaatatgattacttctcaaagtaatgataattgtaaaaaggttcacaatcttcataaacaagctattgcttacgctattgatacctttggtcaaattgacaatgttcgtacttatattgatgctgctcatggtagatggttaggttcacatgctgatgaagcagctgctattattaaagaaattattgatatggcaccaaacagtaatgttcgtggtttatctactaatgtttctaactaccaaccaactgaagatgaatatgcttaccatcaaaaacttagcgctgagcttgaaaagcttggtgttcataatatgaaatttattgttgatactgcccgtaatggtgtagatgtcgcagaatctttagttaaaactggcacttggtgtaatgttaaaggtacaggttttggtgaacgtccaagaggttccccagacccagttaataaaccattattagatgcttacatgtggttaaaaccaggaggtgattctgatggttcatctactggtgatca

SEQ ID NO: 24894 - DNA, 477 bp, Piromyces finnis
  Glyco_hydro_6
caagagttcatacgacaagttaattgctgaaggagaaaatgaagttgccgaaattgttgctaaggttgctagatacccaactccaacttggttagctagtactgattccgtcaagcttgttccaaaggttttagcacaagttaccgaacaaatgaagaagaccggtaagaaggttttaacttccttcattatctacaatttaccaaacagagattgttctgctcaagcctccagaggtgaattaggtattgaacatcttggtaagtacaaggaatggattgatgaaattgcaggatactttgcagctcacgaaggaccaattgttgctattgttgaaccagatgccatgggtaacatggttagtcacaatgataatccagtttgtgaagaagcattcgatactcaaatggaagctcttgtctctgccattactaagcttaacatgaagaatgttggtgtttacatggatcttgcaca

SEQ ID NO: 24895 - DNA, 891 bp, Piromyces finnis
  Glyco_hydro_6
gagttcatacgacaagttaattgctgaaggagaaaatgaagttgccgaaattgttgctaaggttgctagatacccaactccaacttggttagctagtactgattccgtcaagcttgttccaaaggttttagcacaagttaccgaacaaatgaagaagaccggtaagaaggttttaacttccttcattatctacaatttaccaaacagagattgttctgctcaagcctccagaggtgaattaggtattgaacatcttggtaagtacaaggaatggattgatgaaattgcaggatactttgcagctcacgaaggaccaattgttgctattgttgaaccagatgccatgggtaacatggttagtcacaatgataatccagtttgtgaagaagcattcgatactcaaatggaagctcttgtctatgccattactaagcttaacatgaagaatgttggtgtttacatggatcttgcacaagttggatggttaggttggagtggtaacatgcgtttccttattccaattcttgaacaactcttaaacaaggttggtactggagttttacgtggtttctcatctaacatttccaacactcaaccattagttagaccagaaactcttgatgttactttagccggtaacccaagtcaaagtgaatacgaatacagtttgaatgtcagagaagaattaaagaagattggtatggttgactttggatgggttgttgatacttcacgtaatggtgtatctaacattaagaccaagggagaatactggtgtaacattaagggatccggtattggtagaagaccagaagccaatccagcagatcttccaggacttgatgctgtttactggttcaagccaccaggtgaatctgatggtagtgacaa

SEQ ID NO: 24896 - DNA, 891 bp, Piromyces finnis; identical to SEQ ID NO: 24895
  Glyco_hydro_6

SEQ ID NO: 24897 - DNA, 622 bp, Piromyces finnis
  Glyco_hydro_6
tccaagatacgttgaagaaattgaatcttccatgccagatatgagcgatgaattaaaggctaaggctaagaatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctctt

SEQ ID NO: 24898 - DNA, 843 bp, Piromyces finnis
  Glyco_hydro_6
tccaagattcattgaagaaatcgattcttcaattccaaagttaagtggtgatttagctgctaaggccgaaaaggtcaagcaagttccaactgctgtttggttagcttgggatggtgctccaggtgaagttgaaggtcaccttgctgctgctggttctaagactgttgtcttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttc

SEQ ID NO: 24899 - DNA, 843 bp, Piromyces finnis
  Glyco_hydro_6
tccaagatacgttgaagaaattgaatcttccatgccagatatgagcgatgaattaaaggctaaggctaataatgtcatgaatgtttcttctgctgtttggttagcctgggaaggtgctccaaatgaagttgaaggtcatcttaaggctgctggttctaagactattactttcattctttacatgattccaactcgtgattgtaacagtttagcttctgctggtggtgcttctgatcttaagaaataccaaggtattgttgacaagatcgctaataccattagcaagtacccagatgttaaggttgctatggttattgaaccagatactcttggtaaccttattactggttctactgaagcttgtaagaatgttcacactttacacaagaatgctctttcctacgctgctaacgttttcggtaacatgagtaacgttagtgcttaccttgatgctgctcatggtaagtggttaggttgggctgctgacaagactgctgctgtcattaaggaaatcttagacaatgctccaaatgctaacattcgtggtttcagtaccaatgtttctaactatcaatctattgaaaaggaatacgcttatcatgaagctcttaatgctgctcttgaaaagcttggtattactggaaagaaattcattgttgataccggtcgtagtggtgttgatgttactgaagaattcgatgttaaccaaacctggtgtaacttcgtttacgctggtttaggtgaaccatctcgcggaagtccagatttagaaaagatgccattattagatgcttacatgtggctcaagccaccaggtgaagctgatggttctgatgttggttc

SEQ ID NO: 24900 - DNA, 843 bp, Piromyces finnis; identical to SEQ ID NO: 24899
  Glyco_hydro_6

SEQ ID NO: 24901 - DNA, 519 bp, Piromyces finnis
  Glyco_hydro_6
accagatactcttggtaaccttgtaactggtagcagtgaagcctgtaagactgttcacactttacacaaaaacgccttatcttacgctgttaatgtcttcggtgctatgagtaatgtcagtgtttaccttgatgctgctcacggtaaatggttaggtggtgttactgataaggttgccactgttgttaaagaaattttagatggagctccaaacggtaagattcgtggtttaagtactaatgtttctaactaccaaccagttagcgctgaatatggttaccaccaaaagcttgcttcttctctttctgccgttggtgtaagtgatatgcacttcattgttgataccggtcgtaatggtgttgatgtttcatctaccttcagtattaacgaaacctggtgtaactttgttggtactggttttggtgaacgtccacaaggtaacccatctggtatgccattattagatgcttacatgtggctcaagccaccaggtgaagctgatggttctgatgttggttc

SEQ ID NO: 24902 - DNA, 960 bp, Piromyces finnis
  Glyco_hydro_6
caacccatactacactgctgaagttgatgctgctattgctcaaatgagtaactcttcccttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatgg

SEQ ID NO: 24903 - DNA, 960 bp, Piromyces finnis
  Glyco_hydro_6
caacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgctactggtcaaaccgttttaactgtcttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatgg

SEQ ID NO: 24904 - DNA, 960 bp, Piromyces finnis; identical to SEQ ID NO: 24902
  Glyco_hydro_6

SEQ ID NO: 24905 - DNA, 960 bp, Piromyces finnis; identical to SEQ ID NO: 24902
  Glyco_hydro_6

SEQ ID NO: 24906 - DNA, 960 bp, Piromyces finnis
  Glyco_hydro_6
caacccatactacactgctgaagttgatgctgccatcgctcaaatgtctaactcttcccttattgctaaggctgaaaagatgaaggaatactctaacgctatttggttagataccattgaaaacatgaacaattggttagaaagaaaccttaagactgctcttgctgaacaaaaccaaactggtaagactgtcttaaccgttttcgttgtttacgatttaccaggtcgtgattgtcacgctcttgcttccaatggtgaacttcttgctaatgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgctttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgctcgtccacaagccagtccaattgctggtatggattaccttgatgctttctactgggttaagccatacggtgaatctgatggtacttctgatgaaagtgctaagcgttacgatgg

SEQ ID NO: 24907 - DNA, 960 bp, Piromyces finnis; identical to SEQ ID NO: 24902
  Glyco_hydro_6

SEQ ID NO: 24908 - DNA, 960 bp, Piromyces finnis; identical to SEQ ID NO: 24906
  Glyco_hydro_6

SEQ ID NO: 24909 - DNA, 960 bp, Piromyces finnis; identical to SEQ ID NO: 24903
  Glyco_hydro_6

SEQ ID NO: 24910 - DNA, 960 bp, Piromyces finnis; identical to SEQ ID NO: 24903
  Glyco_hydro_6

SEQ ID NO: 24911 - DNA, 960 bp, Piromyces finnis; identical to SEQ ID NO: 24903
  Glyco_hydro_6

SEQ ID NO: 24912 - DNA, 960 bp, Piromyces finnis; identical to SEQ ID NO: 24902
  Glyco_hydro_6

SEQ ID NO: 24913 - DNA, 960 bp, Piromyces finnis; identical to SEQ ID NO: 24903
  Glyco_hydro_6

SEQ ID NO: 24914 - DNA, 960 bp, Piromyces finnis; identical to SEQ ID NO: 24902
  Glyco_hydro_6

SEQ ID NO: 24915 - DNA, 960 bp, Piromyces finnis; identical to SEQ ID NO: 24902
  Glyco_hydro_6

SEQ ID NO: 24916 - DNA, 960 bp, Piromyces finnis; identical to SEQ ID NO: 24902
  Glyco_hydro_6

SEQ ID NO: 24917 - DNA, 960 bp, Piromyces finnis; identical to SEQ ID NO: 24903
  Glyco_hydro_6

SEQ ID NO: 24918 - DNA, 960 bp, Piromyces finnis; identical to SEQ ID NO: 24902
  Glyco_hydro_6

SEQ ID NO: 24919 - DNA, 960 bp, Piromyces finnis; identical to SEQ ID NO: 24906
  Glyco_hydro_6

SEQ ID NO: 24920 - DNA, 849 bp, Piromyces finnis
  Glyco_hydro_6
cttcaagttccaagctgaagttcaatcttctattaacaagttaagtggttccttagctgaaaaggctaagaaggttaagtacgtcccaactgctgcttggttagcttgggaaggtgctccagctgaagttccacaataccttgatgaagctggttccaacactgttgttttcgtcttatatatgattccaactcgtgattgtaacgctaacgcctctgctggtggtagttccaacattgaaaagtacaagggttacgttgacaagatctacaacactattaaccaatatccaaactctagaattgttatgattcttgaaccagatactattggtaaccttgttactgctaacaatgacaactgtagaaacgtccaaaacatgcacaagcaagccctttcttacgctattagtaagttcggtacccaaagtaacgtcagagtttaccttgatgctgctcacggtgcttggttatctagccacgctgacaagactgcccaagttattaaggaaatcttaaacaacgctggtaacggtaaacttcgtggtatcagtactaacgtttctaactaccaaactgttaacgatgaatacaactaccacatgagacttaacagtgccctcgaaaaccttggtgttagaggtatgaaattcattgttgatacttcccgtaacggtgctaacatttctggtgctttcaatgctagtggtacctggtgtaacttcaagggtgctggtttaggtgctcgtccacaaggtagcccagacccaagcaagccattacttgatgcttacatgtggattaagactccaggtgaagctgatggttcttctagcggttctagagctga

SEQ ID NO: 24921 - DNA, 960 bp, Piromyces finnis
  Glyco_hydro_6
caacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacatttctaccactccagcttgtgctgcttctgaaaagtactactacgatggtcatgcttacttaattaagaagctcggtattcttccacacattgctatgtaccttgatattggtcacgccttctggttaggttgggatgataaccgtttaggtgccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatgg

SEQ ID NO: 24922 - DNA, 960 bp, Piromyces finnis
  Glyco_hydro_6
caacccatactacactgctgaagttgatgctgctattgctcaaatgagtgactcctctcttattgctaaggctgaaaagatgaaggaatactctaacgctatctggttagataacattgaaaacatgcaaaactggttagaaagaaaccttaagtctgctcttgctgaacaaaacgccactggtcaaactgtcttaactgtctttgttgtttacgatttaccaggtcgtgattgtcacgctcttgcttccaatggtgaacttcttgccaacgatgctgatgccgctcgttacaagtctgaatacattgatgtcattgaagaaaagttaaagacttacatttctcaaccagttgttcttattattgaaccagattcccttgctaacatggttaccaacattgaatctactccagcttgtgctaagtctgaaaagtactactacgatggtcacgcttacttaattaagaagttcggtgttcttccacacgtttctatgtaccttgatattggtcacgctttctggttaggttgggatgacaaccgtgaaaaggccggtaaggtttactctaaggttatttcctctggttctccaggtcaagttcgtggtttcgcttccaacgttgctaactacactccatgggaagacccagaactttctcgtggtccagacactgaatggaactcttgcccagatgaaaagagatacattgaagccatgtacaaggacttcaagtctgctggtatcaagtctgtctacttcattgaagatacttctcgtaatggtgttaagaacgaccgtttccacccaggagaatggtgtaaccaaatgggatctggtattggtgcccgtccacaagccaacccaattgccggtatggattaccttgatgctttctactgggttaagccatacggtgaatctgatggtacttctgatgaaagtgctaagcgttacgatgg

SEQ ID NO: 24923 - DNA, 960 bp, Piromyces finnis; identical to SEQ ID NO: 24921
  Glyco_hydro_6

SEQ ID NO: 24924 - DNA, 960 bp, Piromyces finnis; identical to SEQ ID NO: 24922
  Glyco_hydro_6

SEQ ID NO: 24925 - DNA, 960 bp, Piromyces finnis; identical to SEQ ID NO: 24922
  Glyco_hydro_6

SEQ ID NO: 24926 - DNA, 960 bp, Piromyces finnis; identical to SEQ ID NO: 24921
  Glyco_hydro_6

SEQ ID NO: 24927 - DNA, 960 bp, Piromyces finnis; identical to SEQ ID NO: 24921
  Glyco_hydro_6

SEQ ID NO: 24928 - DNA, 960 bp, Piromyces finnis; identical to SEQ ID NO: 24921
  Glyco_hydro_6

SEQ ID NO: 24929 - DNA, 960 bp, Piromyces finnis; identical to SEQ ID NO: 24921
  Glyco_hydro_6

SEQ ID NO: 24930 - DNA, 960 bp, Piromyces finnis; identical to SEQ ID NO: 24921
  Glyco_hydro_6

SEQ ID NO: 24931 - DNA, 960 bp, Piromyces finnis; identical to SEQ ID NO: 24922
  Glyco_hydro_6

SEQ ID NO: 24932 - DNA, 960 bp, Piromyces finnis; identical to SEQ ID NO: 24921
  Glyco_hydro_6

SEQ ID NO: 24933 - DNA, 927 bp, Neocallimastix californiae
  Glyco_hydro_8
taacaacaatgatgttcgttccgaaggtatgtcttatggtatgatgatctgtgtacaaactgatcacagagaagaatttgacaagatttggaattgggcaaagaaccacatgtggcataagagtggtagctgggatggttacttcgcttggaaaagaggatcaaatggttatggtggtgatgataattgtgcaccagatggtgaaatgtatttcatgatgtctcttctctttgctgctaaccgttggaataacaagcaatacatggatgatgctcaatacattttaaagagaatgtgggataacagccaacactctcttttcaacccaagatataatgttattaccttccaaccacaaggtaatgaaaataatttctctgatccatcttacgatttaccagcctttgttgatctcttctctcgttggtcaacaactaatcaaggcaaatggaaggccgctgcttctgctactcgtgaccatttatacaaatcttcaaacactaagtctggtttattcagtgattacaacaactttgatggtactccacattctgtaagttataacagtaatgctcaaaagtatatgtacgatgccatgcgttgtgctatgaactttggtatggattattatctctttggtgctgatgctaagcgtcaaactgaaatggctagacgtcttattgacttctttgaaaaagatggttaccaacatgctcgtttcaactgggatggttcaaacccatctgaacaatatactttaggtgaagttggtgctaatgcagttgctacctacgctttaatgggtgttaatggatacgaagacattattaagaagaacttaaagatggcttgggatggtgaaccaatgactggtcaataccgttactacgatggtttagtccactacttatctatgcttcatcttac

SEQ ID NO: 24934 - DNA, 915 bp, Neocallimastix californiae
  Glyco_hydro_8
caacaatgatgttcgttctgaaggtatgtcttatggtatgatgattgctgttcaaaccaaccacaaagaagaatttgacaaactttggaactgggctaagaaccacatgtggcacaaaggtggtggctgggatggttacttcgcctggcaacgtaacaccagtggtaatggtggtgatgataattgtgctccagatggtgaaatgtactttatgatgtcacttctctttgccgctaaccgttggaataacaaacaatatatggatgatgctcaatacatcattaagagaatgtgggataatccacaacacaaacttttcaaccaacaaaataacattattactttccaaccacaaggtactggtaacaatttctctgatccatcctacgatttaccagcctttgttgatcttatttctcgttggtctactaccaaccaaaatagatggaagtctgctgctcaagctactcgtgatcacttatacaaatcttctaacacaagatctggtttattcagtgattacaacaactttgatggtactccacactctgaaagttacaaccaaaatgcttccaagtacatgtacgatgctatgcgttgtgctatgaactttggtatggattactacttattcggtagtgatgccaaacgtgaaactgaaatggctaagcgtatcattgatttctttgaaaaagatggttacaaacatgctcgtttcaactgggatggttctggtgcttctgaacaatacactcaaggtgaaactggtgccaatgctgttgcttgtttcgctttaatgggtactcaaggttatgaaagtattattaagaagaacttacaaatggcttgggatgttaaaccaatgactggtcaataccgttactatgatggtttagttcactacttagctatgct

SEQ ID NO: 24935 - DNA, 915 bp, Anaeromyces robustus; identical to SEQ ID NO: 24934
  Glyco_hydro_8

SEQ ID NO: 24936 - DNA, 918 bp, Piromyces finnis
  Glyco_hydro_8
caataatgatgttcgttctgaaggtatgtcttacggtatgatgatcgctgttcaaactgatcaccaaaaagaattcgacaaactttggaactgggctaagaaccatatgtggcacaagagtggtagttgggatggttatttcgcctggaagcgtggatcaaacggttctggtggtgatgataactgtgctccagatggtgaaatgtacttcatgatgtcattactttttgccgctaaccgttggaatgacaagaaatacatggacgatgcccaatacattcttaagagaatgtgggataacagtcaacacagtctcttcaacccagcttacaatgttattactttccaaccacaaggtaatgaaaacaatttctctgatccatcctacgatttaccagctttcgtagatctcttctctcgttggtctactactaaccaaaataaatggaaggctgctgcttctgccactcgtgatcacttatacaaatcttccaacccacaatctggtttattctctgactacaataactttgatggtactccacactctgttagttacaacagtaacgctcaaaagtacatgtacgatgctatgcgttgtgctatgaactttggtatggattactatttattcggtactgatgctaagcgtcaaactgaaatggccaaacgtatcatcaaccactttgaaaaggatggttaccaacacgctcgtttcaactgggatggtactggtggatctgaacaatacactttaggtgaaactggtgctaacgctgttgccacttatgctttaatgggaattgctggttacgaagacattattaagaagaacttaaagatggcttgggatggtaaaccaatgactggtcaataccgttactacgatggtttagttcactacttatctatgcttca

SEQ ID NO: 24937 - DNA, 918 bp, Piromyces finnis; identical to SEQ ID NO: 24936
  Glyco_hydro_8

SEQ ID NO: 24938 - DNA, 789 bp, Piromyces finnis
  Glyco_hydro_8
ggatggttatttcgcctggaagcgtggatcaaacggttctggtggtgatgataactgtgctccagatggtgaaatgtacttcatgatgtcattactttttgccgctaaccgttggaatgacaagaaatacatggacgatgcccaatacattcttaagagaatgtgggataacagtcaacacagtctcttcaacccagcttacaatgttattactttccaaccacaaggtaatgaaaacaatttctctgatccatcctacgatttaccagctttcgtagatctcttctctcgttggtctactactaaccaaaataaatggaaggctgctgcttctgccactcgtgatcacttatacaaatcttccaacccacaatctggtttattctctgactacaataactttgatggtactccacactctgttagttacaacagtaacgctcaaaagtacatgtacgatgctatgcgttgtgctatgaactttggtatggattactatttattcggtactgatgctaagcgtcaaactgaaatggccaaacgtatcatcaaccactttgaaaaggatggttaccaacacgctcgtttcaactgggatggtactggtggatctgaacaatacactttaggtgaaactggtgctaacgctgttgccacttatgctttaatgggaattgctggttacgaagacattattaagaagaacttaaagatggcttgggatggtaaaccaatgactggtcaataccgttactacgatggtttagttcactacttatctatgcttca

SEQ ID NO: 24939 - DNA, 741 bp, Neocallimastix californiae
  Glyco_hydro_88
ttggaactacattgatggtgttttcttaaatagtgttataaacttatataaaaagactaataatgaaaagtacaaagatttcttcatcaaatatgttaactactatgtttctgaagatggtacttttgttcattacactgctgatggagtaaagaccgtcgataatgaaatgggttgggttaatggtgaacttgataccgtttgtgaaagtaagattttatttgatgcctatgaaatgactggtgataaaagataccttactgcaattgaattcacctacaagaagcttatggaaatgccatactgttataattctccaaacttctggcataagaccttctatatcaatcaaatctggcttgatggtatgtatatgtacgctcctttcttagctagatatgctcttttaaaaaatgatctttcaattttagatgatattaagaaccaatacgctttcattcatgataatatgagagatgaaaatggtttataccaccatggtttcgatactaccaagactattttctggagtaaaaataatgatggtaagagtgaaaacttctggcttagaagtatgggttggtttgcagtttctcttgctgatatcttagaatattacccagaaggtgaaaacaaagaatacttaaagagtatcttagaagaattattaaatggtatattaccataccaagataagactactaagatgttctaccaagttattgatagaccagaagaaat

SEQ ID NO: 24940 - DNA, 744 bp, Neocallimastix californiae
  Glyco_hydro_88
aaagtggaactacattgatggtgttttcttaaatagtgttgttaatttatataagaagactaataatgaaaagtacaaagaatttttcattaaatatattaattactatgttgcagaagatggtactttcgttcattacactgaagacggtgtaaagactgtcgataatgatttaggttgggttactggagaacttgatactgtttgtgaaagtaagattttattcgatgcttatgaaatgacaggtgataaaagatacctcactgctattgaatttacttaccaaaagcttatggaaatgccattatgttacaattcaccaaatttctggcataagactttctacatcaatcaaatttggcttgatggtatgtatatgtacgctccattcttagctagatatgctgttttaaagaatgatctttctattttagataatatcaaagaacaatatgctttcattcatgataacatgagagacgaaaacggtttataccatcatggtttcgataccactaaaactattttctggagtaaaaataatgatggtaagagtgaaaacttctggcttagaagtatgggttggtttgctgtatctcttgctgatatcctagaatactacccagaaggtgaaaataaagaatatttaaaaaatgttttagaagaattattaaatggtatattaccattccaagataaaactactaaaatgttctaccaagttattgacaaaccagaagaaat

SEQ ID NO: 24941 - DNA, 1299 bp, Neocallimastix californiae
  Glyco_hydro_9
tgctagacacattgaattatctcttcttttctacgaagctcaacgttctggtaaacttccagaagacaacagaatttactggagacatgatagtgaacttgaagctggtgctgatcatggtgttgatcttactggtggatattacgatgctggtgataatgctaagtttaatttcccagctgcttctactatgactcttttagcttggagtggtattgattatgctgaaggttacaaaaatgctggtcaatggaaatatattttagatgctgttcgttggggtgctgactactttattaaatgtcacactggtaaaactgaactttatgctcaagttggtgatggtaacactgatcattctttctggtatccaccagaatatgttcaatatgattacccatcattcaaagttactgctcaagaaccaggttctgaagtagctggtgaaacagctgctttcttagctgctgcatctattcttttcaaagatgaagatccatcatattctgctactttattaaagcactcaaaggaaatttatgacttcgctgataaatatcgtggtgattacactgttgctgttccagctgtcagtttttataacacttacagtggttatatggatgaattagcttggggtgccgcttggcttcttagagctactggtgatgaatcatatcttgataagtacaatgtcattgccaataaaaagtatgaatcttatgatccaaagaaattcactggtgctactggaccaatctcttgggatgataaaagacctggttgttatattttaatggctatgattactggtgatgaaaagcgtattaatgaagcttacagttactgtgatgccgttttaactcaaccacgtaccaaaggtggtttatggtatgatgatggtttatctatttggggttctaaccgttacgcttctaatgctgcatcaatgcttggtatgtttgcaaattatcttccaaagtctgacccaaagcgtgcaaaatatgttgaattcgttaaacaacaaactgattatattcttggtgataacccagctaagattaattatgttgttggtgctgaagccaattcaccaaaagctgttcaccaccgtggtgcttctggtgtatttgattctcaagataaggctgctaagccagatgaaaacatatatactttatggggtgctttagctggtggtccagataagaatgataagttcgttgatagccgtaaggactatcaaatgagtgaagttgctcttgattacaatgccgctttccaaatgaatcttgcatt

SEQ ID NO: 24942 - DNA, 1305 bp, Neocallimastix californiae
  Glyco_hydro_9
tgctagacacattgaattatcacttcttttctatgaagctcaacgttctggtaaacttccagaaaataatagaatttactggagacatgatagtttactcgatgctggtgctgataacaaggtcgatcttactggtggttattatgatgctggtgataatgtaaagtttaacttcccagctgctgctgccttaactcttcttgcatggagtggtattgactatgccgatggttataagaaagctggtcaatgggattaccttttagatgctgttaaatggggtgctgactatttccttaaatgtcacactggtaagaacgaactttatgttcaagttggtaagggtgcaactgatcatggtttttggtatccaccagaatatgttcaatacgaatatccatcctacaaaattacttcttctgcaccaggtagtgaagttgctggtgatactgcttcattcttagcagcatcttctattcttttcaaagatgttgattcatcttactcagccactttattaaagcacgctaaagaaatttatgattttgctgatacctatcgtggtgaatacattaaagctgttccagatgcccaaggattttactctaactggagtggttgtgatgatgaattagcttttggtgctttatggttatatagagctactaaagatgaaagttacatgaataagtttaagaaaattgctgatgcctcttatggtgaacaagatactaaagcttatggtacttgttctggaccaatttcatgggatgataagagaccaggtgcttatattttagctgctatgcttactggtgatgaaaagcgtaagagtaaagcttacagttactgtgatgctattttaactcaaccaaagactccaggaggtttatggtatgatgctaacctttctaagtggggttctaaccgttatgcttctaacgctgcagctatggttgctatgtttgccaattctcttccagcttctgattctaaacgttctaagtacgttgacttcgttcaaaagcaaactgattatattcttggtaataatccagcaaaggtaaactatgttgttggtgctgaagctaactctccaaaggctgttcaccatcgtgctgcttctggtacttatgattctcaagataaaaatgctaaaccaactgactacaatgtcttcactttatggggtgctttagctggtggtccaggttcaaaggatgaatacactgataccagaaagaactatgaaatgaatgaagttgctcttgattacaatgctgctttccaaatgaatcttgcttt

SEQ ID NO: 24943 - DNA, 1305 bp, Neocallimastix californiae
  Glyco_hydro_9
tgctagacatattgaactttctttacttttctatgaagctcaacgttccggtaaacttccagaaaataaccgtatttactggagacatgatagtatgcttgatgccggtgctgataatggtgttgatcttactggtggttattatgatgctggtgataacgtaaagtttaatttcccagctgctgctgccttaactcttttagcttggagtggtgttgactatgctgatggttacaagaaagctggtcaatgggattatcttcttgatgctgttcgttggggtgctgactatttcataaaatgtcacactggcaaaaatgaactttatgctcaagttggtaggggtactaccgatcatggttactggtaccctccagaatatattcaatatgatcatccttcctacaaggttacagcttcatctccaggttctgaagtcgctggtgataccgcttcattcttagctgctacttcaattttattcaaggatgaagatccatcttattctaagaaatgtttacaacatgccactgaaatctatgatttcgctgatacctatcgtggtgattacactggttctattccagatgtttctggtttctactctacttggagtggttacaatgatgaattagcttttggtgccttatggctttacagagctactggtgatgaatcttactatgaaaaatttaagaaaattgctgatgccgaatatggtgcccaagattccaaggcttatggtacctgtactggtccaatttcttgggatgataaaagaccaggtgcttacgttcttgctgccatcattactggtgatgaagatcgtttaaagcaagcctactggtattgtgataatgttttaactcaaccaagaactaaaggtggtttatggtatgattctaatctttcaaagtgggcttctaaccgttacgcttctaatgctgctgctatgttagctatgatggctaattaccttccaaagggcgatgccagacgtgctaaatacgttgattttgtaaagagtcaaaccgattatattcttggtgataatccagctggtgttaactttgttgttggtgctgaagccaattcaccaaaggcagttcaccaccgtggtgcttccggtacctatgattcacaagatgtccatgccagaccaaccgattacaatatcttcactttatggggtgctttagctggtggtccaagtaaggatgatacctactctgataccagaaaggattatgaaatgaacgaagttgctcttgattacaatgctgccttccaaactaatcttgcttt

SEQ ID NO: 24944 - DNA, 429 bp, Neocallimastix californiae
  Glyco_hydro_9
caactacaaaactactccaggtggtttatggttcgatactaatctttctgcttggggttctaaccgttatgctagtaacgctgcttataccgttgctatggttgcttctactatggatgccagtgacgctaagcgtaagcaatacgttaaatttattcagaagcaaatcgattatattcaaggagataatccagctaaggttgattatgttgttggtgctgatccaagttcaccaaaatctgttcaccaccgtggttcttctggtactatgaatgctatggctgaaccacctttcaatgttttcccactttatggtgctcttgctggtggtccagatggtaatgataagtacactgatgatcgtactaactataactctaatgaagttgctttagattataatgccgcttatactggtcttcttgcttt

SEQ ID NO: 24945 - DNA, 1293 bp, Neocallimastix californiae
  Glyco_hydro_9
ttacgctagaattttgaacttaaatttacgtttttatgaatgtaattggtctggtaaagctccagaacataaacaagtctattggagatatgattctgctttagaagatggagctgatgttggtttagatcttactggaggttattatgatgccggtgaccatgttaaatttaatttaccaatgtcttatgcaatgactatgttagcatggggtggtattgatttatatgataattatgttgcagctggtcaaattgattatttagttcaaattgtcaaccatggtgcagattattttgtaaagtgccatccagaaaaagaagtcatttatgcacaagttggtcttggtgatgttgaccattgtttctgggtaccaccagaattaatgactatggaaagaccagctgtttgtaaacttactccagaaaatggtgcttctgatgttactgctcaaatggcagctgctttagctagtgcctcaattttaaataagatggtaggaaatactgaaaagtctgaactttatttaaagcatgccattgaaatttatgactttgctgataaatatagagatgtttatggtaatccatgtccagaaggtgcttccttttatccatctgcatcttataaggatgaattagtttggggtgctgcatgggtttatcgtgcttctggagatgaaaaatactatgaaaaggctgattcttattacgattcacttggattatctggtcgtgttttaattggtccaatttcatgggatgatgcttcatcaggtattattttcttaatgtcaaagcctggttttggttctaattggaagagatatttaggtgaagctcaaacatacgttgatcaatatttaaatgataagagtgctcgtacagatgctggtatgttatggtatagtgctgtttctggttggggatctgctcgtcatgctatggctggtgtattcctttattgtattttcaatacttaccataaaccaactgatccaaaatactttaatttcattcaacaacaagccgattatattcttggtaataatccatttaatcgttcacttgttgttggttcaattccaggacatgatccattaaatgttcatcatcgtggttcccatggtggttattctccaatttcattaccagaacataatatgtacacattatatggtgcacttgctggtggtccacttcaagatgattcatgggatgatgatagaaataattatattactaatgaagtttcatgtgattataatgctggtgttactggtgttatggcata

SEQ ID NO: 24946 - DNA, 1299 bp, Neocallimastix californiae
  Glyco_hydro_9
tgcaagacacattgaattatctcttcttttttacgaagcccaacgttccggtaagcttccagaaaacaacagaatttactggagacatgatagtgaacttgaagctggtgctgataatggtgtcgatcttactggaggatattatgatgctggtgataatgcaaagttcaacttcccaggtgcagctactatgactcttttagcctggagtggtgttgattatgctgaaggttataaaaacgctggtcaatgggagtatttattagatgctgtccgttggggtgctgactactttatgaaatgtcacactggtaaaactgaactttatgctcaagttggtgatggtaacactgaccactctttctggtatcctcctgaatatgttcaatacgaatacccatcatttaaggttactgctgatgctccaggttccgaagttgcaggtgaaacagctgctttcttagctgctgcttctattcttttcaaggatgaagacccaacatactctgctactttattaaagcattcaaaggaaatatatgactttgctgataaatatcgtggtgattacactgttgctgttcctgcagtcagtttctataatacttacagtggttacatggatgaattagcttggggtgctgcttggcttcttagagccacaggtgatgaatcttatcttgaaaagtacaatgttattgccaataaaaaatatgaatcttatgatccaaagaaatttacaggttctactggaccaatctcttgggatgataagagaccaggttgttatattttaatagcaatgattacaggtgatgaaaaacgtattaatgaagcctacaattactgtgatgctgtattaactcaaccacgtactgctggtggtttatggtatgatgatggtttatctatttggggttctaaccgttacgcttcaaatgctgcttctatggttgctatgtttgctaactaccttccagaatcagatccaaagcgtgcaaagtatgttgaatttgttaagcaacaaactgattatattctcggtgataatccagctaaaattaactatgttgttggtgctgaagctaattcaccaaaatcggttcaccaccgtggtgcctctggtgtattcgattctcaagataaggctgctaaaccagatgaaaatatctatactttatggggtgctttagctggtggtccagataagaatgacaagttcgttgatagtcgtaaggattatcaaatgagtgaagttgctcttgattataatgcagctttccaaatgaatcttgcttt

SEQ ID NO: 24947 - DNA, 1293 bp, Neocallimastix californiae
  Glyco_hydro_9
ttatgcaagaattttaaatttaaatttacgtttctatgaatgtcagtggtcaggaaaagcaccagaacataaacaagtatattggagatatgattcagctttagaagatggcgcagatgttggtttagatcttactggaggtttctatgatgcaggtgatcatgtaaaattcaatttaccaatgtcttatgccatgacaatgttagcttggggtggaattgatttatatgataattatgtagctgctggtcaaattgattatttacttcaaatggttaaccatggagctgattattttgttagatgtcaccctgaaaaagaagttatctatgcccaggttggtgtaggcgatgttgatcattgcttttgggttcctccagaattaatgactatggaaagaccaactgtatgtaaacttactccagaaaatggtgcttctgatgttactggtcaaatggcagctgcattagctagtgcttctatattaaacaaaaagtatggtaacactgaaaaagctgaattatatttaaaacatgctattgaaatctttgactttgctgataagtacagagatgtttataataatccatgtcctgaaggtgcttccttctatccttctgcttcatataaggatgaattggtatggggtgctgcatgggtatatcgtgcctctggtgatgaaaagtattatcaaaaggcagatgaatattatgattctcttgctttatctggtcgtaatttaattggtccaattacatgggatgatgcttcatctggtattgtattcttgatgtctaaaccaggattcggttcaaattgggaaagatatttaggtgaagctcaacactatgttgaccagtatttaaatgataagggtgctcgtactgatggaggtatgttatggtatagttccgtttcaggttggggatctgctcgtcatgcaatggctggtactttcctttactgtatctttaatacctaccataagccaactgatccaaaatactttaatttcattcaagaacaagctgattatattcttggtaataatccatttaatcgttctcttgttgttggttctattccaggctatgaaccattgaatgttcaccatcgtggttctcatggaggttattcaccactttctccaccagaacacaatatgtatcctttatatggtgctcttgctggtggtccacttcaaaacgatttttgggatgatgatcgtaacaattatgttactaatgaagttgcttgtgattataatgctggtattactggtgttatggccta

SEQ ID NO: 24948 - DNA, 1293 bp, Neocallimastix californiae
  Glyco_hydro_9
ttatgcccgtcaccttgaactttctatcctcttttatgaagctcaaagatctggaaaattaccagataacaatagaatttactggcgtggtgacagtatgttagaagctggttctgataataaagttgatttaactggtggttattatgatgctggtgataatataaaatttaactttcctcaggctagttctcttactcttttatcatggagtgctgtagagtggaaggatggttataaacaggctggtcaatgggaatatatgaaagatttaattaaatggggtatggattacttcattaagtgtcatactgataaatatgtcttatatggtcaagttggaaatgctaaattagatcataattcttgggtatcgccagaaaatatttcttatgattatccatcttacaagattactgactcttccccaggttccgatcttgcagctgaaacctctgctgctttagttgcagcttcaatggtttttagagatgaggatccaaattatgctgatcttttattaaaacatggtaaagaactttatgaatttgctgataaatatagaggttcatatgatgaatctataccagaagcaaatgactattatcattcaaatagttacaatgatgaacttgtttggggtgcagcttggttattcagagctacaggtgaagaatattataagtctaaggtagatgctatttgggattatccttatgacgaaaatgattctaataagttccttgattctaaaaatccaatttcatgggatgataaaaaggcttcatcatatactttaatggctatgattactggcgatcaaaaatatcttaaggaagctactactcacagtgatttaatggtaaatcatacaactacccctggaggattatggtataatgaaaatttatctgtatggggatcaaatagatatgcttctaatgctgcttttactgtagctatgatgacttctataatgaatgatgatgattctaaacgtcaagaatacattgatttcgttaagaaacaaacagattacattcttggtgacaatccagcaaaaatcgattatgtggttggtgctgcaccaaattcaccaaaggcagttcaccatcgtggtgcatcaggtactaaagatgtttatgaaaatccagatgagaatacatacgtcttatatggtgctcttgctggtggaccaggtccaaaggatgaatacaaagatattcgtgaggattatcaaaaaaatgaagtcgctttagattataatgctgccttccagggtcttttagcctt

SEQ ID NO: 24949 - DNA, 1266 bp, Neocallimastix californiae
  Glyco_hydro_9
tgctagacatcttgaattaaacttcttattctatgaagctcaacgttctggtcctcttccaagtaccaaccgtattccatggagaggtgactctggtcttgaccatggttctgatgttggtgttgatcttactggtggttactatgatgccggtgataatgtaaagtttaacttcccacaagcattctctatgaccgctatctcttggatgggtattgaatttgctaagggtgttgaaatggctaatcaaactgaatacttaaaggataccgttaaatggggttgtgattacttattaaagtgtcatgaaaagggtaccgatgttttctacatgcaagttggtgatggtgatattgatcatcaatactggaaagcttatgaaaatattgactatccaactccaacttttttcgttgattctaaaaacccaggtactgaagttactggtgaaactgcagctgcctttgctgctgcttctattcttttcaaggatagtgatccagaatactctgctactcttttagatcaagcaaaggaatggtatgaatttgctgacaagtatcaattcgattattctcaatctgttccagcagctggatcatactacaagagttataatggttacaatgatgaactcgcttgggccgctatctggctttatcgtgcacttggtgatgaagcttacttagaaaaggctaagagtctagttgctaattacaaactcagtgaagttggtattgattgggatagtaagtaccagggtgtcattgttatccttgcccaacttggtgttaaagaatacgttgaaaaggttgaagcttgggttaaggatatctgtactaatggaaagttttctccaggtggtctttacattaacaaagatagtgaatggggttccaaccgccgtgctactgctatggctgccagtttaatttactatactcataaccttccagaaggtaatgaattacgtgaaatggctaagaaattcgctaaatcccaagctgattatattcaaggtgctaatccactcggtattgattatgttgttggtgctgatgaaacctctccacgttctgttcaccaccgtactgcttctggtgctgcttgtattgaatgtgatccagttcaaaatgttcacattatttacggtgccttagctggtggtccagatgttgaagataattaccttgatgacagagctgactataagaagaatgaagttgctcttgattacaatgtctgttatgctgctgttcttgctta

SEQ ID NO: 24950 - DNA, 1296 bp, Neocallimastix californiae
  Glyco_hydro_9
ttatgctcgtcaccttgagctttccattcttttttatgaagctcaaagatctggtaaattaccagctaataacagaattttctggcgtcatgacagtatggttgatgctggtaaagataacaatgttgatttaactggtggttactatgatgctggtgataatgtaaagtttaactttccacaagcaagtgcattaactcttctcgcttggagtgctgttgattggaaagatggttacaaggaagctggtcaatggggatatatgaaagatttattaaagtggggtatggattatttcattaaatgccacaccagtaaatatgaattatacggtcaagttggtaatggtagtttagatcatggagcttgggttccaccagaggaaattgattatgaatatccatcatacaagattactgcttctgctccaggttcagatcttgctgctgaaacatctgcttctatggttgctgcttctatggctttcagagatgatgatccagaatatgcggatattttattaaagcatggtaaggaactttacgattttgctgaaaaataccaaggtacttacgataaatctattactgatgctaagggttattatcgttcctacagtggattcaatgatgaacttgtttggggtgccgcctggttatacagagctacaggtgataagacctataaggataaagttgataagatttgggatactccatatggtgatcttgatccagataagttcctcggttctggtggtccaatttcttgggatgataaaaaggctgctgcttatgccttaatggctcttactactggtgagagcaagtatgttgatgaatctactaagcacagtgaattaatggttaactacaaaactactccaggaggtttatggtatgatactaatttatctatgtggggttctaacagatatgcttccaatgctgcttttactgttgctatgttagctacatctatggatgctaatgacgctaagcgtaaggaatacgttaaattcattaagaagcaaattgattatattattggtgataatccagccaaggttgattacgttgttggtgccgacccaagttctccaaaggctgttcaccaccgtggtgcttccggttcaaagggtgctgataagggtccaagtgaaaatgtctttgttttatatggtgctctcgctggtggcccaggagctaatgataatttcaaggatgctcgtgataactatgaaatgaacgaagttgctttagattacaatgctgccttccaaggtcttttagcctt

SEQ ID NO: 24951 - DNA, 1296 bp, Neocallimastix californiae; identical to SEQ ID NO: 24950
  Glyco_hydro_9

SEQ ID NO: 24952 - DNA, 1305 bp, Neocallimastix californiae
  Glyco_hydro_9
tgctagacacattgaattatctcttcttttctacgaagctcaacgttctggtaaacttccagaaaataacagaatttattggagacatgatagtatgctcgatgccggttctgaccatggtgtcgatcttactggtggttattatgatgctggtgataatgtcaagttcaatttcccaggtgcagcttctttaactcttcttgcttggagtgctattgattatgctgatggttacaaaaaggctgaccaatggaaatacattttagatgctgtccgttggggagctgattactttgttaaatgtcacactggtaaaaatgaactttacgttcaagttggtgacggtcaaatcgatcatggttattggtacccaccagaatatattcaatacaagcattcatcttacaagattactgcttctgctccaggttctgaagttgctggtgataccgcttccttcttagcagcttcttctattcttttcaaggaggaaaatccaacttattctgctactttattaaagcatgctatagaaatttacgattttgctgataaatatcgtggtgaatatactaaggctgttccagatgctcaaggtttctatgctaattggagtggtttcttggatgaattagcatttggtgctttatggttatacagagctactggtgatgaaagttatatgcaaaaattctctactattgctgatgctaaatatggtgaacaagatagtaaggcttatggtatttcaactggtccaatctcatgggatgataagagaccaggagcttatattcttgctgctatggttactggtgaagaaaaacgtttacaacaagcctactggtattgtgatagtattttaactcaaccaaaaactagaggtggtttatggtatgatgctagtctttctcaatggggttctaaccgttatgcctctaatgctgctgctatgcttgctatgtttgccaattatcttccaaaatctgatccaaaacgttctaaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgcttt

SEQ ID NO: 24953 - DNA, 585 bp, Neocallimastix californiae
  Glyco_hydro_9
ttatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataataa

SEQ ID NO: 24954 - DNA, 303 bp, Anaeromyces robustus
  Glyco_hydro_9
taaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgcttt

SEQ ID NO: 24955 - DNA, 102 bp, Anaeromyces robustus
  Glyco_hydro_9
tggtccaggtgctagagatgattacaaggatgatcgtaccaattataattctaatgaagttgctttagattataatgctgcttacactggtcttcttgcttt

SEQ ID NO: 24956 - DNA, 1296 bp, Anaeromyces robustus
  Glyco_hydro_9
ttacgcccgtcaccttgaactttctattcttttctatgaagctcaaagatctggtaaattaccagctaataacagaatcttctggcgtcatgacagtatggttgatgccggtaaagacaacaatgttgatttaactggtggttactatgatgctggtgataatgtaaaattcaatttcccacaagccagtgctcttactcttcttgcttggagtgctgttgaatggaaagatggttataaagaagctggtcaatgggaatacatgaaagatttacttaagtggggtatggattattttgttaaatgtcacactggtaaaactgaattatatggtcaagttggtaatggtagtcttgatcatggtgcttgggttccaccagaggatattgattataagtatccatcttataagattactgcttctgctccaggttctgatcttgctggtgaaactgctgctgcattagttgcttcttctttagcattcagagaagatgatccagaatatgctgatctcttattaaaacatggtaaggaaatttatgattttgccgataaatatagaggttcatatgataaatctattgaagatgctaagggttactaccgttcatatagtggttatatggatgaacttgtttggggtgctgcttggttatataaggctactggtgacgaaacatataagaaaaaggttgatgccatttgggattatccatacggtgatcttgatccagataagttccttggatcaactggcccaatttcttgggatgataagaaggcttcctcctatgctttaatggctatgattactggtgaagataaatatgtcaaagaatctactactcacagtgatttaatggttaattataaaactactccaggtggtttatggtatgatactaatttatctatgtggggttctaacagatatgcttctaatgctgctttcactgttgctatgttagcttcttctatggatcctaatgattcaaaacgtaagcaatatgttaagtttgttcaaaagcaaattgattatattattggtaacaatccagcaaaggttgattacgttgttggtgctgatccaagctcaccaaaggctgttcatcatcgtggtgcttcaggttctaagggagctgataaaggtccagatgaaaacgtattcgtcttatatggtgctcttgctggtggtccaggtgcaagagatgattataaggatactcgtaataattatgaaatgaatgaagtagctttagattacaatgctgccttccaaggtcttttagcttt

SEQ ID NO: 24957 - DNA, 1305 bp, Anaeromyces robustus
  Glyco_hydro_9
cgcaagacatattgaactttctttacttttctatgaagctcaacgttcaggtaaacttccagaaaacaaccgtatttactggagacacgacagtttacttgatgctggtgctgataatggtgttgatcttactggtggttattatgatgctggtgataatgtcaagtttaacttcccagctgctgccactttaactcttttagcttggagtggtattgattatgctcaaggttataaagaagctggtcaatgggattatcttcttgatgctgttcgttggggtgctgattatttcatgaaatgtcacactggtaaaaacgaactttatgttcaagttggttctggtagagttgatcacgcttactggtatccacctgaatatgttaactatgatcatccatcattcaagattactgcttcagctccaggttctgaagttgctggtgacactgcttctttcttagctgctgcttctattttattcaaggatgttgattcatcatattctcaaaaatgtttaaaacatgctaaagaaatttacgatttcgctgatacttaccgtggtgaatacactaaagctgttgaagatgctcaacaattctatgctaattggagtggtttccttgatgaattagcttttggtgctttatggctttacagagctactggtgatgaatcttaccataataaatttaagaaaattgctgatgattcttacggtgaacaagatactaaagcttatggtatttgtactggtccaatttcatgggatgataagagaccaggttcttacattcttgctgccatgattactggtgaagaaaaacgtttacaacaagcttattggtattgtgatgaagttttaactcaaccaaaaactccaggtggtttatggtataatgataacctttctaaatggggttctaaccgttatgcttctaatgccgctgctatgttaggtatgttcgctaattaccttccaaagagtgatccaaaacgttctaaatatattgattttgttaagagtcaaaccaattatattcttggtgataatccagctaaggttaactatgttgttggtgccgaagctaattcaccaaaggctgttcatcaccgtggttcttctggtacttacgattctcaagataataatgctaaaccaaccgattacaatatttacactttatggggtgctttagctggtggtccaggaaaatctgatgattattctgatactagaaagaattatgaaatgaatgaagttgctcttgattacaatgctgcattccaaatgaatcttgctct

SEQ ID NO: 24958 - DNA, 939 bp, Anaeromyces robustus
  Glyco_hydro_9
ttatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataataatccatgcccagaaggtgcttccttctacccatctgcttcttataaggatgaattagtctggggtgctgcttgggtttaccgtgcatcaggtgatgaaaaatactataaaaaagctgatgaatattatgattctcttgctttatctggacgtaatttaattggaccaattacatgggatgatgcttcatctggtattgttttcttaatgtcaaaaccaggttttggttctaactgggaaagatacttaggcgaagctcaacattatgttgatcaatacttaaatgatatgggtgctcgtactgatggaggtatgttatggtacagttccgtttctggttggggatctgctcgtca

SEQ ID NO: 24959 - DNA, 1308 bp, Anaeromyces robustus
  Glyco_hydro_9
tgctagacatattgaactttctttacttttctacgaagctcaacgttctggtaaacttccagaaaataatcgtatttattggagattcgatagtcaacttgatgctggtgctgatcatggtgttgatcttactggtggttattatgatgctggtgataatgtaaagttcaatttcccagctgcagcagcattaactttattagcttggagtggtgttgattatgctgatggttataaaaaagctggtcaatgggattatttccttgatgctattcgttggggtgctgactattttatgaaatgtcacactggtaaaaatgaattatatttccaagtcggtgacggtaaaattgaccacacttattggtatccaccagaatatactgtctatgaacatccatcattaaaacttactacttccaaaccaggttctgaagtagctagtgatacagcttcatttttagctgctacctatatgatatttaaagatattgatccaacttacgctaaaaaatgtttacaacattcaaaagaaatttatgaatttgctgacaagtatcgtggtgattattcaaaatcatttggtaattatgtcaatgatttctataaaaattggggtacaattaatgatgaattagctttcggtgctttatggctttatagagctactggtgatgaatcttatttagctaaatataaggttattgctgatgcttcatatgatagtcgtgatgaaagtgcctatccaaattgtagtggtccaatttcatgggatgataaaagaccaggtgcctatgttcttggtgctattgttactggtgaagataaatatttagataaagctatcagctattgtgatgctgtattaactcaaccaaaaactcgtggtggtctttggtataataataacctttctaaatggggttcaaatcgttatgcttctaatgctgcttctatgttaggtatgttagctaattatcttccaaaggatcatccaaaacgttcaaaatatattgattttgttaaaagtcaaactaattatattcttggtgataatccagctaaagttaattttgttgttggtgctgaaaagaattcaccaaaggctgtacatcaccgtggtgcttctggtacttatgattctcaagatactaatgctaaaccaactgatcataatgtttacactatttggggtgctttagctggaggtccaggtaaggatgattcttataccgacacaagaaagaattatgaaatgaatgaagttgcccttgattataatgctgctttccaaatgaatcttgcttt

SEQ ID NO: 24960 - DNA, 96 bp, Anaeromyces robustus
  Glyco_hydro_9
aggtgctagagatgattacaaggatgatcgtaccaattataattctaatgaagttgctttagattataatgctgcttacactggtcttcttgcttt

SEQ ID NO: 24961 - DNA, 1293 bp, Anaeromyces robustus
  Glyco_hydro_9
ttatgctagaattttaaatttgaatttacgtttttatgaatgtaattggtctggtaaagctccagaacataaacaagtctattggagatatgactctgccttagaagatggtgctgatgttggcttagatcttactggaggtttttatgatgctggtgatcatgtcaaatttaatcttccaatgtcttatgctatgactatgttagcatggggtggtattgatttatatgaaaattatgtcgctgctggacaaatcgactatttagttcaaattgttaaccatggtgcagattactttgttaagtgtcatccagaaaaggaagttatttacgctcaagttggtcttggtgatgttgatcactgtttctgggttccaccagaattaatggaaatggaaagaccagctgtatgtaaacttactccagaaaatggtgcttctgatgttactgcacaaatggctgcagctttagcttcagcttctatcttaaataaaaaagttggaaatactgaaaaagctgaactttacttaaaacacgctattgaaatttatgactttgctgataaatacagagatgtttatggtaatccatgtccagaaggtgcttcattctatccatctgcttcatacaaggatgaattagtttggggtgctgcttgggtttaccgtgcttctggtgatgaaaaatattatgataaggctgatgaatattatgattctcttggtttatctggtcgtgttttaattggaccaatttcatgggatgatgcttcttcaggtattatcttcttaatgtcaaaaccaggttttggtaagaactgggaaagatatttaaatgaagctcaaatttatgttgatcaatacttaaatgataaaggatctcgtactgatgctggtatgttatggtacagttccgtatctggttggggatctgctcgtcatgctatggccggtgttttcctttattgtatatttaatacttaccacaaaccagaagatccaaaatactttaactttattcaacaacaagctgattacattcttggtaataatccatttaatcgttctcttgttgttggttctattccaggtcatgatccattaaatgttcaccatcgtggttctcatggtggttattcaccaatttcaccaccagaacataacatgtacactttatatggtgcccttgctggtggtccacttcaagatgattcatgggatgatgatagaaacaactatattactaatgaagtttcttgtgattataatgctggtattactggtgttatggccta

SEQ ID NO: 24962 - DNA, 1260 bp, Anaeromyces robustus
  Glyco_hydro_9
tgctagacatcttgaattaaatttcttattctatgaagcccaacgttctggtcatcttccagccaataatcgtattccatggagaagtgactctggtcttgaccatggtgctgataatggtgtagatcttactggtggttattatgatgctggtgataatgttaaattcaatttcccacaagcattctctatgactgctattgcttggtatggtcttgaattcgctaaaggtgttgaaatggctggtcaaactgaatatttaaaggataccgttaaatggggttgtgattatttattaaaatgtcataaaaagggtacagatgttttctatatgcaagttggtgatggtgatattgatcatctttattggaaggctgttgaagatattgattatccaactccatccttctatgttgattctaaaaacccaggtactgaagttactggtgaaactgctgctgcttttgctgctgcttctcttcttttcaaagaaagtgacccagaatattctgctactcttttagatcaagctgttgaatggtttaattttgctaatacttatagatttgattattctgtttctgttccaaaggttgctagttactataagagttggggtggttacaaggatgaacttgcctgggctgctatatggctttacaaagctcttggtgaagaaaaatacttagaattagctaaggatcttgttaaagattataaacttggtgaactcggttttgattgggatagtaaataccaaagtactattgttatccttgctcaacttggtgttaaggaatatgttgaaaaagttgaaaattgggttagagaaatttgtactaagggtaaattatctccaggtggtctttacattaataaagatagtgaatggggatcctgtcgtcgtgctacttctatggctgctagtttaattttctatactcatactcttccagaaggtaatgaattacgtgaaatggctaagaagtttgctcaatctcaagctgattatgttcaaggtaataatccacttggtattgatttcgttgttggtgctgatgcttcttcaccacgttctgttcatcatcgtactgcttctggtgctgattgtattgaatgtgatccagttgaaaatgctcatattatttatggtgctttagctggtggtccagatgaaaatgatcaatatgaagatattagagctgattaccaaaagaatgaagttgctcttgattataatgtttgttatgctgctgtttg

SEQ ID NO: 24963 - DNA, 1308 bp, Piromyces finnis
  Glyco_hydro_9
ttatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttacaaggaagctggtcaatggaaatatcttcttgatgcagttcgttggggagctgattacttcatgaagtgtcacactggtaagaacgaactttatgctcaagttggtaagggtactactgatcactcatactggtacccaccagaatatgcttcctacgatcacccatcattcaagctcacagcttcagctccaggtaccgaagtttcagccgatactgcctcattcttagctgcttcatacctcttattcaaggatgaagatccatcctatgcctccaagtgtttacaacactccaaggaaatctatgactttgccgatacttaccgtggtgattacattggatcaattccagatgtttcaggtttctactccacctggagtggttacaatgatgaattagcctttggtgccttatggctttacagagccactggtagcgaaagttacatgaagaaattcgaagccattgctgatgcagtttatggagctcaagatactaaggcttacggtacttgtactggaccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgcttt

SEQ ID NO: 24964 - DNA, 1305 bp, Piromyces finnis
  Glyco_hydro_9
ttatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttataagagtgctggacaatgggaatatattttagatgctgttcgttggggtgctgattatttcatgaaatgtcacactggtaaaaatgaactttatgctcaagttggtgatggtaatactgaccatgctttttggtatccaccagaatatgtaaaatatgattacccatcatttaaagttactgctgaaaaaccaggttctgaagttgctggtgaaactgctgcatttttagctgctgcttccattctttttaaggatgaagattcttcttattctgccaaattattaaagcatgctaaggaaatttatgaatttgctgatacttatcgtggagattatactggtgctattccaggagttgttagtttctacagtacctatagtggttataatgatgaattagcttggggtgctgcttggcttcttagagctacaggtgatgaatcttatcttaataaatacaatgttatcgcaaataaaaagtatgaatcttatgatccaaagaaattttcaggtgctactggaccaatctcttgggatgataagagaccaggttgctatattttaattgctatggttactggtgatgaaaatcgtatcaaggaagcttacaattattgtgatgctgtattaacacaaccaaaaactccaggtggtttatggtatgatgatggtttatctatgtggggttctaatcgttatgcatcaaatgctgcctccatgttagctatgtttgcaaactatcttccaaaatctgatccaaaacgtgctaagtatgttgaatttgttcaacaacaaactaattatattcttggtgacaacccagctaaaattaattacgttgttggtgctgaagccaactcaccaaaagctgttcaccatcgtggttcttctggtgtcttcgattcacaagataaagctgcaaaaccagatgaaaacatttacacattatggggtgctttagccggtggtccagatgaaactgattcttacattgatactcgtagtaactttagaaccaatgaagtagctcttgattacaatgctgctttccaaatgaatcttgcttt

SEQ ID NO: 24965 - DNA, 1305 bp, Piromyces finnis
  Glyco_hydro_9
tgctagacacattgaattatctcttcttttctatgaagctcaacgttctggtaaacttccagaaaataacagagtttactggagacatgatagtttacttgatgctggtgccgataatggtgttgatcttaccggtggttattatgatgctggtgataatgttaagttcaacttcccaggtgctgctgccttaactcttcttgcttggagtggtattgattatgctgatggttacaaagaagctggtcaatgggattatatattagatgcagttcgttggggtgctgattactttgtcaagtgtcacactggaaagaatgaactctacgttcaagtaggtaagggtgctactgatcatggtttctggtatccaccagaatatgttcaatatgatcatccatcttacaaaattactgctgctgctccaggttccgaagttgctggtgatactgcttctttcttagctgctgcctctattcttttcaaggatattgattcttcatattcttctaatttattaaaacatgctattgaaatatatgattttgctgattcttaccgtggtgaatacattaaggctgttccagatgctcaaggtttctactctaactggagtggttacaatgatgaattagcctttggtgctttatggttatacagagctactggtgaaagtaagtatatggataaattcagtaaaattgctgatgcttcttacggtgaacaagatactaaggcttatggtacatgtactggtccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgcttt

SEQ ID NO: 24966 - DNA, 1308 bp, Piromyces finnis; identical to SEQ ID NO: 24963
  Glyco_hydro_9

SEQ ID NO: 24967 - DNA, 1305 bp, Piromyces finnis; identical to SEQ ID NO: 24964
  Glyco_hydro_9

SEQ ID NO: 24968 - DNA, 1305 bp, Piromyces finnis; identical to SEQ ID NO: 24965
  Glyco_hydro_9

SEQ ID NO: 24969 - DNA, 1296 bp, Piromyces finnis
  Glyco_hydro_9
ttacgctcgtcaccttgaactttctattcttttctatgaagctcaaagatctggtaaattaccagctaacaacagaattttctggcgtcatgacagtatggttgatgctggtaaagataacaaggttgatttaactggtggttactacgatgctggtgataacgttaaattcaatttcccacaagctagtgctcttactcttcttgcttggggtgcctacaaatggaaggatggttacaaggaagctggtcaatgggattacatgaaggatttacttaagtggggtatggattacttcattagatgccacactgacaagtacgtcttatacggtcaagttggtaatggtagtttagatcacggtgcttgggttgctccagaagatattgactacgaatacccatcttacaagattactgcttccgctccaggttctgatcttgctgctgaaacttctgcctctatggttgctgcttctttagctttcagagatgaagacccaacctatgctgatactttattaaagcatggtagagaactttatgaatttgctgaaaagtaccaaggtacttacgataaatctattactgatgccaagggttactaccgttcttacagtggttttaatgatgaacttgtttggggtgctgctatgttatacgctgccactggtgaacaaacttacaaggacaaggtcgataagatttggaacactccatacggtgaacttgatccagatagattccttggttctactggtccaatttcttgggatgataagaaggctgctgcttacgctttaatggccatcactactggtgaaagcaaatatattgaagaatccactagacacagtgatttaatggttaattacccaactactccaggtggtttatggtacgatactaacttatctatgtgggcttctaacagatatgctgctaatgctgctttcactgttgctatgttagctacctctatggatgctaatgactctaagcgtaaggaatatgttgcttttgttaagaagcaaattgattacattcttggtgataacccagctaaggttgattacgttgttggtgctgacccaagttctccaaaggctgttcaccaccgtggtgcttctggttcaaagggtgctgacaagggtccagatgaaaacgttttcattttatatggtgctcttgctggtggtccaggtgccaaggataattacaaggatgctcgtaacaactatgaaatgaacgaagtcgccttagattacaatgctgccttccaaggtcttttagcctt

SEQ ID NO: 24970 - DNA, 906 bp, Piromyces finnis
  Glyco_hydro_9
tttaaaacttactacaggtgctccaggttctgaagttgctggtgatactgcttcatttttagctgctacttacattattttcaaggatatagatccttcttatgccaaaaaatgtttacaacattctaaggaaatttatgaatttgctgatacctatcgtggtgattattcaaaatcttttggtgattatgtcaatagtttctataagaattggggtactatttatgatgaattagcttttggtgctttatggctttacagagctacaaatgatgaatcttacttaaaaaagtataaagcaattgctgatgcttcctacgatactagagatgaaaatgcctatggtaattgtaagggtccaatttcatgggatgataagagaccaggtggttatgtacttggtgctatcgttactggtgaagaaaaatatattgaaaaagctttaagttattgtgatatggtattaactcaaccaagaactccaggtggtttatggtatgatagtaacctttccaaatggggttctaaccgttatgcttctaatgctgcatccatggtagctatgatggcagatttccttccaaaggatgatgctagacgtgcaaagtatgttgatttcgttaaaagtcaaacagattatattcttggtgataatccagctggtgttaactatgttgttggagctgaagaaaattcaccaaaggctgttcaccaccgtgctgcctcaggtacttatgattctcaagatcgtaatgccaaaccaaatgatcataatgtttacactatttggggtgctttagctggtggtccagcaaaggatgattcctacgaagataccagaaagaattatgaaatgaatgaagttgctcttgattataatgctgctttccaaatgaatcttgcttt

SEQ ID NO: 24971 - DNA, 114 bp, Piromyces finnis
  Glyco_hydro_9
tgctcttgctggtggtccagatgctaatgataaatatactgatgatcgtaccaactataattccaatgaagttgctttagattataatgctgcttatactggtcttcttgcctt

SEQ ID NO: 24972 - DNA, 114 bp, Piromyces finnis
  Glyco_hydro_9
tgctcttgctggtggtccagatggtaatgataagtacactgatgaccgtaccaattacaactccaatgaagtcgctttagattataacgctgcttacactggtcttcttgcctt

SEQ ID NO: 24973 - DNA, 1192 bp, Piromyces finnis
  Glyco_hydro_9
ttatgctagaattttaaatttaaatttacgtttctatgaatgtcaatggtctggaaaagctccagaaaataaacaagtctattggagatatgattctgccttagaagatggtgctgatgttggtttagatcttactggaggtttttatgatgctggtgatcatgtaaagtttaatttaccaatgtcttatgctatgactatgttggcttggggtggtattgatttatatgataattatgttgctgctggtcaaattgattacttaattcaaatggtaaatcatgctgctgactattttgttagatgtcatccagaaaaggaagttatttatgctcaagttggtcttggtgatgtagatcattgtttctgggttccacctgaattaatggaaatggaaagaccagctgtttgtaagcttactccagagaatggtgcttctgatgtaactgcacaaatggctgctgcattagctagtgcatcaattttaaataagaaatatggtaatgaggaaaaagctgaactttatttaaagcatgctattgaaatttacgattttgctgataaatacagagatgtatatggtaatccttgtccagaaggtgcatctttctatccatctgcttcttataaagatgaattagtttggggtgctgcttgggtttaccgtgcatctggagatgagaaatactatgaaaaggctgattcatattatgattctcttggtttatctggtcgtgtattaattggtccaatttcttgggatgatgcttcatcaggtattattttcttaatgtcaaagccaggatttggttcaaactggaaaagatatttaggtgaagctcagacttatgttgatcaatacttaaatgataaatcagctcgtaccgatgctggtatgttatggtatagtgctgtttctggttggggatctgctcgtcatgctatggctggtacattcctttactgtattttcaatacttatcataacccaactgatccaaaatactttaatttcattcaacaacaagctgattatattcttggtaataatccatttgatcgttcacttgtagttggttctattccaggtcatgatccacttaatgttcatcaccgtggttctcatggaggttattcaccaatttctccaccagaacacaacatgtatactttatatggtgctcttgctggt

SEQ ID NO: 24974 - DNA, 1192 bp, Piromyces finnis; identical to SEQ ID NO: 22660
  Glyco_hydro_9

SEQ ID NO: 24975 - DNA, 741 bp, Neocallimastix californiae
  Glyco_hydro_97
ttgggtagccccaggtgtttcctcatggtcatgggttgctcactgggggtacggtgaaagtgatcaatcgaatcctaatacgcataaaaaatggattgatctggcttcaaccatgggatggagattctacattttagatgaaggatggcaaccagatagttatgacaatgatggtagttattactcgggttggtttgattggtggccagaagttagagattatgctaaaaggaagggggtacaacttattgcctgggttcacaagaatgatgtggatacaccggaaaagagaagaaaaaggtttaaggaatggtcagaggaaggaattgttggtattaaagttgatttcttcttcaatgaggctcaaagtaccttacaacttcatcaagatatttataaagaggcggccaggtaccatttactcgttaatgttcatggttctaatccaccatcaggagaaattagaacttatcctaatgttcttgctcgagaaggtattagaggacaagaggctggtggtattacggcgtatcaatatactattcttccatttactcgtggcgccattggtacaacagatgttactgaagagcttcgttctaaggatcccgaagtcaccacaatgggattccaaattgctctttctaccctctttgaaaatggtattcattctcttggaagtgctcccgatgtctattacagcaatactgaaggatccgactattataaagatttcccagc

SEQ ID NO: 24976 - DNA, 909 bp, Neocallimastix californiae
  Glyco_hydro_beta-prop
aaaccacaacccaatcatcactcaaaagtatagtgctgatccaggtgttatggtttacaacggtagagtttatgtttatgctactaatgatggtgatgctggtaccagatacaattcagaaaacacttacggacaaattaacactattaatgttatgtcttctgctgatttagttaactggatggatcacggttcaattccagctgctggtggtggtggtgctgctagatgggcatctaactcatgggctccatgtgctgcttggaaaaagattaatggtaaggataagttcttcctttactttgccaataacgctagtggtattggtgttttaactgccgattctccaactggtccattcaaggatccaattggtagagctcttatctcacgtcaaactccaaatagtaatgttgaatggcttttcgatccagctgttatcgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattctggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaaccaccacactattattgaattcaagaataagtactacatcttctaccacgctgaatggcttaacaagcaaattttaggtggtcaaaagggttaccgtactactcatgttgatgaattaccagttaatgg

SEQ ID NO: 24977 - DNA, 315 bp, Neocallimastix californiae
  Glyco_hydro_beta-prop
tgaagattctggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaaccaccacactattattgaattcaagaataagtactacatcttctaccacgctgaatggcttaacaagcaaattttaggtggtcaaaagggttaccgtactactcatgttgatgaattaccagttaatgg

SEQ ID NO: 24978 - DNA, 849 bp, Neocallimastix californiae
  Glyco_hydro_beta-prop
tgtaaataatccaattatatgggctgatgtacctgatccagatattattagagtagatgatacatattatatggttagtactactatgtacttcactccaggtgctccaattatgaaatcaaaggatcttgtatcatgggaaattgttacttacacctatgatattttagccaatggtgatgttcaaactctttctagaggtcaacatgattattctcatggttcatgggctgcaagtttacgttataataaaggaattttctatgtattctttggtagttatggtacaaataaatcttatatatttaaaactaaggatattgaaagtggaaaatgggaacgttttgaaattaacggaatgtaccatgatgcttccattcttttcgatgatgatggtagaaattacctcgtttatggaggtggtggtgaaattaagattaaggaatttaatgcggaaatgaccaattttaaatggggaggtcttgataaaactttatttagaactaatctttctggtctcgctggtgaaggatctcatgttatgaaaattaatggatattactatgtatttattattgcttggccaagtggtaaaggtcgtattgaaatttgttaccgtagtaaagacctcactggttactatgaaaacaaaacagttttagattcaggattaggttcctatggtagtggtgttgcccaaggtggtattgtagatacccctgatggtaaaaaatggtttggattattattccaagatcatggtgctgtcggtagaattccagttcttgttccagttaattggcaaaatggatggccaatgatgggtgttaacggtaaagctccacttac

SEQ ID NO: 24979 - DNA, 915 bp, Neocallimastix californiae
  Glyco_hydro_beta-prop
aaatcataatccaattaatactattaagtacagtgctgatccaggtgtcatggtttatgatggtagagtttatgtttatggtaccaatgatggttatgctggagaattaggaagaaacccacaggataatacttatggtcaaattaatactattaatgttatgtcttctgatgatttagttaattggatcgatcatggtactatcccagctgctggtagaaatggtgctgctaagtgggccggtaactcatgggcaccatgtgctacacacaagaaaatcaacggtaaggaaaagttcttcctttactttgcaaacagtggtaatggtattggtgttttaactagtgattctccaactggtccatttgttgatccaattggtcatgctcttatttctcgtagtactccaaattgttccaatattgtttggttattcgatccagctgtatttgttgatgatgatggtactggttatctttacttcggtggtggtgttccagataatcaatcttctaatccaaagactgttcgtgctgttaagttaggtaatgatatgactagtcttgctggtaatccagttactattgatgctccatgggtatttgaagattctggtattaacaaatccggtgatacttacttctactcatattgtactaactggaatggtggtccatacggtaatgctaagattgcttacatgactagtaagaatccattaggtccatttactatgcaaggaactgttttaaataacccaggtgatttctttggaactactggtaacaaccatcacactatcattgaatttaaggaccaatggtacatcttctatcacgctgaatggcttaacaaacaagaatttggaagtcaaaagggataccgtacttcacatgttgatgttttaccattttc

SEQ ID NO: 24980 - DNA, 909 bp, Neocallimastix californiae
  Glyco_hydro_beta-prop
aaatcataacccaactattactcatagatatagtgctgatcctggtgttatggtttacaatggtagagtttatgtatatgccaccaatgatggtgatgccgctactagatataattcagaaaacacttacgctcaaattaataccattaatgttatgtcatcagctgatttagttaattggatggatcatggttcaattaatgctactggtggtggtggtgctgctaaatgggctaaaaactcttgggccccagctgccgcctggaagaaaattaatggtaaggataagttcttcctttactttgctgataatgctagtggtattggtgttttaactgctgattctccaactggtccattcagggatccaattggtagagctcttatttctcgtcaaactccaaacagtaacgttgaatggcttttcgatccagctgttttcgttgatagtgatggtactggttatctttactatggtggtggtgttccaaaaggtagagaagctaacccaaataccattcgtgttgctaaattaggtggtgatatgactagtatttctggtactccagctaatattgatgctccatgggtatttgaagattctggtattaataagattggtaacacttatgtttactcctactgtactaactggaatggtggtccatacggtaatgctagaattgcttacatgaccagtaacaatccaatgggaaaattcactttccaaggtacctgtttcaacaatccaggtgatttcttccaaactactggtaataatcaccacaccattattgaatttaagaacaaatactacatcttctaccatgctgaatggcttaacaaacaaatcttaggtggtcaaaagggttaccgtactactcatgttgatgaattacctgtcaatgg

SEQ ID NO: 24981 - DNA, 1044 bp, Neocallimastix californiae
  Glyco_hydro_beta-prop
aggtgtttcagttcatgatccatctatcgttaaaagtggtaacaaatattatatttttggatctcacatggacgctgcatatactaccgatttatggaaatttacaaaattgtatacaggtgttgatgaaaataataaaatgtttacaaatttattctcaaaatccaactatgatgcatttaaatttgtaggaaagaatagtgatggaggttattctgtatgggcagcagatgttatgtataataagaaaatgaaaaaatgggttcaatatttctgtacttcttctacttatattaaatcaagtctttgttatggtatagctgataaggttgaaggaccatatacttataaaagttgttttctccattcaggtatggattcaggatctgttggcaaaactaatttaagggctattacaggaactgaagataaaaatcgttattatccaaataacagatataacaacaaagtttatccaaatgctattgatccaaatgcattctatgattttaatggtagactatggcttgcttatggttcttggtcaggtggtatttacattttagaattagatgaaagcactggtcttccaaagcataatatttcaaatggtaataatgttgataaatattacggtaagaaacttgcaggtggaggtcatcaatctattgaaggtccatacattttaccatacaaagctgctggatactattatttgtttgtatcatatggtactcttacttcaaatggtggttaccaaattcgtttgttccgttcaaagaatccagatggtccatatactgatgttgctggtaaagaatttatgagtggtactaattcaaactttggtgttaagattatgggtaattatggtattccaggaagagaaaaggcttatatggcaccaggtcacaactctgtattaattgacgatgatggtaaaattttactttgctaccatactcgttttaatgatggtcaagaataccacgaaccacgtgttcaccaaatgttccttaataaggaaggttggttaaccgctgc

SEQ ID NO: 24982 - DNA, 673 bp, Neocallimastix californiae
  Glyco_hydro_beta-prop
taatccaattattaaggatatgtacactgctgatccagctccaatggtttatggtgataccctttacctttacactactcatgatgaagatgtacttaagaacaacttctacactatggaaaactggtatgtcttttctactaaggatatggttaactggactaaccatggtcaaatcttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaggaaattggacatccaattgtttatgaagatgactggaatgactttgacccaactgttttcattgatgatgatggtaaggcttacttatacttcggtaatccagaacttagatatgttgtcttaaacgatgatatgatttcttatgatgaagaaattggagttgttaaggttccaatgactgaagaatccttcggtaagggtagtcacgataccggtacatcctatgctgaaggtccatacttctacaagagaaacggtctttactacatggtctatgctgccttcagagaaggttctcacactgaatctcttgcttattctacttctgaaaagcca

SEQ ID NO: 24983 - DNA, 855 bp, Neocallimastix californiae
  Glyco_hydro_beta-prop
taatccaattattaaggatatgtacactgctgatccagctccaatggtttatggtgataccctttacctttacactactcatgatgaagatgtacttaagaacaacttctacacaatggaaaattggtatgtcttctctactaaggatatggttaactggactaaccatggtcaaattttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaagaaattggacatccaattgtttacgaagatgactggaatgactttgacccaactgttttcattgatgatgatggtaaggcttacttatacttcggtaatccagaacttagatacgttgtcttaaacgatgatatgatttcttatgatgaagaaattggtgttgttaaggttccaatgacagccgaatccttcggtaagaatggtgatcgtactacttatggagaaggtccatacttctacaagagaaacggtctttactacatggtctttgctgctttcagagaaggtgcttttactgaatctcttggttatgctacttctgaaaagccaactggtccatggaagtacggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctattga

SEQ ID NO: 24984 - DNA, 861 bp, Neocallimastix californiae
  Glyco_hydro_beta-prop
taatccaattattaaggatatgtacactgctgatccagctccaatggtttatggtgataccctttacctttacactactcatgatgaagatgtacttaagaacaacttctacactatggaaaactggtatgtcttctctactaaggatatggttaactggactaaccatggtcaaatcttatctttagatgatattgaatgggctgatgaaagagcttgggctccacaaactgttgaaaaggacggaaagttctacttctacttcccagctcacaagattgatggtggtatggctattggtgttgctgttgctgattctccaattggtccattcaaagaaattggacatccaattgtttatgaagatgactggaatgattttgacccaactgttttcattgatgatgatggtaaggcttacttatatttcggtaatccagaacttagatatgttgtcttaaacgacgatatgatttcttatgatgaagaaattggtgttgttaaggttccaatgactgaagaatccttcggtaagggtggtcacgataccggtacatcctatgctgaaggtccatacttctacaagagaaacggtctttactacatggtctatgctgccttcagagaaggttctcacactgaatctcttgcttattctacttctgaaaagccaactggtccatggaagtatggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctattga

SEQ ID NO: 24985 - DNA, 858 bp, Neocallimastix californiae
  Glyco_hydro_beta-prop
tccaattattaaggatatgtacactgctgatccagctccaatggtttatggtgataccctttacctttacactagtcatgatgaaactgaacttaagaacaacttctacactatggaaaactggtatgtcttctctactaaggatatggttaactggactaaccatggtcaaatcttgtctttagatgatattgaatgggctgatgaaagagcttgggctccacaaactgttgaaaagaacggtaagttctatttctacttcccagctcacaagattgatggtggtatggctattggtgttgctgttgctgattctccaattggtccattcaaagaaattggacatccaattgtttatgaagatgactggaatgactttgacccaactgttttcattgatgatgatggtaaggcttacttatacttcggtaatccagaacttagatatgttgtcttaaacgatgatatgatttcttatgatgaagaaattggagttgttaaggttccaatgactgaagaatccttcggtaagggtagtcacgataccggtacatcctatgctgaaggtccatacttctacaagagaaacggtctttactacttagtctatgctgctttcagagaaggttctcaaactgaatctcttgcttacgcaacttctgaaaagccaactggtccatggaagtacggtggtgttcttatgactgaaggtactgctttcactaatcatccaggtattgctgatttcaatggtaaatcttacttcttctaccatactgatgaacttccaggaggtggtgacttccacagaagtgtttgtgttaccgaatttgaatacaaggaagatggatctattga

SEQ ID NO: 24986 - DNA, 924 bp, Neocallimastix californiae
  Glyco_hydro_beta-prop
taatcataatccattgtttactcatagatatagtgctgacccaggtgttatggtttataataatagagtttatgtctatgctactaatgatggtgatgttgccactaaatttacagacgataatacctatagtcatattaattcacttaatgtcatgtcttctgaagatttagttaattggacagatcatggttcaatcttagttgctggtaataatggtgctgctaaatgggctggtaattcatgggctccatgtgctacttataaaaaaattaatggaaaggataagttcttcctttactttgctaataatgctaatggaattggtgttttaactagtgattctcctactggtcctttcaaagatccaattggtaaagctcttatcactcgtcaaactccaaattgtggtgatgtcgcttggctttttgacccagctgttttagttgatactgatggtactggttacctttacttcggtggtggtgtaccagacggtaaggatgctgcaccaaaaactattagagttgttaaattaggagccgatatggtaagtcttgccggaactccacaacttattgatactccatatgtatttgaagattctggtataaataaaattggaaatacctattactattcttactgtaccaattggtctgcaggtgaaccttatggacaagctagaattgtttatatgaccagtagtaatccaatgggtccattcacatatcaaggtgtctgtttaaataatccaggagaagatttccaaacttatggaaataatcatcatactattattgaattcaaaaataaatattacattttctatcataccgaatggcttaataagcaagttttcggaactcaaaagggttatcgtacttcctttgttaatgaaattacattcagtaatggcaaatt

SEQ ID NO: 24987 - DNA, 843 bp, Neocallimastix californiae
  Glyco_hydro_beta-prop
cgtaagaaaccctatcatatgggctgatgttcctgatgatgatatcatcagagttgatgatacttattatatggtaagtacaacaatgttctttagtccgggtgctcctattatgaagtcaaaggatctcttttcatgggaaatttgcaactatgtttatgatatccttgctgatggtgacgttcaaactcttaagaatggaaagcatgattattctcatggtcaatgggctgctagtttacgttatcatgagggtactttttatgtcttctttggtagttatggtactaataagtcatatatctttaaaaccaaagatattgaaaaaggtacttggactcgtaatgaaatctttggtatgtatcatgatgcttcaattctctttgatgatgacggtaggaagtatctcgtctatggtggtagtggtgaaatcaaaattaaagaatttaacaatgaaatgaccgacttcaagagaggtggtgctgataaagttttatttagaactggtctttctggtcttgctggtgaaggttctcatattcaaaaaattggtaaatattactatatatttattattgcttggccaaatggaaagggtcgtattgaaatttgttaccgtagtagagatcttcttggaaattatgaaaacaagattgttcttgattccggtttaggttcctatggaagtggtgtagctcaaggtggaatcgttgatacacctgatggtaaatggtatggtcttttattccaagatcatggttctgttggtagaattccagtacttgttccagtcaattggcaaaatgattggccaataatgggtgttaacggtaaagcaccatt

SEQ ID NO: 24988 - DNA, 906 bp, Neocallimastix californiae
  Glyco_hydro_beta-prop
taaaaatcctttaattactcatagatatagtgcagatccaggtgttatggtttacaatggtagagtttatgtttatgcaactaatgatggtgatgttgctaatagaaatgttggtgaaaataaatatgatcaaattaatactattaattgtatgtcatctgatgatttaattaactggatggatcacggaccaattccagctgctggtggtaatggtgctgccaaatgggctaaaaattcatgggctccaactgctgcttggaagaaaatcaatggtaaggataagtttttcctttactttgccaataacgctagtggtattggtgttttaactgccgattctccaactggtccattcaaggatccaattggtagagctcttatctcacgtcaaactccaaatagtaatgttgaatggctttttgatccagctgtttttgttgatactgatggtactggttatctttactacggtggtggtgttccacaaggtcaaaatgctaatccaagaactattcgtgttgccaagttaggaaatgatatgacaagtattcaaggtactccacaaatgattgatgctccatgggtatttgaagattcaggtattaataagattggtaacacttatgtttactcatactgtactaactgggctggaggtccatacggtaatgccagaattgcttacatgactagtaacaacccaatgagtggattcaaataccaaggtacttgtttcaacaatccaggagatttcttccaaactactggtaacaatcaccacactattattgaattcaagaataagtactacatcttctaccacgctgaatggcttaacaagcaagttttcggttctcaaaagggttaccgtactactcatgttgatgaattaccagttaatgg

SEQ ID NO: 24989 - DNA, 585 bp, Neocallimastix californiae
  Glyco_hydro_beta-prop
tggttgtattcgtgatccctttattttaaagggtcaagatggttattattatatgttggctactgatatgagatcgtacagtggctgggatagtaatcgtaatattttaagtgcgaagtcaaaagatttaatacattggaatgatgtcacaagtatagaaattgctaataaatatcctcttactcaaggagctgatcgtgcctgggctccacaagctatctatgatcatgaaaagaattcttatatgatctattttgctgttagagttccaaaccgtggtaataaaaccattatgtattatgcttatagtaaggacatgaaaaaattagatactgctccagcccttttattccaaccaagaaatggtaatgaagctattgattctgatattattttccaaaataataaatactacatgtattacaaggacgaaactagaaaaaccatttgtttagctactgctgatcatgccagtggtccatatcaagaaattaaacaactttctgataatggtattgaagttgaaggttgtaatatttataatattattggaaccaataaatggttaatgatgtctgatgccta

SEQ ID NO: 24990 - DNA, 924 bp, Neocallimastix californiae
  Glyco_hydro_beta-prop
aaatcataatccaatcaatgtattaaagtacagtgctgatccaggtgttatggtttatgatggtagagtttatgtttacgctactaatgatggtattggtgaaaatattggaaataacccaagagataacgattacagtcacattaacactattaatgttatgtcatctagtgatatggtaaactgggttgatcatggtacaattccagctgctggtaacagtggtgctgctaagtgggctggtaattcatgggctccatgtgctgctcacaaaaagattaatggtaaggaaaagttcttcctttactttgctaatagtggtaatggtattggtgttttaactagtgactctccaactggtcctttcgttgatccaattggtggaccacttgtttctcgtagtactctaaactgtaacagtattgtttggttatttgatccagctgttatggttgatgatgatggtactggttatctttacttcggtggtggtgttccagaaaatgctaagtctaacccaaaaactgttcgtgcagttaaattaggtaatgatatgattagtcttgctggtactccacaaactattgatgctccatgggtcttcgaagattctggtattaacaaggctggaaacacttacttctattcttactgtactaactgggataatggaccatacggtaatgctaagattgcttacatgactagtagcagtccattaggtccattccaataccaaggtactgttcttaacaacccaggagatttctttggaactgttggtaacaatcaccacaccattattaacttcaagaacaaatggtatatcttctatcacgctgaatggcttaacaaacaagtcttcggtagtcaaaagggtttccgtacttcacacgttgatgaattaccattcagtaacggtaa

SEQ ID NO: 24991 - DNA, 1044 bp, Neocallimastix californiae
  Glyco_hydro_beta-prop
aggtgtgtctgttcatgatccgtctgtagttaagtatggtaataaatattatatatttggttcccacatggatactgcctatactaccgatttatggaagtttactaaattgtatactggtgttaatgataacaataaaatgtttacaaatttattttcaaaatcaaattatggtgcatttaattttgtaggaaaaaatagtgatggtggttattctgtttgggctcctgatattatatataataatagaatgaaaaaatgggttcaatatttttgtacatcttccacatatattaaatctagtatttgttacgctttagctgataacgttgaaggtccatacacttataaaaattgctttattttctctggtatggattcaaaaaccgttggtaaaactaatttgaaagctgttattggatatgaagatatgaatcgttattatccaaataacaaatacaataatagagtttatcccaatgcaattgatccaaatgcattttatgattttaaggggaagttatggcttgtttatggttcttggtcgggtggtatatatattttagaattagatgaaagtacaggtcttccaaaacacaatatttctaatggcaataatactgatagatactatggtaagaagcttgcaggtggtaatcaccaatctattgaaggtccatttattttaccacacaaagctgttggttattattatttatttgtatcctatggctctcttacgtcaaatggtggttaccaaattcgtatgttccgttctaaaaatccagatggtccatatacagatgttgctggaaaagaatttatgagtggtaataattcaagctttggtgttaaagtcatgggtaattataatattcctggaagagaacaggcatatatggctccaggccacaattctgctttacttgatgatgatggtaaagtgttaatattctatcatactcgttttaatgatggtcaagaatatcacgaaccacgtattcatcaaatgtttcttaataaggaaggatggttatgtgctgc

SEQ ID NO: 24992 - DNA, 132 bp, Neocallimastix californiae
  Glyco_hydro_beta-prop
aggtgtgtctgttcatgatccgtctgtagttaagtatggtaataaatattatatatttggttcccacatggatactgcctatactaccgatttatggaagtttactaaattgtatactggtgttaatgataa

SEQ ID NO: 24993 - DNA, 847 bp, Neocallimastix californiae
  Glyco_hydro_beta-prop
ttgtaagagtcctctcgttagcaacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaatac

SEQ ID NO: 24994 - DNA, 924 bp, Anaeromyces robustus; identical to SEQ ID NO: 24990
  Glyco_hydro_beta-prop

SEQ ID NO: 24995 - DNA, 867 bp, Anaeromyces robustus
  Glyco_hydro_beta-prop
ttgtaagagtcctctcgttagcaacatgtacactgctgatccagccccaatggtttatggagatactctttatcttttcacttctcacgatgaaaacaacattcaaaacaacttctacactatgttaaactggcatcttttctcaacaaaggatatgattaactggactagtcatggacaagtcttctctttagatgatatcagctgggctgatgatagagcttgggctccacaagctattgctagaaatgataaattctatctttatgtaccagtacataaaagaaatggaggtatggccattgctgttggtgtttctgataaaccaactggtccatacaaggatattggtcatccacttgttgatgaaggtgattggaatgatattgatccaaccgttttcattgatgatgatggtcaagcttacttatacttcggtaatccagaacttagatacgttcttttgaacgaagatatggtttcttacaacaaatctgttggtgttaagaagattccaatgactgctgattccttcggaagaggtgaaggtagccgtactacttatggcgaaggtccattcttctacaaaagaaaggatatgtactatatggcttacgctgctttcagaccaaataagggtagtgaacatcttgcttattcttactctaattcaccaactggtccatggaagtacggtggtgttcttatgactgaagatggtggtacatacactaatcacccaggtattgctagattcaagggacgttcatacctcttttaccacactggtcaacttccaggtggtggtgcttaccacagaagtgtatgtttcactgaattcaaatacaataaggatggtagtattga

SEQ ID NO: 24996 - DNA, 846 bp, Anaeromyces robustus
  Glyco_hydro_beta-prop
agtttataatccaattatctgggcagatgtacctgatccagatattattagagttgatgatacttactatatggtaagtactactatgttttttaatccaggtgctccaataatgaaatcaaaagatcttgtttcatggaaaatttgtaattatgtttatgataaacttgctgatggtgatgttcaaaatcttgcaagaggtcaacatgattattctcatggtcaatgggctactagtttacgttatcataaaggaactttctatgttttctttggtagttatggtactaataaatcttacatttttaaaacaaaagatatagaaaatggtccatggactcgtactgaacttggtggtatgtatcatgatgcttctatgatttttgatgatgatggtagaaattatcttgtttatggagctggtggtgaaattagaattaaagaatttaattctgaaatgaccgattttaagagaggtggtgccgataaaattttatttagaactaacctttcaggtcttgctggtgaaggttctcatgttcaaaaaattaataattattattatattttcattattgcttggccaaatggtaaaggtcgtattgaaatttgttaccgtagtaaagatattcttggtaattatgaaagtagaactgtattagattctggtgttggttcttatggtagtggtgttgcccaaggtggtattgttgatactccagaaggtaaatggtatggtttacttttccaagatcatggttctgttggtagaattccagttcttgttccagttaactggcaaagtgattggccaatgatgggggttaatggtagagctccagtaac

SEQ ID NO: 24997 - DNA, 912 bp, Anaeromyces robustus; identical to SEQ ID NO: 14689
  Glyco_hydro_beta-prop

SEQ ID NO: 24998 - DNA, 1047 bp, Anaeromyces robustus
  Glyco_hydro_beta-prop
aggtgtatccgttcatgatccatctgttattaagaatggtaataagtattatattttcggttcacatatggatactgcttatactaccgatttatggaaatttactaaattatatacaggtgtcaatgaaaataatagaatgtttactaatttattctctaaatcaaattatggtgcattcaattttgttggtaaaaacagtgaaggtggatattctgtatgggctccagatgttatgtataacaaaaaaatgcgtaaatgggtacaatatttctgtacatcttctacttatattaaatcaagtatttgttatgctttagctgataatgttgaaggtccatacacttatcaaagttgtttcattttctctggtatggattctggaagtgttggaaagactaatttaagagctgttactggtactgaagatggaaatcgttattatccaggtaataaatataataatagagtttatccaaatgctattgatccaaatgtattctatgatttcaatggtagactttggcttgcttatggttcatggtctggaggtatttacattttagaattagatgaaagtacaggtcttccaaaacataatattagtaatggtactaatattgataaatattatggtaagaaacttgctggtggtggtcaccaatctattgaaggtccatacattttaccatataaagctgctggttattactatttatttgtttcatatggtactcttacttctaatggtggttaccaaattcgtttattccgttctaaaaacccagatggtccatatactgatccagctggtaatgaattcatgggtggtactaattcaaactttggtcttaagcttatgggtaattacaatattccaggtagaagtcaagcctatatggctccaggtcataattctgctatgattgatgacaatggaaaggttttaatgttctatcatactcgtttcaatgatggacaagaatatcatgaaccacgtgttcatcaattattccttaataaggaaggttggttctgtgttgctcc

SEQ ID NO: 24999 - DNA, 642 bp, Anaeromyces robustus
  Glyco_hydro_beta-prop
tttacgtgatccttatatttttaaaggtgaagatggtttatattatttacttgctacagatatgaaatctgcacttggttggaatagtaatcgtaatcttttaagtgcaaaatctaaagatcttattaattggtatgatacaacaagtatagaaattgccaataaatatcctttaatgcaaggagctgatcgtgcatgggctccacaagcgatttatgatccagaaaaaaaatcttatatgatttattatgctgcaagagttcctggacgtgataatagaactattatgtattatgcttatagtaaagatatgaaaaaattagatacagcaccagccttattatttgctccaagtaatggtaatgatgctattgattcagatattattttccaaaatggaaaatattatatgtattataaaaatgaaactaataaacgtatttatcttgctacatctgatcatgctaatggtccatataaagaaataaaacaagtttctgaaggtaatattggtgttgaaggtccaaatatttataaattattaaattctaataaatggcttttaatgtctgatgcctattatgatcattattatgttatgcaagaaactactgatcttcaaaattttaaaacggttaatcg

SEQ ID NO: 25000 - DNA, 927 bp, Anaeromyces robustus; identical to SEQ ID NO: 14694
  Glyco_hydro_beta-prop

SEQ ID NO: 25001 - DNA, 648 bp, Anaeromyces robustus
  Glyco_hydro_beta-prop
aggtacaggatgtttacgtgatccatttattcttaaaggtgaagatggtacttactttttattagccactgatatgagatcttatagtggttgggatagtaatcgtaatattttaactgctagatctactgacttaattcattggacaaacgtttctcttattgaagtttgtaataaatatcctattttccaaagaggtgatcgtgcttgggctccacaagcaatttacgatccagaaaaacaagcttatatgatatactttgctgttagagttccaagtaatggtaacaaaactattatgtattacgctcatagtaaggatatgactagatttgataccaccccacaacttttatttgctcctaagaatggtaatgaagctattgatgctgatattatttaccaaggtggtagatattatatgtattataaagatgaaacaagaaaaactattaatttagctcttgctgaacatgcaagtgggccttaccaagaaattaaacaactttctgataatggtattgaagtcgaaggttgtaatatttatccagttgttggtactaataaatggcttatgatgtctgatgcttatgttaatggatatttcgtattacaagaaactactgatttagttaactttagaactct

SEQ ID NO: 25002 - DNA, 912 bp, Anaeromyces robustus
  Glyco_hydro_beta-prop
aaataaaaatccattgattactcatagatatagtgcagatccaggtgttatggtttacaatgatagagtttatgtttatgccacaaatgatggtgatgttgctaatagaaatgttggtgataatacatatgaacaaattaatactattaattgtatgtcttcagatgatttagttaactggactgatcatggaccaattgctgctgctggtcaaggtggtgcagctaaatgggctaaaaattcatgggctccaactgctgcccataaaactattaatggtaaggaaaaattcttcctttactttgctaacagtggtgctggtattggtgttttagttagtgactctccaactggtccattcactgatccaattggtaaagctcttattactccacaaactccaaattgtgctagtgttacttggcttttcgatcctgctgttttagtcgatactgatggtactggttatctttactttggtggtggtgtcccacaaggtcaagatgctaatccaaaaactattcgtgttgttaaattaggtccagatatgacaagtcttgctggtaatccagaaactattgatgctccatgggtattcgaagattctggtattaataagattggtaatacttatgtttactcttactgtactaactgggctaatggtccacatggtaatgctagaattggttatatgacaagtaatagtccaatgggtccattcactttccaaggtacttgtttcaacaacccaggtgatttcttccaaactactggtaataatcatcacactattattgaattcaagggtaaatattatatcttctatcacacagaatggcttaacaaacaagttttaggtagtcaaaagggttatcgtaccactcatgttaatgaaatgcctgtaaatgg

SEQ ID NO: 25003 - DNA, 915 bp, Anaeromyces robustus
  Glyco_hydro_beta-prop
aaataaaaatccaataattactcatagatatagtgctgatccaggtgttatggtttataatggtagagtttatgtttatgccactaatgatggtgatgttgctaatagaaatgttggtgataatacatatgaacaaattaatactattaattgtatgtcttcagatgatttagttaactggactgatcatggaccaattaaggctgctggtcaaggtggtgcagctaaatgggctaaaaattcatgggctccacatgctgctcacaaaactattaatggtaaggaaaaattcttcctttactttgctaacagtggtgctggtattggtgttttagttagtgattctccaactggtccattcactgatccaattggtaaagctcttgttactccacaaactccaaattgttctagtgttacttggcttttcgatcctgctgttttagttgattctgatggtactggttatctttactttggtggtggtgtcccacaaggtcaaaattctaatccaaaaactattcgtgttgttaaattaggtccagatatgacaagtcttgctggtaatccacaaactattgatgctccatgggtatttgaagattctggtattaataaggttggtaatacttatgtttactcttactgtactaactgggctaatggtccatatggtaatgctagaattgcctatatgacaagtaacagtccaatgggtccattccaatatcaaggtacttgtttcaacaacccaggtgatttcttccaaactactggtaataatcatcacactattattgaatttaaggataaatattatatcttctatcacacagaatggcttaacaaacaagttttaggtagtcaaaagggttatcgtaccactcatgttaatgaaatgccaatgaatggtaa

SEQ ID NO: 25004 - DNA, 858 bp, Anaeromyces robustus
  Glyco_hydro_beta-prop
tatcattacttcaatgtacacagctgatccagctccattaattgttgatgatactctttacatttacactactcatgatgaagatgttcttataaacaatttctatactatgagagattggtatgtattctctactaaggatatggttaactggactaatcatggtccaatcctctctttagatgatattacttgggctgatgacagagcttgggctccacaaactattgaaagaaatggtaaatactacttctattacccagctcataagattgatggtggtatggctgttggtgttgctattggtgactctccagttggtccattcaaagatattggcgaaccacttgtttatcaagatgattggattgatttcgatccaactgttttcattgatgatgatggtcaagcctacttatactttggtaatccacaacttagatatgttctcttaaatgaagatatggtttcttacaatgaagaagttggtattgttgatgttgaattaactgttgaaggttttggtgaaggtaataataacccaacctcttatgatgaaggaccattcttctataagagaaatggtatttattatatgttattctctggtttcagaaagggttacgaatctgaatacattggttacgctacttcaacttctccaactggtccatggaagtatggtggtattcttatggaagaacatgaagacaaaactttcactaatcactcatctattgttgaattcaatggtcacacctacttcttcttccacactggtgaccttccagatggtggtgacttccacagaagtgttgcttacatcgaatttgaatacaatgaagatggttccattaa

SEQ ID NO: 25005 - DNA, 858 bp, Anaeromyces robustus; identical to SEQ ID NO: 25004
  Glyco_hydro_beta-prop

SEQ ID NO: 25006 - DNA, 489 bp, Piromyces finnis
  Glyco_hydro_beta-prop
ttggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattctt

SEQ ID NO: 25007 - DNA, 609 bp, Piromyces finnis
  Glyco_hydro_beta-prop
tggatgtttacgtgatccatatatttttaaaggaaaggatggatattactatttattagcaacagatatgaaatctgctttaggttggaatagtaatcgtaatattttaagtgcaaaatcctctgatcttattcattggacgaatgaaagtagtatagaaattgctaataagtatcctttaatgcaaggagctgatcgtgcctgggctcctcaagccatctatgatcctgaaaaagattcctacatgatttattttgctgcccgagtccctggtcgtgataaccgaaccattatgtactatgcctacagtaagaatatgcaaaaattagatacagccccacaattgttatttgctccaagtaacggtaatgatgccattgattccgatattattttccaaaacaataaatattacatgtattataaaaatgaaaccaacaaacgtatttatttagctaccgctagtcacgcaagtggtccatacagtgaaataaaacaagtttctgaaggaaatattggtgttgaaggacctaatatttatcaacttcaaggtaccaataaatggcttatgatgtctgatgcctatggtaatggctattatgttatgca

SEQ ID NO: 25008 - DNA, 585 bp, Piromyces finnis
  Glyco_hydro_beta-prop
tggatgtattcgtgatccatttatcttaaagggtcaagatgattattactatttattagctactgatatgaaatcttacttaggttgggacagtaaccgtaatattttaactgcaaaatcaaaggatcttattcattggaatgatgttaccagtattgaaattgctaataaatatcctttaactcaagctgctgatcgtgcctgggctccacaggctatttatgatccagaaaagaaatcttatatgatctattttgctgttagaactccaggaaatggtaataaaactattatgtactatgcctacagtaaggatatgaaaaaattagatactgctccagctcttttatttgcaccaagaaatggtaacgaagccattgattctgatattattttccaaaacaacaaatactacatgtactacaaggatgaaactaagaagaccatttgtttagctactgctgatcatgctagtggtccatatcaagaaattaagcaactttctgatcgtggtattgaagttgaaggttgtaatatttatccagttgttggtactaataaatggttaatgatgtctgatgccta

SEQ ID NO: 25009 - DNA, 870 bp, Piromyces finnis
  Glyco_hydro_beta-prop
gagtccactcatcactaatatgtacactgctgatccagctccaatggtttacggtgataccctttacctttacactactcacgatgaaaacaaccttaaaaacaatttctacactatgcttgattggtacgttttctccactaaggatatggttaactggactaaccatggtaagattttctctttagatgatattagctgggctgatgacagagcttgggctccacaagctattgaaagaaacggtaaattctacctttactgtccagttcacaaaactaacggtggtatggctattgctgtcggtgtttctgacaagccaaccggtccatttaaggatattggtcatccacttgttgatgaaggtgactggaacgatattgacccaactgttttcattgatgatgatggtcaagcttacttatacttcggtaacccagaacttagatatgttcttttgaacgaagatatgatttctatcaataaatctgttggtgttaagaagattaagatgactgaagaagccttcggtaagggtagtcacgataccggtacaacttatggtgaaggtccatacttctacaagagaaacggtatttattacatggcctatgctgccttcagacaaggtaagaacattgaatctcttggttactctacttctacttctccaactggtccatggaagtacggtggtccacttatgactgaagaaggtggtgctttcactgttcacccaggtattgttgatttcaagggtcattcttacctcttctaccacactggtgaacttccaggtggtggtgacttccacagaagtgttggtttcgctgaattcagatataataaggatggttctattccagttgt

SEQ ID NO: 25010 - DNA, 1047 bp, Piromyces finnis
  Glyco_hydro_beta-prop
aggggtatctgttcacgatccatctgttgtcaaaaatggtaataaatattatattttcggttctcatatggatactgcttttactactgatttatggaagtttacaaagttatatacaggtgttaatgaaaacaataaaatgttttcaaatttattctcaaaatcaaattatggtgctttcaactttgttggtaaaaatagtgaaggtggattctcagtttgggctccagatgttatgtttaataagagaatgaataaatgggttcaatatttctgtacttcttctacatatattaaatccagtatttgttatgctttagctgataatattgaaggtccatacacttataaggattgcttcatcttctctggtatggattcaggtagtgttggtaaaacaaatattagagctattactggtagtgataacggtaatcgctatttcccaggtaacaaatacaataataaggtctatccaaatgccattgatccaaatgcattctacgatttcaatggtaaattatggttggcttatggttcatggtctggtggtatctatatcttagaattagatgaaagtactggtcttccaaaacataacatcaataatggaaataacatagataaatactatggtaagaagttagctggtggtaatcatcaatctattgaaggcccatacattttaccacataaagctgctggatattactatcttttcgtttcctatggtactcttacatctaacggtggttaccaaattcgtttattccgttcaaagaacccagatggtccatatactgatgctgctggtagagaatttatgagtggtactaattccaactttggtgtcaagattatgggtaattacaatattccaggaagaagccaagcttacatggctccaggtcacaattctgctttaattgatgacaatggaaaaatcttactcttctatcacactcgtttcaatgatggtcaagaatatcacgagccacgtattcatcaaatgttccttaacaaggaaggatggcttgttgctgctcc

SEQ ID NO: 25011 - DNA, 909 bp, Piromyces finnis; identical to SEQ ID NO: 14708
  Glyco_hydro_beta-prop

SEQ ID NO: 25012 - DNA, 918 bp, Piromyces finnis
  Glyco_hydro_beta-prop
acttaccaatcacaacccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtactggttacctttacttcggtggtggtgttccagaaggtcaagctagtgacccaagaaccactcgtgctgctaagttaggtgatgatatgattagtattgatggtattccacaaaccattgaagctccatgggtctttgaagactctggtattaacaaggttggtgactcttacgtctactcttactgtgtcaactgggataacggaccatacggtaatgctaagattgcttacatgactagtgaaaatccattaggtccattcaccttccaaggtactcttcttaacaacccaggtgatttcttcggaactaccggtaacaaccaccacactattattgaattcaagggtaagtggtacatcttctaccacgctgaatggctcaatgtccaagtctacggaagtcaaaagggttaccgtaccactcacgttgatgaacttccattctt

SEQ ID NO: 25013 - DNA, 909 bp, Piromyces finnis; identical to SEQ ID NO: 14710
  Glyco_hydro_beta-prop

SEQ ID NO: 25014 - DNA, 915 bp, Piromyces finnis; identical to SEQ ID NO: 14711
  Glyco_hydro_beta-prop

SEQ ID NO: 25015 - DNA, 909 bp, Piromyces finnis; identical to SEQ ID NO: 14708
  Glyco_hydro_beta-prop

SEQ ID NO: 25016 - DNA, 918 bp, Piromyces finnis; identical to SEQ ID NO: 25012
  Glyco_hydro_beta-prop

SEQ ID NO: 25017 - DNA, 915 bp, Piromyces finnis; identical to SEQ ID NO: 14714
  Glyco_hydro_beta-prop

SEQ ID NO: 25018 - DNA, 912 bp, Piromyces finnis
  Glyco_hydro_beta-prop
acttaccaatcacaacccattaatgacttatagatacggtgctgacccaggtgtttttgtatacgatggtagagtttatgtcttcactacaaatgatggtgatgttgaccttactaacaaaaatattgcagaaaacacttattcacacattcaaacccttaatcttatttcttctgctgatttagttaattggaccgaccacggttctattagtgttgcaggtaataatggtgctgctaaatgggctcaatattcatgggctccatgcgctacctacaaaaagattaatggtaaagataaattcttcctttacttcgctaataatgctaatggtattggtgttttaactagtgattctccaactggtccatggaaggatccaattggtaaggcacttattactcgtcaaactccaaactgtaatgtcgaatggttattcgatccagctgtatttgttgatgatgatggtaaaggttatctttactttggtggtggtgttccaactggtcaagatgctaatccaaagactattcgtgtcgttcaattaggagatgatatgactagtattgttggtaccccacaattaattgatgctccatacgttttcgaagattctggtattaataagatcggtaacacttatatttattcttactgtactaattgggctaatggtccatatggtagtgctaatattgcatacatgacaagtagcagtccaatgggtccattcaaaatgcaaaaatcatgtttcaagaatccaggtgaatactttggtaactatggtaacaaccatcacactatgattgaattcaagggtaaaaactacattttctaccacactgaatggcttaataaggaagttttcggtactcaaaagggttatcgtacttctcatgttgatgaaatgcc

SEQ ID NO: 25019 - DNA, 918 bp, Piromyces finnis; identical to SEQ ID NO: 14716
  Glyco_hydro_beta-prop

SEQ ID NO: 25020 - DNA, 915 bp, Piromyces finnis; identical to SEQ ID NO: 14711
  Glyco_hydro_beta-prop

SEQ ID NO: 25021 - DNA, 915 bp, Piromyces finnis; identical to SEQ ID NO: 14718
  Glyco_hydro_beta-prop

SEQ ID NO: 25022 - DNA, 915 bp, Piromyces finnis; identical to SEQ ID NO: 14714
  Glyco_hydro_beta-prop

SEQ ID NO: 25023 - DNA, 918 bp, Piromyces finnis; identical to SEQ ID NO: 14716
  Glyco_hydro_beta-prop

SEQ ID NO: 25024 - DNA, 666 bp, Neocallimastix californiae
  Glyco_hydro_catalytic_dom
taaaaaaattttagttgctatttggaaacaaattgctgctgaatttgctgactatgatgaacatttaattttcgaaggtatgaatgaaccaagaaaggttggtgatccagccgaatggaatggtggtgattatgaaggatggaatttcgttaatgaaatgaatgatcttttcgttaaaactattcgttctactggtggtaacaatgctttacgtcatcttatgattccaacctacgctgcttgtattaatgatggtgctattaataacttcaaatttccaagaggtgatgataaagttattgtttctcttcactcatacagtccatataactttgccttaaataatggagctggtgcagttagtaatttctacgatggtagtgaaattgattgggctatgaatactattaattctaatttcattagcaagggtattcctgttattattggtgaatttggtgccatgaatcgaaacaatgaaaatgaccgtgaaagatgggcagaatattatattaagaaggctacatctatcggtgttccatgtgttatatgggataatggttactttgaaggagaaggtgaacgttttggtcttattaatcgttctactttacaagttgttttcccaaaacttattaatggtttaattaaaggtttaggtaattc

SEQ ID NO: 25025 - DNA, 915 bp, Neocallimastix californiae
  Glyco_hydro_catalytic_dom
atatactggggttaatgaatctggtgctgaatttggtcaaggtgaatacccaggtacttacaataagcattacatttacccagatgttaaagctattcaagcttccattgatcaaggtatgaatattttccgtgttggctttgcatgggaacgtttacaaagaagcttaaatgctgaatttgatgccactgaatttggtcgtttagatgaagttattaactatatcactagtaatggtgctgtagccattattaatccacataactttgctagatataagaacgctgttattggtacaagtcaagtcccaaattctgctttctctaacttatggaagagattagctcaaaaatacaagaacaatcaaaaagtttggtttggtttagtaaatgaaccacatgatatgccaacagctcaatggttcgctgctgcacgtgatgctgttgataccattcgtgctacaggtgctaacaataatgttcttgttcctggtaatgcatacactggtgcatggaactggaaagaaactttttatggtgaatctaatgcttccgttgctcttagatacttcagctcagctgataagaatataattttcgaaactcaccaatatttcgattctgattattctggtactcatgaacaatgtgttcaacgtccatgtaacaaactcttcgttaatttcgttgaatggttaaaagctaacaatttaaagggtttcattggtgaatttggtgctgccattaacagggactgcaaagcttgtgttgaagaagctattaactacttagaacaaaactctgctaatattgttggctgggcctggtgggctgctggtccatggtggggtaattatatgtactcccttgaaccaaaaggtaacaagttcccagaacaaatgacttggttaaagcc

SEQ ID NO: 25026 - DNA, 381 bp, Neocallimastix californiae
  Glyco_hydro_catalytic_dom
agctaatgctgatgtttccttaagatacttctcttctgaagatgaaaatattctctttgaagttcaccaatatttcgatactgattactctggttctcatgatacctgtgtccaacgtccatgtcaaaacaacctcaaagaatttgttgaatggcttaagactaacaacttaaagggatgggttggtgaaattggtggacttgctaatgatgaatgtaaggaatgtattgaagaagttcttgaatatctccaagaaaacagagatgttattaagggagtccaatggtgggccgctggtccatggtggggacataatgctttatctattgaaccaaatgccgaaaaggccttcccaggacaaatggcatggttaaaaccata

SEQ ID NO: 25027 - DNA, 646 bp, Neocallimastix californiae
  Glyco_hydro_catalytic_dom
aggttacctttctactaagggtcacaatattgttgattcaaagggtcgtaaggttcaattatctggtctttcatggttcggtggtgaaactactaacctttccccacacggtttatggaccaattctttagctaactttattaagattgtcaaggataatggttacaaccatcttcgttacccatggactaatgaaatgttctttgaaggtgctaagactcaatctattgatcaaatgaacaatccagatcttgttgatctttctccattagaagttatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggagctgatcttcacaatgaaccacacggtaaggcttgctggggttgtggtgaagaagaacgtgattggagacttgcagctgaaagatgtggtaatgctattcatgaagttaatccagactggcttattattgttgaaggtaatgatcactatggtgaagaaggatggcaaaagggagaatcctactggtgg

SEQ ID NO: 25028 - DNA, 1035 bp, Neocallimastix californiae
  Glyco_hydro_catalytic_dom
aggtttcctctctactaagggacacaacattgttgattctaagggacgtaaggttcaattatctggtctttcttggttcggtggtgaaaccactaacctttccccacacggtttatgggctaactctttagctaacttcattaagattgttaaggataatggttacaatcatcttcgttacccatggaccaatgaaatgttctttgaaggtgctaagactcaatcagttgatcaagttaacaacccagatcttgctgatctctctcctttagaaattatggatgccgttattaatgaatgtggtaaggctggtcttaaggtttatcttgatcgtcacagaccactttctggtggacaaagtgaattatggtatgttgatgaagttgatgaagctaaatggattgaagactggcaattccttgctaagcgttacaagggtaatccaaccgttattggtgctgatcttcacaatgaaccacacggtaaggcctgctggggttgtggtgaagaagaacgtgattggagacttgcagctgaaagatgtggtaatgctattcatgaagttaatccagactggcttattattgttgaaggtaatgatcactatggtgaagaaggatggcaaaagggagaatcctactggtggggaggtatgttaaagggagttaaagaattcccagttagattaaatactccaaacaagcttgtctattctgctcacgattatgataagaatgtccatatgcaagattggttcaaagaagccgatttcccagataacatgccaccaatttgggatgataaatggggatacattgttaaggaagatattgcaccagttcttattggtgaattcggttcactcttaagagatgccacagatgttaaatggttaagtaacttaattgactatatgaaagaaaatgaagttcactggactttctggtgtttaaatccaaactctggtgataccgaaggtattcttggatatgattggaagacagttaatactaagaaggatggtattttaactcc

SEQ ID NO: 25029 - DNA, 924 bp, Neocallimastix californiae
  Glyco_hydro_catalytic_dom
tttagttaatccaaaggctattcctgctgctaaaaaactttatgatttcttaaaatcaaattatggtaaaagaattctttctggtcaagtcggtgctgccggtcaagctggtgatgaaggtgaagaatttaaacgtattatgaatgctactggtaaaaagccagcagtttggaatatggatttcatttttgaatctaatgattgtacttggagaccaactaatcctgatattactgaaatggcaattaattggtggaagaaatatcaaggtaaaggaattatgtctgctcaatggcattggaatattgctggtagaactggtaactttgctttctacaaaaaagataccactttcgatcttgaaaaagcagtcaccgaaggtacttgggaatatgaaaaaattattaaagatattgatcgtgtttctggtttaattaagaaattacaagctattaatatgccattaatctggcgtcctcttcatgaaaataatggtgactggttctggtggggtaataatccaaaagcttgtgctaaattatggaaaatcttatatgaacgtatggttaactatcatggattaaataatttaatttggctttggaatggtaataatgatgaatatactccaattgaatacattgatattattggtgttgatatctatgctaatgatcatggaccacaaactacagcatacaatactcactttgatttttatggaggtaaaaagatggttgttttatcagaaaatggacgtattccagatattcaacaatgtgttgaccaaggtgcttggtggggttatttccaaacctggaacaatgaatttattttacaaaatcattatcatactgatgctcaacttaaagaatatttcaatcataaaattgttatgaatatggatgaattaccatcattcaa

SEQ ID NO: 25030 - DNA, 699 bp, Neocallimastix californiae
  Glyco_hydro_catalytic_dom
tgatattactgaaatggcaattaattggtggaagaaatatcaaggtaaaggaattatgtctgctcaatggcattggaatattgctggtaaaactggtaattttgctttttacaaaaaagataccactttcgatcttgaaaaagcagtcaccgaaggtacttgggaatataaaaaaattattaaagatattgatcgtgtttctggttttattaagaaattacaagctattaatatgccattaatctggcgtcctcttcatgaaaataatggagattggttctggtggggtaataatccaaaagcttgtgctaaattatggaaaatcttatatgaacgtatggttaactatcatggattaaataatttaatttggctttggaatggtaataatgatgaatatactccaattgaatacattgatattattggtgttgatatctatgctaatgatcatggaccacaaactacagcatacaatactcactttgatttttatggaggtaaaaagatggttgttttatcagaaaatggacgtattccagatattcaacaatgtgttgaccaaggtgcttggtggggttatttccaaacttggaatagtgaattcattttacaaaattcatatcatactgatgctcaacttaaagaatactttaatcataaaattgttatgaatatggatgaattaccatcattcaa

SEQ ID NO: 25031 - DNA, 1077 bp, Neocallimastix californiae
  Glyco_hydro_catalytic_dom
cagtttacttagtttagccgttattggctcaaaggctatgaaaaacatttcatctaaggaattagttaaggatttgactattggttggagtttaggtaatactttagatgccacttgttttgaaactttagattataataaaaatccaattgcttcagaaacttgttggggtaatgttaaaactactcaagaactttactataaattaagtgatcttggttttaatactttccgtattccaactacttggagtggtcattttggagatgctccagactacaaaattaatgatcaatggatgaaaagagttcgtgaaattgttgattatgctcttaatactggtggttatgccattttaaatattcatcatgaaacttggaatcatgctttccaaaaaaatttagacagtgctaagaaaattttagttgctatttggaaacaaattgcagctgaatttgcagactatgatgaacatttaattttcgaaggtatgaacgaaccaagaaaggttggtgatgcaaatgaatggaatggtggtgattatgaaggatggagcttcgttaatgaaatgaatgatcttttcgttaaaactattcgtgctactggtggtaacaatgctttacgtcatcttatgattccaacttacgctgcttgtgttatggataatgctgtgaataacttcaaatttccaagtggtgatgataaagttattgtttctcttcactcatacagtccatataactttgccttaaataatggagctggtgcaattagtaatttcaacgatggcagtgaaattgattgggttatgaatattatcaactctaacttcattagcaaaggtattcctgttattattggtgaatttggtgccatgaatcgaaacaatgaagatgaccgtgaaagatgggctgaatattatattaagaaggctacatctcttggtattccatgtgttatatgggataatggttactttgaaggagaaggtgaacgttttggtcttattaatcgttctactttacaagttgtttacccaaaattagttaatggtttaattaaaggtttaggcaattc

SEQ ID NO: 25032 - DNA, 120 bp, Neocallimastix californiae
  Glyco_hydro_catalytic_dom
tatatgggataatggttactttgaaggagaaggtgaacgttttggtcttattaatcgttctactttacaagttgtttacccaaaattagttaatggtttaattaaaggtttaggcaattc

SEQ ID NO: 25033 - DNA, 1032 bp, Neocallimastix californiae
  Glyco_hydro_catalytic_dom
tggttatctttcaactaaaggtagacacattgttgacgaaaagggtcgtaaggttagattagctggtatctcatggtttggaggtgaaactactaatctttctccccatggattatgggctaagccattagaccatttcattaaagtaataaaggatcatggttacaaccatattcgttatccatggactaatgagatgctcttcccaggtgctaaaactgaatctattaatgctatggaaaatcctgatcttgttgatcttaccccattagaagttatggacgctgttattgatgcctgtggtaaggctggtttaaaagtttatcttgatcgtcacagaccactttctggtggtcaaagtgaattatggtatatttctaaggttgatgaaaagaaatggattgaagactggcaattcctagccaaacgttacaagggtaatccaactgttattggtgctgatcttcacaatgaaccacatggtactgcctgttggggttgtggtgaaactcaacgtgattggagacttgctgctgaaagatgtggtaatgctattcatgaagttaaccctgattggcttattattgtagaaggtaatgatcattatggtgaagaaggttggcaaaaaggtgaaggctactggtggggtggtatgttgaagggtgttaaagaaaatcctgtcagattaaagaaaccaaacaagcttgtttattctgctcacgattatgataagaatgttcacatgcaagattggttcaaagtttcttctttcccagataacatgcctgaaatttgggatgataaatggggttacattgtgaaagaagatatagctcctgttcttattggtgaatttggttcacttttaagagataaaactgatgttaaatggttacaaaatttaatttcttacatgaataaaaataccgttcactggactttctggtgcttaaatccaaattctggtgatactgaaggtattcttggttatgattgggaaactgttaacactcaaaaggatggaattcttga

SEQ ID NO: 25034 - DNA, 156 bp, Neocallimastix californiae
  Glyco_hydro_catalytic_dom
ctacatggaaaaggttactgctatgggagttccacaaatctggtgggataatggtgtcttcgaaggtactggtgaacgttttggtcttcttgatcgtaagaacttaaagattgtttatccaactattgttgctgctttacaaaagggtagaggttt

SEQ ID NO: 25035 - DNA, 429 bp, Neocallimastix californiae
  Glyco_hydro_catalytic_dom
tgcttgtaatgaaaactcattcaacaactttatcttcccagaagatgatgataaggttattgcttctgttcatgcctatgctccatacaactttgccttaaataatggtgaaggagctgttgataagtttgatgcagctggtaagagagatcttgaatggaacattaatttaatgaagaagagatttgttgatcaaggtattccaatgattcttggtgaatatggtgctatgaaccgtgacaatgaagaagatcgtgctacttgggctgaattctacatggaaaaggttactgctatgggagttccacaaatctggtgggataatggtgtcttcgaaggtactggtgaacgttttggtcttcttgatcgtaagaacttaaagattgtttatccaactattgttgctgctttacaaaagggtagaggttt

SEQ ID NO: 25036 - DNA, 924 bp, Neocallimastix californiae
  Glyco_hydro_catalytic_dom
aaattactctaagggtttcagaattggtgctgctactaacaccattcattacaacaacgctaactatgttaatgctatgaaagcattcaactatatggttgctgaaaatgcttgtaagttcgttagtattcaaggtactaagggtagattcaatttcaatgattgtgatgcccactacaacaaagcaaaggaattaggtatggactttagaggtcacgctttaatttggcacagtatggctccaaagtggcttgaatacgaagattctaatactatgagaaattccatagttaatcacattacaactgtcttaaagcactacgaaggtaaaattgatacttgggatgttgttaatgaagctattgatgatgattccaatggtaatggttggaagtatcgtaattcattcctttaccaaaagaacagagatttcattgatcttgctttcaagactgctcgtcaagtagctccaaaggttaaacttttctacaacgattataatactgaaggtatttggggtaagagtgaatctgtttaccaatttgttgctgatttaaagaaacgtaatattccaattgatggtgttggtcttcaataccatgtcagtgttcaaaatcaaccacaattcaacaaaattaacgatttaattggtcgttactgtaagttaggccttgaagttcacattactgaattagatgtcagttgtgttaattcttgtaatgctggagatgttgaaagcagacaatcccaagttttcactaatgctttaaaggcttgtcttaacaactcctgttgtactgctttccttgtctggggtattggtgatccagacagttggttaggtaatgataagaagggtttacttttcaatggtaattaccaaccaaaatctcaatacaatgctctcttaaacgtcttaaagac

SEQ ID NO: 25037 - DNA, 963 bp, Neocallimastix californiae
  Glyco_hydro_catalytic_dom
tcaacaagttagacctgatttctactttggtgtttctacagcctctcatttctttgctaacccaaagtacaatgatattatttctacttacaacttacaagttgctggtaatgaatgtaaattctatacttttaacggttctcaaactttcaacacaaagccatgtgatgacactgttgctttcgctaagaagtatggagctaagttccgtggtcacaatcttttctggccagcttactctccacaatggttccaagatgctcatgatggtagtgacccagaagctgtaaaagaatacattcttgactatgttgctaaggttttagatcattacaaggatgaagaagatattatttactgggatgttattaatgaatctgttactgacgattctactgctaagaacatcaagttacgtactggttctgataacagtaatgaattcgaaggttgggatacttacacagaagatattttcaaggttgctcgtgaacacaccaacgaaaatgtaaagttattctataacgattacaatgccgaagcaaacaatggaaactttgatggaaaaactggtgctgttttcgaatacatcagatctatgagagaaaagggtgtcccaattgatggtgtcggcttacaaatgcacgtttcctgtaattggactccaaattatgaacaacttacaaagttaatttctcaatatgaagaaattggcgttgaagttcatattactgaaattgatgttaaaagaactcaatgtaaatctgctgaagctcaaaaagaagttttcatgaacgtcttcaaagcttgtttcgatcatgaaaactgtaaggtcttcactgtttggggttcctacgatgaagaatcctgggttggtgttgaaaatgaaccagttctttttgatgttgatatgtatccaaaggacatttactttgatatgttggactacgttttagaaaaatt

SEQ ID NO: 25038 - DNA, 178 bp, Neocallimastix californiae
  Glyco_hydro_catalytic_dom
taccccatctccaatccgtgatatttcatcaaaggaattaattaaggaaatgaatttcggttggaatttaggtaatactatggatgctcaatgtattgaatacttaaattatgaaaaggatcaaactgcttcagaaacttgctggggtaatccaaagactactgaagatatgttcaag

SEQ ID NO: 25039 - DNA, 927 bp, Neocallimastix californiae
  Glyco_hydro_catalytic_dom
ttattctaatggttttagaattggtgctgccaccaacactagattctacaacaatggtaactacgttaatgccatgaaggctttcaactatatggttgctgaaaatgcttgtaagtttgttagtattcaaggtacaaagggtaaattcaacttcaatgactgtgataatcacctcaagaaagctaaggaattaggtatggacttcagaggtcacgcccttgtttggcactctatggctccagattggcttaaaaatgaagattcaaaaactatgagacaatccatcgttaaccacattactaaggtcttacaacactatgacggtaagattgatacctgggatgttgttaatgaagctattgatgatgattccaatggtaatggctggaaataccgtaactccttcctttaccaaaagaacagagatttcattgatcttgctttcaagaccgctcgtcaagttgctccaaaggttaaacttttctacaacgactacaacaccgaaggtatttggggcaagagtgaatctgtctaccaatttattgctgacttaaagaagcgtaacattccaattgatggggtcggtattcaataccacgtcagtgtcaagaaccaaccccaattaaacaaaattactgacttaattggccgttactgtaagttaggccttgaggttcacattaccgaaattgatgtcagttgtgaaggtgcctgtaacaacggtgatgttcaaaaccgtcaagctcaagtcttcacaaatgccttaaaggcttgtcttgccaactcctgctgtaccgcttatcttgtttggggtattggggataatgacagttggttaggtgctgataagaagggtttacttttcgatggtagttacaagccaaaagctcaatacactgccctcttaaacaccttaaagacaacaaa

SEQ ID NO: 25040 - DNA, 1050 bp, Neocallimastix californiae
  Glyco_hydro_catalytic_dom
aaaagctgcaccattccgtatgggtgttggtttaaatggttcagataaaagtacttctactgttttatctaagaaaatgcgtgaaatcattgcttatcaattcaattcagtcacttattcaaatcttatgaaggctgaaaatattttagataaagccgcttcccaagctaatgcaaaaaaaggtgatgatatgccagttttaaaatttgatacaattgttgatggtttagaattctgtaaagaaaataacattaaaatgagaggtcacactttagtatggcatgttcaaactccagaatggttcttccgtactgactttagtgatagtggttcatatgtcaatgcagccaagatggaaaagcgtatggaaagttatattaaacaaatgttagaattcgttcaatattattatccaggtattgttgatgtttgggatgttgttaatgaagctgttgaaattgaaggtggtagttatgatgcctcaactggttggaatactcgtactagatataatggtagtccaaatccatggtatactactatgggcgctgactatgttattaaggctttccgtattgctcgtaaatatgctgacaaaaatgttaaacttatttacaatgattacaacacttttatgtcacaaaagactactgctatttgtaatcttattaaaaaattaaaggctgaaaacttagttgatggcgttggtcttcaatcttacttaaatgccgactggccaaatcgtaatgactataagactgctattcaaaagtttgctgctcttggtgttgaagttcaagctacagaattaactattagaactgatggtactgcaaataaatataatactcaagctaaacattatgaagaagttttcaagatttacaaagatttgaagaagagtggtgtcaatattactagtgttacagtctttggcttacaagatggttatttattttataataatgattcaactgatacacgtttatgggaccataatcttaagaaaaaaccagtttacaattctattatgaaagtattatcttcaaa

SEQ ID NO: 25041 - DNA, 1012 bp, Neocallimastix californiae
  Glyco_hydro_catalytic_dom
taccaataagagttcttctccagtcttctctaagaaaatgcgtgaaattattaaatatcaatttaattctgtaactttcactaatcttatgaaagctgaatttatgttagataaaagtgcttctcaagccaacgctagaaatggtaatgatatgccagttttaaagtttgatacaattgttgatggtttagaattctgtaaggaaaataatattaagatgagaggtcacactttagtttggcacactcaagctccagaatggttcttccgtactggatttaatgataacggtagttatgttgataagaacaaaatggaaaaacgtatggaaagttacattaaacaaatgttagaatttattcaatattactatccaggtgtcattgatgtatgggatgttgttaatgaagctgttgaaattgctaacggtagttatgatgcttcatccggatggaatactcgtactaagtttgataacaacaagactaatccatggtatgcaactatgggtcctgactatgtatttaaggctttccgttttgctcgtaaatatgctgataagaatgtcaagcttatttacaacgattttaatacattccaatatccaaaaactgataatatctgtaaccttgttaagaaattaaaggctgaaaacttaattgatggtgttggtctccaatcttacttaggtccaagttggccaaatcgtaacgattacaagaacgctattcaaaagttcggtgctcttggtgttgaagttcaaattactgaattaactattagtgttgaaaatggtaataacaaattcactacccaagctaatcaatatagagatgttttcaagatctataaggacttaaagaaaagtggtgttaacatcactagtgttactgtcttcggtttacaagatcattacttattctatgataatgataatactgaaactcgtttatgggatggtaatcttaagaagaagccagtatacaatgctattatgaatgtattaaaaaat

SEQ ID NO: 25042 - DNA, 1059 bp, Neocallimastix californiae
  Glyco_hydro_catalytic_dom
ttttgttcaaacggatggaactaattttgtagtggatggttgtaaacgttatttctctggttctaatacctactatttgatggtatcaagtcatgaaagagtggatttagctcttgaagcttatgctagacataatctcaatgttgttagagcttgggctttctgtgatgaatgtgaagacgccacaagattagtcgatttctctggtccagaagttaagcttaactccttaaatatggaaaaggttgattattatcttgcagctgctgctcaaagaaatattcgtgtggttttaactcttactaacaattggactgattatggtggtatggatgtttgggtcaaaaagttcggtggaaaatatcatgatgaattttataccaacagaaaaattattgaaggttataaacaatatattaaagctatgattaaccgtgttaacacatacaccggtcaattatataaggatgatccaactattttctcatggcaacttgctaatgaagctcgttgtaacaatggtccacatggtcttccagttaaaaattgtaatacggatactattacaaagtggatggatgaaatcgctacttttatccataaagaagatccaaatcatttagtttcttctggtattgaaggtattggtcttactccaccagctggtgttgatccatatacttatgtatacacttatactgaaggtactgattatgaagctatcagtgctcttgattctattgattataatactgttcatatgtatccagttggttggggattaaaagattatgccaaagatggtgttacttggattcaagctcatgctgatgtcgataaaaaatttaacaaaccaacagttgttgaagaatggggtctcagtacttcagttgataatgttccaattaaagagcgtgatccaatttatactcaatggatgaatgcagttttagctaatgataatattggaatgaatatgttctggtatgtctgtggtgaagattattatggaacagatggctacttattagaagatgatgaaatcactgctgttatcga

SEQ ID NO: 25043 - DNA, 921 bp, Neocallimastix californiae
  Glyco_hydro_catalytic_dom
cgccaagggtttcagaattggtgctgctacaaacactattcactataataatccaaattatattaatgctatgaaggctttcaattatatggttgctgaaaatgcttgtaaatttgtaagtattcaatacactaaaggtaaatttaactttgacgattgtgataatcacttaaagaaagctaaggaattaggtatggctttcagaggtcatgctttaatatggcatgctatggctccaggttggcttgaacgtgaagatggaaatactatgaaacaatctattattaatcatattaccactgtattaaagcattatgaaggtaaaattgatacttgggatgtcgttaatgaagctcttgatgatagttctaatggtaatggttggaaacttcgtaattctttcctttatcaaaaggttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaaattcgaaaaaattaacaatttaattagtcgttactgtaaattaggtgttgaagttcacatcactgaattagatgtcagttgcgatgacaactgtcgtgacgcagacggtggtgagagcaagcaaggacaagtttacactaatgccctaaaggcttgtcttaataattcttgttgtactggtttccttgtttggggtattggtgataaggatagttggagaggtgttgaaagtaaaccattacttttcgatgctaactaccaaccaaagggtcaatacactgctatattaaacactttaaagtc

SEQ ID NO: 25044 - DNA, 696 bp, Neocallimastix californiae
  Glyco_hydro_catalytic_dom
tgctatggctccaggttggcttgaacgtgaagatggaaatactatgaaacaatctattattaatcatattaccactgtattaaagcattatgaaggtaaaattgatacttgggatgtcgttaatgaagctattgatgatggttctaatggtaatggttggaaacttcgtaattctttcctttatcaaaaagttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaagttcgaaaaaattaatgatttaattagtcgttactgtaaactaggtgttgaagttcatatcactgaattagatgtcagttgtgatgacaactgtcgtgatgcagacggtggtgacagtaagcaaggacaagtttacactaatgccctaaaggcttgtcttaataattcttgttgtactggtttccttgtttggggtattggtgataatgatagttggagaggtgccgaaaacaagccattacttttcaatactaattatcaaccaaagggtcaatataccgctgtcttaaacacattgaaatc

SEQ ID NO: 25045 - DNA, 927 bp, Neocallimastix californiae; identical to SEQ ID NO: 13684
  Glyco_hydro_catalytic_dom

SEQ ID NO: 25046 - DNA, 876 bp, Neocallimastix californiae
  Glyco_hydro_catalytic_dom
aattaccatcaatggtaagagacttcttatcaagggtgtcaatcgtcatgattcagatccattcaatggaagggctgttccacaacaaacattacgtgaagatattgctctcatgaaaaagcataatattaatgccataagaacttctcattacagtaatgactcctacctctactggctctgcaataaatatggtatgtatgtcatgggtgaaaccaatttggaatctcatgctttacagaataaccatgacgcaaaagccaaattctatgaacttggaatggacagaacagaaactgcctataagcgtttgaaaaataatccatcaatctttgcatggtctattggaaatgaaatggcctacaccaataatccaaatgatgcaggaggtcttttccgtgatatgatctggtatttcaaaaagaacgattccagtcgtccagtacatagtgaaggacaaggtagtagtatgggtgttgatatgtctagtaatatgtatcctggttctgatggactcggtgttcatgctggtcgaggaaagatgccttacatcatgtgtgaatatgatattgcttcaggtaatgctataggtgctttaaaagaatattgggatgtgataagaagtgctgataatatgttagggggttttatttgggattgggttgatcaatccagagcaaaaactctcaacggcggatgggattactactctcaatcttatgccataactaatctttattctgaagaaattaaaggtaaattctatgcttatggtggtgattggggtgattggccaaatgataatagtttctgtgtcaatggtcttatcaatccagatagaactcctcaaccagaacttgccgaagtcaaattcca

SEQ ID NO: 25047 - DNA, 609 bp, Neocallimastix californiae
  Glyco_hydro_catalytic_dom
ctggccatacaaatggccaggtatgcaaagttggttaaatcaagttaaatctttcattgatgataagaagaaatctggtttaaccaactggtatggtttagaaatctggaatgaaccagatggtacttgggataatgccaatggaagtttcaacgatatgtggaaaaagacttatgaccttattcgtcaagctgatccaggagaaaaaattattggtccatgtttcagttggtatgaagaaaacaaaatgaagaacttcttacaatactgtaaacaaaacaactgtattccagatattattagttggcatgaattaagtggtattgaaggtgtttcaagccacttaagaggttaccgtaacttagaacgttctcttggtatcaaggaacttccaattagtattaacgaatactgtgatgccgaacatgaattagaaggtcaaccaggttccagtgctcgtttcattggtaagttcgaacgttacaaggttgatagtgctatgattacttggtggttcgttccacacccaggtcgtttaggtagtttaatggctactgacactcaaaagggtgctggttggtacttctacaaatggtatggtgatatgac

SEQ ID NO: 25048 - DNA, 924 bp, Neocallimastix californiae
  Glyco_hydro_catalytic_dom
tgcaaacggcttcagaattggtgctgctgctaacacaatgtactttaacaaccaaagttatatcaatgccttaaagtctttcaactatatggttgctgaaaatggttgtaagctttcaggtattcaacaacaaaaaggtgtttacaatttcaatgattgcgataatcacttaaagaaggctcaagaattaggtatggatttccgtggtcactgtcttatctggcacgcttaccaaccatcttggttcgaaaatgctgatgctaatactttaaagaacgctattgttgatcatattactaagactttacaacattatgaaggaaagattgatacttgggatgttgttaatgaagctattgatgatagttctaatggtaatggttggaaaatgcgtaactccttcctttatcaaaaggttccaaactttattgatttagctttccaaactgcacgtaaggtttctccaaacactaaacttttctacaatgattacaatactgaaggtatttatggaaaatctgaatctgtttaccaattcgttaaagatttagtttcacgtaatattccaattgatggtgttggtattcaatatcacgtttctgtccaaagtcaaccacaatataacaagattaacgatttaatttctcgttactgtaaacttggacttgaagttcacattactgaacttgatgttaaatgtgataatcaatgttatagtggtaatgttgaacaacaacaagctacagtctttactaatgccttaaaggcttgtcttagtaactcttgttgtactggttaccttgtttggggtgttggtgacaacaattcatggttaggtagtgataagaagggtttacttttcgacggtaactacagaccaaaatctcaatacactgctgtccttaacatgttaaaggaattagc

SEQ ID NO: 25049 - DNA, 180 bp, Neocallimastix californiae
  Glyco_hydro_catalytic_dom
tacaccatctccaatccgtgatatttcatctaaggaattaattaaggaaatgaatttcggttggaatttaggtaatactatggatgctcaatgtattgaatacttaaattatgaaaaggatcaaactgcttccgaaacttgttggggtaatccaaagactactgaagatatgttcaaggt

SEQ ID NO: 25050 - DNA, 489 bp, Neocallimastix californiae
  Glyco_hydro_catalytic_dom
ggttgccagacgtttatctaaaactccaggagctctcgtttctgttgatttagctgatattttaccatattggccataccaatggccaggtttggataaatggcttgatgctgttagatcatttattcgtgacaaaaaagcttctggtttaaaaaattggtatggttatgaaatttggaatgaagctgaaaatacttggagagattctaacggtttatcgttctttgaaatgtggaaggaaacctatagagttattcgtgaaatggatccagatgaaaaaattattggtccatgtgatggtttatacagtgaacaaagaatgcgtccattcttagaatactgtttaaagaatgatgttatgccagatattatgtgttggcacgaattgatgggtattgaattaattccaggaagatataaggcttatcgtaaattagaaaaatctcttggaattaaggaacttccaattaccattaatgaatattgtga

SEQ ID NO: 25051 - DNA, 330 bp, Neocallimastix californiae
  Glyco_hydro_catalytic_dom
tatttttgaagttcatcaatatttcgatagtgattactctggtactcatgatacctgtgttcaacgtccatgtcaaaaccttcttaaagaatttgttgaatggctcaagaccaacaacttaaagggttggttaggagaaactagtagtactcttagtgaaggatgtaaggaatgtgttcaagaagttcttgaataccttgaagaaaacagagaacatgttttaggagttacatggtgggccgcaggaccatggtggggacacactgcctgtgccattgaaccaaatgaagaaaaggccttcccagaacagatggcatggttaaaaccata

SEQ ID NO: 25052 - DNA, 930 bp, Neocallimastix californiae
  Glyco_hydro_catalytic_dom
actccaatatttaggtaccaatgaagctggtggtgaatttggtgatgctgttttaccaggtgtctacaatgaacattatatttatccaaatattaatgctattgaagcttctattgaacaaggtatgaatgttttccgtatgggactcagatgggaacgtttccaacatgaattatttggtgatttaactgaatttgatttaactgaatataaaaagattgttgatgctactactgctaagggagcagttcttattattgatccacataactatgctcgttataacaataatgttattggatctgaagaagttccaattgaagctttcgcagacttctgggctaaattagccgaagttttcaaagacaatgaaaaagtatggtttgatttagttaatgaaccccatgatatggaaacagatgattggtttaaagctgcacgtgctgcagttgatgctattcgtactacaggagctaagaacaatattttaatttcaggtaatggttgggatggagcctggagttggggtaaggaagcatggtatggagaatctaatgcagatgttgctttaagatacttctcttctgaagatgaaaatattatttttgaagttcatcaatatttcgatagtgattactctggtactcatgatacctgtgttcaacgtccatgtcaaaaccttcttaaagaatttgttgaatggctcaagaccaacaacttaaagggttggttaggagaaactagtagtactcttagtgaaggatgcaaggaatgtgttcaagaagttcttgaataccttgaagaaaacagagaacatgttttaggagttacatggtgggccgcaggaccatggtggggacacactgcctgtgccattgaaccaaatgaagaaaaggccttcccagaacagatggcatggttaaagccata

SEQ ID NO: 25053 - DNA, 1053 bp, Neocallimastix californiae
  Glyco_hydro_catalytic_dom
acttacattatctgctgctagttcagctttagctttaactacccaacaagttataaaagaaatgggtcttggttggaatttaggtaatactttagaagctacaggtgattggattaatggtaataatgttaatgcttatgaaactgcttggggaaatccagctgctactaaggaattaattaatgcaattaaaaataatggtttcaatagtattcgtataccagtttcatggagtaatcttatgtcttctgattacactattagtgaagaattattaaagagagttaatgaagtagttagttgggttatcgaaaatgatatgtatgctattattaacattcactgggatggtggatggattgaaaaattcggaactaacgaatccacaatggctaatcaaaagttcgtcaaaatttggaatcaagtttcagattacttcaaaaattatggagaacatttaatttttgaatctttaaatgaagaaggttgttggaatgatgtctggaatcgttacagtaatgctggtgataagaacaaggcttatagtactttaaataacattaatcaacaatttgttgatattgttcgtaaatctggtggtaacaacaaaagtagacatttacttattgctggttattgtactgatattgatcttactgtcgattctgcattcaagatgccaactgattctgaaaaccgtatgatggtttctgttcattactacactccatctactttcactattcttgaaaaggatgaagattggggtaaattccaaggtacttggggtactgatgccgatgttaatgaacttattactaatttcgacaaacttaagaaacgttttgttgataatggtgttcctgttattattggtgaatatgctactgttttaactaacaaggacaaggcaagtgttcacaaatatttattcacttgtgctcaatacgctactagtttaggtatttgcccaatgctttgggataatggtgaatatttcgatcgtaagggtcttcaattcaaggactctgaaattggtgaattctacaaaca

SEQ ID NO: 25054 - DNA, 153 bp, Neocallimastix californiae
  Glyco_hydro_catalytic_dom
tcaatataaagctaaatatattattgataacaactttggtggtatgatgatttgggaattagaaaatgatactgatgatttcgaaattttaactgctataaatgataacttaggatgtaaggattctaacaaatcatctaacagttctcctaa

SEQ ID NO: 25055 - DNA, 750 bp, Neocallimastix californiae
  Glyco_hydro_catalytic_dom
cactttatgtttcgatacttctaagaagaatagctgtattgactccaaaataattgttggttatttcagtgaatggaaaaatgcgaactatcctattagtcgtgtagatttatcaaaaattacacatcttaattatgcatttggtgtaattgatccaaattcatatgctgtaactggatatgatagtaatattttaagtcaagttgtcactgctgcacacagtcaaggagtaaaagttcttatgtctgtaggtggatggtatggaagtcgttactttactcagatgacttcttcaaaaagtaacatagaaaagtttgttgacagttgtcaaagtcttatcagtaattatggtgttgatggtattgatattgattgggaatacccaggaagagaaggcgcatgtaatagcccagatatggcaaatgatgcagaaaattatttaactcttttaaagatcttacgtgaaaagatcggaaatgctctaatttctgctgctgtcagtgttataccgtttgaaaagaatggtcaaccaatttcagacctttctgaatatgaaaaatactttgattatattaatgttatggcatatgattttgctggtagttggacacctactgtttctcatcactctgctttatatgacccagaagctggtgaaaagttgtctctatcttcaggtgtaaagaattggttaagtcgtggttttccagctaataaaattgttgttggtgtaccagcttatggaaagag

SEQ ID NO: 25056 - DNA, 936 bp, Neocallimastix californiae
  Glyco_hydro_catalytic_dom
aaaattaaagtaccttggtgttaatgaagctggtggtgatttcggtgaaggtcatttaccaggagtttacaatactcattacacctatccaaacattgatgctattagtacttctatcgaacaaggtatgaatgctttccgtatgggtcttagatgggaacgtttccaacatgaattatttggtgaattaactgaatttgatcttaccgaatataagaagatcgtggatgctgttactgctatgggagctgttattattgttgatccacacaactatgctcgttacaaagataaacttattggttcagaggaagttccaactgaagcttttgttgatttctggaagaagatggctaatgttttcaaggataatgacaaagtatggtttggtttagttaatgaaccacatgatatgaaaacagatgactggtttaagattgctcgtgctgctgttgatggtattcgttccactggagctaataataccattttaattccaggtaatggatgggatggtgcatggagttggggttctcaagcttggtatggtgaatccaatgctgaagttgccttaagatacttctcttctgaagatgaaaatattgcttttgaagttcaccaatactttgattctgattactccggaggtcatggaacatgtgaaaaacgtccatgccaaaacaatgttaaagaatttgttcaatggcttaaggataataacttaaagggttggtttggagaattcagtggtcatatctctgatagtcaatgtaaggaatgtgtccaagaattccttgaataccttcaattaaacaatgaatatgttttaggagccacctggtgggcagcaggtccatggtggggacaaaacagttacaccattgaaccaaatgctaagaaagaattcccaggacaaatggcttggttaaagcctta

SEQ ID NO: 25057 - DNA, 198 bp, Neocallimastix californiae
  Glyco_hydro_catalytic_dom
agaattcagtggtcatatctctgatagtcaatgtaaggaatgtgtccaagaattccttgaataccttcaattaaacaatgaatatgttttaggagccacctggtgggcagcaggtccatggtggggacaaaacaattacaccattgaaccaaatgctaagaaagaattcccaggacaaatggcttggttaaagcctta

SEQ ID NO: 25058 - DNA, 1050 bp, Neocallimastix californiae
  Glyco_hydro_catalytic_dom
tactttagctactgctagttcagctttagcattaaccacccagcaagttgttaaagaaatgggtcttggttggaatttaggtaatactttggaatccacaggtgattggattaatggtagaaatgtaaatgcttatgaaactgcatggggtaatccagctgctactaaagatttaatcaaagcaattaaaaataatggtttcaatagtattcgtattcctgtttcttggagtaatcttatgtcatctgattacactattagtcaagaattattaaaaagagttaatgaagtagtcagttgggttattgatacaggtatgtatgctattattaacattcattgggatggtggatggattgaaaaattcggaaccaacgaatccacaatggctaatcaaaaattcaataaaatctggactcaagtatccgactatttcaaaaactatggagaacatttaatttttgaatcactgaatgaggaaggttgttggaatgatgtctggaaccgttacagtaactcaggtaataaaaacaaggcttatagtactttaaataatattaatcaacaattcgttgatattgttcgtaaatcaggcggtaacaacaaaaatagacatttacttattgctggttattgtactgatattgatttaactgttgattctgctttcaagatgccatctgattcagctaaccgtatgatggtttcagttcactactacactccatctacctttactattcttgaaaaggatgaagattggggtaaattccaaggaacatggggtactgatgctgaaattaaaactcttatggctgattttgacaaacttaagaagcgcttcgttgacaacggcgtaccagttattattggtgaatatgccacagttttgactaacaaggataaagctagtgtccataaatatttattcacttgtgctcaatacgctactagtttaggtatttgtccaatgctttgggataatggtgattactttgaccgtaaagctcttaaattcaaggattccgaaattggtgacttctacaaata

SEQ ID NO: 25059 - DNA, 420 bp, Neocallimastix californiae
  Glyco_hydro_catalytic_dom
atactggccatatcaatggcctggtatgcaaaaatggttagaactagttagacagttcattcgtgataaaaaggctgctggtattaaaaatttctatggttatgaaatttggaatgaagctgaaaacacctggagagattctaatggttatactttctttgaaatgtggaaagaaacctacaaggtcatccgtgaaatggatcccgatgaaaaaattattggtccatgtgatggtttgtacagtgaagaaagaatgcgtccatttttacaatattgtttagataatgatgtcatgccagatattatgtgttggcacgaattgatgggtgttgaattaattccacgaagatacaaagcttaccgtgaattagaagcttctcttggtattaaggaactcccaattactattaatgaatattg

SEQ ID NO: 25060 - DNA, 231 bp, Neocallimastix californiae
  Glyco_hydro_catalytic_dom
tattccaatgattcttagtgaatattgtgcaatgaaccgtgataatgaagaagatcgtgctacttgggccgaattctacatggaaaaggttacagctatgggagttccacaaatctggtgggataatggtatcttcgaaggtactggtgaacgttttggtcttcttgatcgtaagaacttaaagattgtttatccaactattattgctgctttacaaaaaggtagaggttt

SEQ ID NO: 25061 - DNA, 618 bp, Neocallimastix californiae
  Glyco_hydro_catalytic_dom
tttaccaggttggccatacaaatggccaggtattcaaacttggtttaatgaaattagatcctttattaatgataaaaagaagtcaggtttaactaacttttatggtaatgaaatttggaatgaaccagatgttacttggaaggattctaatggtttaagtttcaatcaaatgtggaaacaaacctacgatttacttcgtcaaattgatccaaatgaaaaaattattggtccaagtttcagttggtacgaagaaaataaaatgaaaaacttcttacaattcagtaaacaaaataattgtcttccagatattatcgcttggcatgaattaagtggtattgatggtgtctccagtcacttcagaagttatcgtaacttagaaaaatctatgggaatatctgaacgtccaatcactattaatgaatattgtgatgaaaatcatgatttagaaggtcaaccaggttctagtgctcgtttcattggtagattcgaacgttacaaggtcgatagtggtatgattacttggtggtttgttcctcacccaggtcgtttaggtagtttattagcatctgatactcaaaagggtgccggttggtacttctataaatggtatggtgatat

SEQ ID NO: 25062 - DNA, 1107 bp, Neocallimastix californiae
  Glyco_hydro_catalytic_dom
tttttataaaggtgttgatatctctagtattatttctttagaaaatagtggtgttcaattctacgatactaatggtcaacctcaagatatctttaaaacccttgcaagtgttggagtcaattgtattcgtgttagaatttggaattctccaagaagtactgatggaaaaacttatggaggaggaaataatgatcttgaagtagccagagaaataggtagtagagctgcgaaggctggacttccattatttgttgattttcattattcagatttctgggcagacccagccaaacaatctattccaaaagaatggaagggttttgatttaaataaaagaatttttgaaatttatagatttacaaaaggttgtttagaatggcttttagaaaatggatcatatatatctatggttcaaattggtaatgaaactacttgttttatgtgtggtgaaaatgaaatggtcaatgttatgaaaatgatgagtaatggtatccaagctgtacgtgatattaataaaaatatattaattgcacttcatttcaccaatcccaataaaacagataatatgttatggtatgcttctcaacttgctgaagcaaaagtagattatgatgttttctgtacttcctattatccattttggcatggaactactgaaaatttacaatggatattaggagaaattgctaataaatatggtaagaaagttatggttgctgaattttcatatccatatactgaagtagcaaagacatcagataattgtgaatacagtcatgttaatcataagttagaaggtaccgagtttaattatccattaacattagatggacaaattcaatgtataaaagatgtttatagtcacataaaaaatacaaagaatggtattggggccttctattgggaaccagcatggattgcacccaaagctagtaatgatttagaaagaagacaactttgggaaaaatatggttctagttgggctacaaaaactgcagctgagtatgatattaatgccgatagtagtcttaccggtgaatcagcatgggataatcaagcagtttttgatcaagaaggaaaacctttaaaatccatttgggcactagg

SEQ ID NO: 25063 - DNA, 919 bp, Neocallimastix californiae
  Glyco_hydro_catalytic_dom
aggttacctttctactaagggtcacaatattgttgattcaaagggtcgtaaggttcaattatctggtctatcatggttcggtggtgaaactactaacctttccccacacggtttatgggctaactctttagctaactttattaagattgtcaaggataatggttacaaccatcttcgttacccatggactaatgaaatgttctttgaaggtgctaagactcaatctgttgatcaagtgaacaatccagatcttgctgatctttctccattagaaattatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagaatccgatttcccagataacatgccaccaatttgggatgataaatggggatacattgttaaggaagatattgcaccagttcttattggtgaattcggttcactcttaagagatgccacagatgttaaatggttaagtaacttaatttattacatgaac

SEQ ID NO: 25064 - DNA, 795 bp, Neocallimastix californiae
  Glyco_hydro_catalytic_dom
agctattgattattttattgctgctgcatctcaaagaaatataagattggtgctaggttttacaaataactggactgattatggtggtatggatgaatgggtaaaaggttttggaggaaaatatcacgacgatttttatactaataaagaaattcgtaatgcatttaaaaggtatattaaaactgtaataactcgtattaatcgtcatactaatattcgttatagagatgatccaacaattttttcatggcagttggcaaatgaaccaagatgtggtaatggtccatctggacttcctcaatcagggaagtgtactccggaagttattactgaatgggctgatgatattagttcgtatattaaagaattagatccaaatcatcttgtctcagttggtgttgaaggttttggtcttgaagcacctaaaggatctaaaggattatatgcatataaatatgatgaaggaactgattttgaagcattaaccgcattaccaaatgtagattataatacatatcattattacccaattccatggggaatgacagacttaatttctcatactaaagattggattgaatcacatcaagctgttggaaaaaaattaaataaacctgtagtttttgaagagtggggtcttgaagtaccgaccgattgttcaaaagaagaacgaattcaatattataaaacttggacaaaacaaattcttgatgctgatgtaccaatgaatatgttttggtacacagttggagctgattattatggaactgataaatatattcttaaggaagatga

SEQ ID NO: 25065 - DNA, 930 bp, Neocallimastix californiae
  Glyco_hydro_catalytic_dom
ctatgctaatggtttcagaattggtgttgctgctaacactatgaaatttaataatcaagcctataatgaagccttaaaagcctttaattatatggttgctgaaaatggttgtaaattgtctggtattcaacagcaaaaaggtgtttacaacttcagtgattgtgataaccacttaaagaaagctaaagaattaggcatggacttccgtggtcactgtcttatctggcactcataccaaccatcttggttcgaaaatgctgatgcaaacaccttaaagaatgctatcgttgatcacattactaagactttacaacactatgaaggaaagattgatacttgggatgttgttaacgaagctattgatgacagttctaatggaaatggttggaaaatgcgtaactccttcctttaccaaaaagttccaaactttgttgatttagctttccaaactgctcgtaaagtttctccaaatactaaacttttctataacgattataatactgaaggtatttatggtaaatctgaatcggtataccaatttgtaaaagatatgatttctcgtaacattcctattgatggtgtaggtattcaatatcatgtttctgtttcaagtcagccaaaatacgaaaaaattaatgatttaatttcccgttactgtaaacttggtattgaagttcatattactgaactcgatgttaaatgtgataatcaatgcaacagcaataatgttgaacaacaacaagctacagtcttcactaatgctttaaaggcttgtttcagtaattcatgctgtaccggttatcttgtttggggtgtaggtgataatgatagttggttaggttctgacaagaaaggtttacttttcaatagtaactacaagccaaagtctcaatacaccgctattcttaatttcttaaaagaaaacaagcc

SEQ ID NO: 25066 - DNA, 1059 bp, Neocallimastix californiae
  Glyco_hydro_catalytic_dom
agaagctccattccgttttggtgttggtttaaacggtgctagtattgaaaattctactgtttcatctaaaactatgagagaagttatcaaacatcaattcaattctgttacttactcaaaccttatgaaatcattatttattcttaatcaagaaggtagtattaagaatcttaaagaaggtaaacaagatccagctttagatttcagtggtattgttgatggtttagatttctgtcaaaagaatggtattcacatgagaggtcatgttttagtttggcacaaccaagtcccaagatggttcttcaccaaagattattctgaagatggtgaatttgttgatccagaaactatggaataccgtttagatagtttcattagacaatatcttggttttgttcaatactactacccaggtgttgttgatgtttgggatgttgttaatgaagctgttgaagttgttggtgaacaatatgataattctactggttggtacactcgtactttatatgatgaagttaaaccaaacatgtggtatgatatgtttggtccagattacgttgttaaaactttccgtattgctcgtaagtatgcccttccaaatgttaaattagtttacaacgattactgtacttatgtcactaaaccaattagtaagagagatgctattgttaaacttcttggtattttacaaaaggaagatttagttgatgctattggtatgcaatcctacatcaacccagaagaagatgttaatgaccatttagcagctattgaagtataccaacaaaccggattagaaattcaaattactgaattaactattcgtgttaagaatactgatgactgggaagaatacaatattcaacaatacagtcaactctttgaaggtattatgaaatatgttagaaagggttacaatattggtagtgttactgttttcggtttacaagatggatacagattctatgaaaacgattccaccaagactcgtctcttcgatcacgatcttcaaaagaagaaggtttaccgtgctattatggatatcattaaggctagtaa

SEQ ID NO: 25067 - DNA, 1071 bp, Neocallimastix californiae
  Glyco_hydro_catalytic_dom
agaagccccattccgtttcggtgttggtttaaatggtggagccatttctacttctactactacttcaaaaaaaatgagagaagtcattaaatatcaatttaactctatgacttatactaatcttatgaaaccagaatttgttcttgataaggaaggttgtctcaaaaacgctgaaaatggatctgaagaagtcgtattaaaatttgatgatattgttgacggtttagattttgctttaaagaataatattcacgttagaggtcatgtattagtatggcacacccaaactccagattggttcttcagaaaaggattcaattctgaaaatgaatttgctgatgttgaaactatctatcaacgtttagaaagttatattcgtcaatatcttggatttgttcaacacaattatccaggtgtcattgatgtttgggatgttgttaatgaagctattgaaattaatgatggatatttcgataactctactggatggtataccagagtctctactcaaactgaagaaagtttatggtataagattgttggaccagattatgttaagaaaacatttgaaattgctcgtaaatacgctcttccaaatgttaaattagtttacaatgattacaatactttccaaacctatccacatgataaaactcaagccatcattgatcttatgaatattttaagaaaagataatttagttgatgctcttggtatgcaatcttatattggtgaaacttggccaaagattgaagaatatgttagagccattgaacgtttcactgaagctggtttagaacttcaaattaccgaattaaccattaccccaccaagtggagaaggttggttagaaaaacaagctcaacaatatcgtgaattctttgaaaaagttatggaacaaattaataagggagctaatattaccagtgttactgtatttggtattcaagatggatatagattctacacctctgacagtactaagactcgtcttttagatcatgatcttcaaaagaaaccaaattacgaagccattatggaagttttaaaagccaataagaagtcagaaca

SEQ ID NO: 25068 - DNA, 1035 bp, Neocallimastix californiae; identical to SEQ ID NO: 13708
  Glyco_hydro_catalytic_dom

SEQ ID NO: 25069 - DNA, 129 bp, Neocallimastix californiae
  Glyco_hydro_catalytic_dom
agttccacaagtctggtgggataatggtatttttgaaggtgaaggtgaacgttttggaatatttgatcgttctaatttgaagattgtttatccaggcattgttgcagccttacaaaagggaagaggatt

SEQ ID NO: 25070 - DNA, 963 bp, Neocallimastix californiae
  Glyco_hydro_catalytic_dom
tcaacaagtcagaccagatttctattttggtgttgcaactcaaaaaactttctttgctaacccaaaatacaaagatatcatgtcaacttttaatttagaagttggtggtaacgaatgtaaattctatactataaatggatctgaaactttcaacactaaggcttgtgatgaatctattgcttttgctaagaaacaaggtgctaagtaccgtggtcacaatcttttctggccagctaattctccaagttggtttaagagtgcttacgatggtaaagacccagaagaagttaaggaatacattcttgactacattacaaaggttttagatcattacaaggatgaagaagatatcatttactgggatgttattaatgaatcagttaccgatgattctaccccagaaaatattaaattacgtaccggatccgatactagtaatgaatttaagggttgggatacctatactgaagatatcttcaaacttgctcgtgaacacactaatgaaaatgttaaattaatttacaatgattataatgctgaagctaatggtggaaacttcggtggtaagactggtgctgtattccaatacattaaatccatgaaagaaaacggtgttccaatcgatggtgttggtttacaaatgcacatttcttgtaattggactccaaattacgaagaacttactaaattaatttctcagtatgaagaaattggtgttgaagttcatgttactgaaattgatgttaaaatggagaactgtaaaactcatgatgatcaaaggaaggtatacatgaacatcttcaaagcttgtttcgatcatgaaaactgtaaagtcttcactgtttggggtgcttacgattctgaatcatgggttggtgctgaaaacgaaccacttattttcgatgaagatatgtatccaaaggacatttactttgacatgttagattacgttatcgataaatt

SEQ ID NO: 25071 - DNA, 1032 bp, Neocallimastix californiae
  Glyco_hydro_catalytic_dom
aggttacttatctactaaaggtaaatacattgttgatgaaaagggtcgtaaagttaaattagctggtctttcatggtttggaggtgaaactccaaatctttcacctcatggtttatgggctaaaccattagctcatttcattaaagtaattaaagatcatggttacaaccacattcgttatccatggactaatgaaatgtttgtagaaggtgcaaagactgaatctattaatgctatggaaaatccagatcttgttgatcttactccattagaagttatggatgcagtaattgatgcttgtggtaaggctggtttaaaggtttaccttgaccgtcacagaccaactgccgctggacaaagtgaattatggtatatttcaaaggttgatgaaaagaaatggattgaagactggaaattccttgctaagcgttataagggaaatccaaccgtaattggtgctgatcttcacaatgaaccacatggtactgcttgctggggatgtggtgaaactgaacgcgattggagacttgctgctgaaagatgtggtaatgctattcatgaagttaacccagactggcttattattgttgaaggtaatgatcactttggtgaagaaggttggcaaaagggtgaatcctactggtggggaggtatgttaaagggtgttaaagaaaacccagtcagattaaataaaccaaataagcttgtttactctgctcatgactacgataagaacgtccatatgcaagaatggttcaagctttctactttcccagataatatgccagaaatttgggatgatgtttggggatatatttctaaggaagatattgctccagtccttattagtgaattcggttcacttttaagagataagactgatgttaagtggttagaaaaccttgtttcctacatgaatgataatgctgttcactggactttctggtgtttaaatccaaattctggtgatacagaaggtattcttggatatgattgggaaaccgttaatacccaaaaagatggtattcttga

SEQ ID NO: 25072 - DNA, 1092 bp, Neocallimastix californiae
  Glyco_hydro_catalytic_dom
attcgaaggttttggtaccagtttttgttggtgggcgaacagacttggttactctgatattttatctgaaaaggctgctaccctcttctacgataaaaaggaaggtttaggtcttactattattcgttataatattggtggtggtgataatccatctcataatcatattactagaacggattctaacatgccaggttatgccattaatccacgttataacggtaatggttcctacacctgggattacaattggaatagtgatttcaatcaaagaaatgctctacttaaagctatcgctaagaacaaggaagaaatcatcgttgaaggtttctctaattctccaccatactttatgactaattctggttgttcaaccggtaatactgatcctaataaggataacctaaagagtgacgcctatcctgcttttgctaaatatcttgcggatgttgcggagcacttcagcaaaagttggggagttaccttccaaagtatgaccccagtcaatgaaccatttactaattactggggagcaaatagtaaaaaacaggaaggatgtcactttgatcaaggaaattctgaatcaaaaattattgtagaacttcgtaaagccattgatcaaaagggcttaaagagtattcaaattagtggtacggatgaaactagtatcgatactcaaattacttcatatgaaaaacttagcaatgaagctaagaatattattactagaattgatacgcatacctatagtggtagtaaacgttatgaattaagagttcttgctgaaaatagtaagaagaatctttggatgtctgaagtcgatggtggaggtgttgcaggaacaaatgctggagaaatgggtgccggtttatggcttgctaaccgtattattgaagatttgaatggtcttagatcctctgcttgggtcttatggcaagtgattgataatcatattagtaagaatggatacaatggtaaaaaggatagtggtatggttaatttgaatggtggttactggggtattgctgttgccgatcatgataagaatgatattattcttacgcaaaagtactatgcttttggtcaattctc

SEQ ID NO: 25073 - DNA, 1050 bp, Neocallimastix californiae
  Glyco_hydro_catalytic_dom
ctttggttgtgttggttcatctttagcattaaccacgaaggaagtgattaaagatatgggacttggttggaatttaggtaatactttagaagcatgtggagattggattaatggtagtaccactaaacaatatgaaactgcatggggaaaccctgaaaccactgaagctatgattaaaggtgttaaaagctatggtttcaagtcagttcgtattccagttgcatggagtaatctcatgtcttctgattatacgattagtccattattacttaaaagagtggaagaagtagtcaattatgttgtcaaaaatgatatgtatgctataatgaatatccactgggatggtggttggtttgaaaaattttctacctcggaacaagaagcatttactaaatacaaaaaagtttgggaacaattaacggattatttcaaaagttttgatgaacatttaattttcgaatcattaaatgaagaaggttgttgggattccatttggaatcgctattctaaatctggtgacaaggccaaagcctacggtttattaaatacaattaatcaaaactttgttgatattgttcgtaattctggtggaaacaataccaatagacatttacttttagctggttattgtacagatattgacttaacggttgatgaagcctatgtggttccaaaggatgatagagttatggtctccgttcactactacactccatccactttcactcttcttgaagaagatgccgattggggtaaggctgcccctacctggggtacggatgatgaagttaactaccttattaatgatttcaataaattaaagacacgttttgttgataaaggtattccagtcattattggtgaatatggtacaactgctaaaaataaagataccgaaagtattcataaatatttaatgacatgtgcagaatatgccctaaacttagatatgtgtccagttgtttgggatgcaggacaatactttgatcgtaattcattaaccttcaaggactccgaaattggagaattatataagagtctttctggtaa

SEQ ID NO: 25074 - DNA, 1062 bp, Neocallimastix californiae
  Glyco_hydro_catalytic_dom
ttttgttcaaactgatggcaccaacttcgtggttgatggttgcaaacgttatttctctggttctaatacatactatttaatggtatcaaatcacgaaagagttgatttagctcttgaagcttatgctagacataatcttaatgttgttagagcttgggctttctgtgatgaatgtgaagatgctacaagattagttgatttttctggtccagaagttacccttaatagtgaaaacatggaaaaggttgattattatcttgctgcggctgctcaaagaaatattcgtgttgttttaactcttacaaataattggactgattatggtggtatggatgtttgggttaaacaatttggtggaaaatatcatgatgaattctatacaaatagaaaaattgttgaaggttataagcaatatattaaagctatgattaatcgagttaacacttacactggtcaattatataaggatgatccaacaattttctcatggcaacttgctaatgaagcccgttgtaacaatggaccacatggtcttccagttaaaaattgtaatactgatactattacaaattggatggacgaaattgcttcatttatacatcaagaagatccaaatcatttagtttcttctggtattgaaggtattggtcttactccaccatcgggtgttgatccaaatacttatgtttatagatatgatgaaggaactgattatgaagctattagtgctcttgattctattgactataatactgttcatatgtatccagttggatggggactaaaggattatagcaaagatggtgttacatggattaaagcccacgctgatgttgataagaaatttaataaaccaactgttgttgaagaatggggtcttagtacttcagcagataatgttccacttgaagaacgtgatccaatttatacaaaatggatggatgctgtattggctaatgataatattggtatgaatatgttctggtatgtttgtggtgaagattattatggaactgatggttatttattagaagatgatgaaattacagctgttattgatcc

SEQ ID NO: 25075 - DNA, 615 bp, Neocallimastix californiae
  Glyco_hydro_catalytic_dom
accaggatggccatacaattggccaggtatgcaaagttggttaaaccaagtcaaatctttcattaatgataaaaagaagtcaggattaaccaattggtatggtttagaaatttggaatgaaccagatggtacttggaaagattctaatggaagtttcaatcaaatgtggaaacaaacatatgatgttattcgtcaagctgatccaggagaaaaaattattggaccatgttacagttggtatcaagaaaataagatgaaagactttttacaattttgtaaacaaaataactgtttaccagatattattagttggcatgaattgagtggtattgaaggagtttctagtcacttaaaggcataccgtaacttagaacgttctcttggtattaaggaacttccaattagtattaatgaatactgtgatgcggaacatgaattagaaggacaaccaggatctagtgcacgtttcattggtaagtttgaacgttacaaggttgatactgctatgattacttggtggtttgttccacacccaggtcgtttaggtagtttaatggctacagacaatcaaaagggagcaggttggtacttctataaatggtatggtgatatgac

SEQ ID NO: 25076 - DNA, 615 bp, Neocallimastix californiae
  Glyco_hydro_catalytic_dom
  modified_base (73)..(73): a, c, t, g, unknown or other
accaggatggccatacaattggccaggtatgcaaagttggttaaaccaagtcaaatctttcattaatgataanaagaagtcaggattaaccaattggtatggtttagaaatttggaatgaaccagatggtacatggagagattctaatggaagttttaatcaaatgtggaaacaaacatatgatcttattcgtcaagctgatccaggagaaaaaattattggaccatgttacagttggtatcaagaaaataagatgaaagactttttacaattttgtaaacaaaacaactgtataccagatattattagttggcatgaattgagtggtattgaaggagtttctagtcacttaaaggcataccgtaacttagaacgttctcttggtattaaggaacttccaattagtattaatgaatactgtgatgcggaacatgaattagaaggacaaccaggatctagtgcacgtttcattggtaagtttgaacgttacaaggttgatactgctatgattacttggtggtttgttccacacccaggtcgtttaggtagtttaatggctacagacaatcaaaagggagcaggttggtacttctataaatggtatggtgatatgac

SEQ ID NO: 25077 - DNA, 984 bp, Neocallimastix californiae
  Glyco_hydro_catalytic_dom
tttattttctatcataggatgggcaagtaccacattagcagccctaactactgaagatattattaaaggtttaactgttggtgttaatttaggtaaaacatttgaaattaatagagattggaaatcggttgaaaatattaatcaaccatgggctgaaaaaaattttacagcaaaagaaattgttgagagttataaacaattaggtttcaatgccattcgtattccggtaaaatgggcaaaaactatcaattctaaaacagttatcgaacctaatttattaaaaagtgtagaagaagtggttcgtcaaaccctaaataataatatgtttgctattattaatttagaaacttcaaatactttcatgacaggttttatttctgaagatgataatatacgttccgaaacctatgatggttataaaggaatatggaaacaaatttcaaattattttaaggattatgatgaacatttattatttgaatctatgaatgattctggttattgggaagatatatggaatactagaacttctgatggggatagacaatatgctcttgatatattacgtcaagtcaatcaagaattcattaatatggttcgttcaacaggtggttcaaatgaagaaagatatttattagtcagtggttatgctaatgatcctatcctaactcaagataacttctataaaattccaagtgatccttcccataaacttatggtttctctttattattatgttccaaatcattttactatcatcgataattattatacttggggttcacaagatgacattaaacagcttcaaactattatgaaaaatcttagtgttcgctttgttattcaaggtgttcctgtagttatcactagatacggtactattgtaaaaaatagaagttcagctaatattcatagttatttaacttccattgctaataatgcatcttctaaaaatataccatcctttttaagtgattctggtga

SEQ ID NO: 25078 - DNA, 1107 bp, Neocallimastix californiae
  Glyco_hydro_catalytic_dom
tttttataaaggtgtcgacatttccagtattatttctctagaaaatagtggtattcgtttctacgacactaatggtcaacaaatagacatttttaaaatgtttgctagtgttggggttaattgtatccgtgttagaatttggaataacccaaagagtgctaatggaaaaacttatggtggtggtaataatgatcttgaagtagctagagaaataggtagtagagcagcaagtgcaggcctaccattatttgttgattttcattattctgatttctgggctgatccaggaaaacaaactattccaaaagattggaaaaactttaatcttgataaaagagtctctgaaatttatagatttactaaaggttgtttagaatggcttttacaaaatggttctcttatttcaatggttcaaattggtaatgaaactacatgctttatgtgtggtgataaaaatatgacaaatgttatgaaaatgatgagcaatggtgcaaaagctgtacgtgaaattaatagagatatattaattgctcttcattttacaaatccaaataaatcagacaatatgttatggtatgcttctcaactcgcttctgctagagttgattatgatgtttatagtacttcttactatccatattggcatggtactactgataatttaaaatgggtattaggagaaattgctaataaatatggtaagaaagttatgattgctgaatattcttacccatatactgaagttgcatatacatcagataattgtcattatggtgttgtagactctaaagcaagcggtactgtattccgttatccaattagtgttgatggtcaaattcaatgcattagagatatgtattctgttatgagaaatacaaagaatggtattggtgctttctattgggaaccagcatggattgctccaaaagcaagaaatgatatggaaagaagacaaatttgggagcaatatggttccagttgggctaccaaaactgcagctgaatatgattcaaatgctgatagaaaccttacaggaggtacatcatgggataatcaagctattttcgatcaaaatggaaaagttttaaaatctatttgggctttggg

SEQ ID NO: 25079 - DNA, 882 bp, Neocallimastix californiae
  Glyco_hydro_catalytic_dom
gcatgttcaaggaagtaaacttttagatggaaatggtaatgaatttattttccgtggtattaatattgcacatgcttggtatactgataagacggaattctccattaatgaaattaatgctttaggtgctaacagtgcacgcattgttttagcttgtggtgctaaatacacaaaaacttcatatactgaagttgaaaagatcatcggatggtgtgaaaaggctggtttagtatgtgttcttgaacttcatgactttacaggatctgataatccatccgatattactactactgctttaaattactggaaagaaatgaaggatttagttaatactcataaagattatattattataaatatagctaatgaatggcaaggtagttggaataagggatccctctggggtaatacttattcttctgctgttaaatctatgcgtaatattggaatccaaaatgcaattatgattgatgcttctggctatggtcaagaaacaggaccaatgataaattatgctcaaagtgttctttcagctgatcctaataaaaatgttattttttcctatcatgtttattcagttctcggtaaagacaatactagtttatactctggtttcgatggaataaaagctaaaggagtatgctggattgttggagaatttggttggtggcaaaatggaggagatgttgtatataaatcattaatgagttactgtaattctaatcgtattggatggattgcttggtcttggtcaggtaatggaggtattgacacctgtcttgatttaacaagttcaaaaaccttttctagaaatagtttgagtgattggggaaaatatgtattttattcaaatgatggaattaaatattcatctaaaaaagc

SEQ ID NO: 25080 - DNA, 1077 bp, Neocallimastix californiae
  Glyco_hydro_catalytic_dom
taaagcagctccattccgttttggtgttggtttaaatggtggtgctattgaaaactccacaacttcttccaaaacgatgagagaggttattaagcatcaattcaactccgttacctattctaacctcatgaaagcagtatttgtacttaatcaagaaggtagtattaagaatcttaagaaaggtaaacaagatccagttttagatttcagtacttttgtggatggtttagatttctgtcaaaagaatggtattcacatgagaggtcatgtcttagtttggcacaaccaagctccaagatggttcttcacgaagaactatgaagaagatggtgaatatgtagatgctaaaacgatggaataccgtttagagagttacattaagcaatatcttagctttgttcaattcaattacccaggggttgttgatgtttgggatgttgttaacgaagccattgaagttgttgataatcaatatgataaatctactggttggtacactcgtaccttatacggtaataactcaccaaacatgtggtatgatatatttggtccagattacgttgtgaagaccttccgtattgctcgtaagtacgctcttccaaatgtcaaattagtttacaacgattattccaccttcgtcaccaagccagtgagtaagagagatgctatcattaaacttcttggtattttaaagaaggaagatttagttgatgccattggtatgcaatcctatattaatcccgatgaagatattaatgaatatttagctgctgtggatgaataccaaaaaactgggttagaaattcaaattactgaattaaccattcgtgtgaagagtacggatgattgggaagaatacaatattcaacaatactctcagctctttgaaggtcttatgaaacgtgttaagaaaggttacaatattggaagtgttactgttttcggtttacaagatggttacagattctatgaaaacgatactcaaaaattccgtcttttcgatcacgatcttaaaaagaagaaggtctaccatgccatcatgaaaatacttaaaggagagagtgctacagatagtga

SEQ ID NO: 25081 - DNA, 993 bp, Neocallimastix californiae
  Glyco_hydro_catalytic_dom
tttttttataattgaatgtgccagtacagctttgagtatagcacttaaagatgttctaaatggtatgagtgttggtgttaatttaggtaaaacatttgaaattaaaaaagattggaaaactgtggaaaatataaatcagccatgggataaaaaatcatttacagcaaaagaaatagttgaaagctataagcaattaggtttcaatgccattcgtattcctgttaattgggctacaaaaattaattcaaaaactattattgaaccaaatttattaaaaagtgttgaggagatcgttcataatactatagataataatatgtttgctattatcaatttagaaacttcaaattcctttatgacaggatttatttcagaagatgaagaattacgttctgaaacatatgacggttataaaaatatatggaaacaagtttcaaatcattttaaggattatgatgaacatttattatttgaatcaatgaatgattccggatactgggaagatatttggaatacaagaactactgatggtgatagacaagctgctcttgatgtattacgtcaagtaaatcaagaatttataaatgcagtacgttcaacaggtgacaataatgaaaaaagatatttattggtaagcggttatgctaatgatcctattttaactcaagataacttttataaaattccaagtgatccatcccataaacttttagtttctctttattattatgttccaaatcatttcactactattgataattattatacttggggttcacaagaagatgttaaacaacttcaaacaataatgaaaaatcttagtattcgttttgttattcaaggtgttccagtgattataactagatatggtacaattgttaaaaatagaagttcagcaaatattaatagttatttaacatctatagttaataatgcatcttctcaaaatatgccttcctttttaagtgattctggtgaatttattgatcgtga

SEQ ID NO: 25082 - DNA, 1056 bp, Neocallimastix californiae
  Glyco_hydro_catalytic_dom
tccaggttatttccatgttaaaggatctgaaattgttgatgaaaatgatgaacccgttagaattgctggtgttaactggttcggaacagaaactgctcaattatccccacatggtttatggagtaaaaatttaactgaaattttatatttaattgtagaccatggttataatactattagatatccatattgtaatgatatctttaaaccaggagcaagtacagtttctattgaatattatagaaatccttgggctaaaggtttatctccacttgaagttatggatgttgttattagagaagcaacagatttaggtttaaaaattatcttagatcgtcatagaccagattttcaagctcaaagtgctttatggtatactagtgccgtttctgaagaacaatggatttcagactggcaaaaattagctaaacgttacaaggataatagtggtgttattggtgctgatttacataatgaacctcatgatgaggcttgttggggttgtgatgacatttccattgattggcgtttagctgcagaaagatgtggtaatgctattcatgaaattaatcctaactggttaattattgttgaaggaattcatcatattggtgaaacttgttggcaatgtggtgataactactggtggggaggatatttaaagaaaggtgtggttgatattattaataaacctgtcaatttaaagattccaaatcgtgttgtttattctactcatgattatccaagagaagttttcccacaaacttggtttgatgatccaactttcccagataatatgccagacaaatggtacaattattggtcttggattaagaaggataatattgctccaatattagtcggtgaattcggaaccaaattggaagatgattgggatagagtttggttaaagactcttgttaactacatgaaggaaaatagacttcattggaccttctggtgtcttaatgagaatagttctgatacaggtggtttaattactggtggtgcatgggatggatggcacgacgaaaaagatagtatgttagaaccaat

SEQ ID NO: 25083 - DNA, 738 bp, Neocallimastix californiae
  Glyco_hydro_catalytic_dom
atgtaaagattcaaatttagcaaaatcaattattatttattatccagaatggaagtactataactatccaccaaggaatcttccatttaacaaacttactcatataaattatgcctttggtgaaattgatccaactaattattcattaaaatatgactctactaagtttttagaattgattgaaactgctcgtagtagaaataaaaatgttaaaattataatgtctgttggtggttggactggaagtagatatttctcagttatgtcatcaaatcctgcaaacagatccaaatttataagtagtgttaaatcgatgttagaaagtactggtgctgatggtattgatattgattgggaacacccaggagtacctggtgctttttatgatagttttgatgcccaaaatgatacctataatttattaaaattgatgcaagaattacgtgaagctattggtaaatcaaaaattatttcaactgctgtaacgttcaatttatttgttgtgaactatcaaccattacaagacttatctaaatttgccgaaatattagattatattaatcttatgtgttatgattttaatggaagttggtcaaatattatatcacatcaatcttcactatacccaactggaggaaatgatagtggattttctgtagaaggtgctgttaaaaattggatgaatgctaaatttccatctaacaaaattgttattggtattccttcttatggtatatc

SEQ ID NO: 25084 - DNA, 120 bp, Neocallimastix californiae
  Glyco_hydro_catalytic_dom
gaaaattaaagctgattatgtaatcgaaagaaatttaggaggtatgatgatgtgggaaattgaagaagatacaaaggatggtgaattaatttccaccgtttacgacaactttattggttt
